United States Patent 9,976,180 (METHODS FOR DETECTING A GENETIC VARIATION IN SUBJECTS WITH PARKINSONISM) - sequence listing, part 26

SEQ ID NO: 386 - DNA, 880831 bp, Homo sapiens
ttagaagctctgagaaatcatgggccgtgcggtaggggttgaaatgctcaaaggtccacacttcttgaaataaacagaatggtcttgagtggattgcaactgttttggaaatagctttgtgaaaagagggtggagagctactcaaaattctacgttagagagactgaaaagacatctaatttcattgctcggcaggtaagtgatagcgctattatttttgttttttaaaattctaatgacttgtcttatggtttaacagaaagatcataagcagtgtaattttttctggggttaacgaggagacaagcaattttgttttaaaataattgtttctggatcattgtgtgacaagaagaatcaaaataacatacatgttgccttacataattacagtaaacttttagctggccatttttcttattgcttatctaatatctttttggatctggcatatcttgtttattttttcccaaaactaatgcaatcgtttggcaagataattttgttgtcttatgtatgccataaaaagtgatcctgtctgtgttacatagtatgcaagactaaaaaagttaaaatagagagggtttaaccatgccctctaacatattttatattgttataatatactaaactatgcatgggaacaaatacatgtatacatatacaccagatttctcactccatgccaacctccaagtatacctacacctgtaggatcttacgtaaggagacactcatatttttacttagcaccctctttccagcctttgaaagctcaagattgctttctcaaacctgatctgccagaaagcagaaaatgagaagctttagtgtgcctctttaggagagctggatttcaaaatcattctaacttattagttctgcaaaatacatttgtcagtgaaatccagaaagtgatagggaccagtaggttcccgaaaaaccataaactttaaaatgctaattaaatctgttttctgttgattcttatttctagttttcccctggagctttaaaattacaatctttcacagtgaccttgataagcattctgctttaataaaaagggttcactgggcaaaagcagttacacaaatttgtaacccgtgcctgacatttcactaagaatccgatcaattccaatgagtacattcagttcagtgaagagttttgacttgcaaggatggaattttacagtcatgtaaatacatgtgatgagatattcataatcaactctgtgaaaagagtctacccctttgaaaaattacaggagatctttaggttttacttttaatttcactggttgtgtgtaacgatagtaaaatggctctaatgcatatctatacgtaccttccttctcaattttaacacaaaaatcattggaggccgttacagtggcattcattggtggggtgatgtcctcttgttttatgttggctgagtgtagcaattactctgaggaaaaatcattcttaactgtcaccacttaccatgaacctgcttgcttagcagaaaaggagcagaggcatctatgtcactgagctccttgggggctccgttgccctatataggtcaagaatgattatctgaggaggagaaacatgtattattgatttggattccttcccagaaaacctacaatgtgctcttaacacaatcctttttttcctcagtgggagaggtatggaagtgaaattatcacatggaagacttaatcatattttaagagagttacagcatgtctttagacaattattttggctgtcaattaattaacacagagggactcccctagtcagtagggcataaaatgtaagcagagaatgtgtttcaagaagcactcctctgtgtatatggccgcagttccctcctcaggggcagagggggcaggctttctctatgtgtaactgaaatctcacaaagtgaaagttacctttgcctaatcccttaggagatttagtcacagaaatatgtaactctaattcaccccaaactcatgaaactgcatggaaacccttgtcaatccttatctgtagggaaatgtccttacattgagatagagtttgggaaagcaacttaatgcctaccaatgctaatctctaattgtaaagtagatagtcaaacaaacaaacaaaaagggggtagtggaaaccaatcttcattattgcacagaatcacttgtctttaaagaaaaatcaacattttattaagggatatctgtaccccactaagggcatctatttgctttgatagttattttgttttgctaaagaaaaaggatgcatgaggtcttgggagtaccaaacacactatcttttccccattaaaaaaaaaaaaaaagttttattggataagactaagtgttgttggctgttgcttacatttgagactcaaaagagaaaggtgagatgggattacataatctagaaaatgtaaagtatatataggaccagaggataatttaaaatgagccctggaatccattcaattgccttcttccaaaatgttataaaaacacttcttgattaatttttgcatagactatataaatattacttgtatattctaatgtaattattcataccatgaaatcgtattggattttaatgctcacagtttgcctttggagttatttacttgggtttcaatcaagttcaaacatttatcaaaaaatataaaagtaaaaaatgactattgctaatatttagtaattggctgtttttgaccacttaaagatttataaattccaagcagctagcctgcttactcacctagttctgttaagcaacacaaaagccactaggaaagaaaaaagcatattgtaagctagaaattatttccatagtaatctcaccttcccagaaatctgtacagtgtgttatagaatagaattcaaatggagagagatctcttatttggtgttttcttcctatttagcttagcagagtgagcacatagcatgtgttggaagagacaacatcctgtggtaagaaacatgttacacatcatgttgtagggaaacaagtactacttgacagtcaaaagatcagaattttttaactgctggccataagatcttctacaagtcactcaatccactgcagctgaatttttcttccttaaatttggggattctttacttttcaatgaagacacaataatttacatacagctgatacctgaacactcatgagataagtgaatgatgcctactttgtgggatactggaaagtcgaaattcaatgattttgagagtgttttggaaacaagtgttatatctgtgagttattataaataatttccaatagcattcattcattcgtcaaaaaaaatcccactaattactaaataacaggcacatcccttatacttaacaactctcagcatagggaatataatacttccctgatacttcagcagtcatttcctttacatctcttaatggtataaatataagtgatattcaatgaaggtggacttggtttcaaaaatattttattactcagaactgacaccacattctatatcaattggacaaacttagttgacctgagtctatttcaacaactttcattttgaccttcaaagaatctatcatgtcgtgtcataattttctagtttataaaggaggattaatgtttgtcattagtgatattgataaggaaactcatacgatgaaatacacttcaaaactccatatcctaaaacatacagaaagcattgtgatttgactgctggcttgtgagcatggagtgaaatgtggacaacatgcgggctgatctaaggggctagcctggaaatgctgttaagatgttgttttgatttagtcgaaagcctagattttattcataggcctctttaggacatctctttagaaaatcgaataagcagtatttcattgcttatttgcttttcttagtcgggttttaaacgtcactatgattttttcaatgtaatttatcaacatttggtctgtatagatttctagactatcactaaaaatatactgacagtattcttaggaaatataagtcaatgtttggtgttacagttatttccagcattgttttgtggttaaattatataattgcaccagcgataaaaaattatatcatcacttacttagtaatataattcagatttttttttgtcaaatacacacacacacacacaaaaacccagaaacagtcaaaaacataaaatgaaaaagaactgagagtaagaggtcattaaaataatgtcttgaggccagagaatttatctttgaattatccttaaattttcaccgtgaagtttcttcagcacattctacacactgaaagagtcagaaaatcattttgggtctcctgaatttggtcttcaatttgtcagcaaagataaagtgatcatgttatattttttttcaaaaagagtgtcattaaatcaattcatttgaatacttgcttattatcacttcatcatatgtaatgtacatacttgaagatatttttaaaattaaaaattgtgaagtaattatatgctctatgtttaacaaatttactcacaatttcggtctaagatttagttttttaaaagaataagtgcttgcctggtaaattcactaaataagctaatagaaaatagaaatcttttagaaatggtgccaaaatttgaacaataatgtgttacttatataaaactatgaaaaggccaagtacagtggctcatgcctataatcccaacactttgggataccgaggcaagaggatcacttgaagccaggagttcaagaccagcctgggcaccacagtgagacctcgtttcttcaatagaaaaaaaaaacataaaaaataaaaaaataatatctgggtgtggtgaatgtgcctgtagtctcagctactcaggaggctgaggtaggaggatcacttgagcccagcagtttgaggctgcagtgagatataatcacatcactgcactccagcctgaatgagattctatctcaaaaaaatatatatattaaaaataataaattttatttgaatcttttcaaggggtgagaaataagtatgtgagattaagaaatttagatcatagatgagaaaagagtattttatggttaaaaatgcatccagtacacacaaaatctgaggttcaacatggtttgtcatcaattggttgtgtggacttgggtaaatcactttatcttaatttaactgctcagctatatccttggtcctattggtaaatcattattatgtccatgagaaaataaacaatgtctatgtttagttgaactcataaactttccttccacatctgtcatgccattcttcttgaaaatgtttccgtgctctcatggtggaacatacatgggatttagaatcagacttaagttcgaatcctgttatagaaatggcattaatgacaaaaacttgggcaaggaatgtgaagtctctaagtctgatgtccactgcagtgtgttgctgggaacagttaatgagcaaattgtatacaatggctagtacattgaccgggatttgttgaagctggtgagtgttatgacttagcctgttagactagtctatgcacatggctctgatcaactaccgctctctcatttctccagataaatcccccatgctttatattctcttccaaacatactatcctcatcaccacatagttcttttgttaatgctttgttctagactttcccttttctgttttcttattcaaacctatatctctttgcatagattgtaaattcaaatgccctcagggtgcaggcagttcatgtaaggagggaggctagccagtgagatctgcatcacactgcagaaagtgagcccgtcaagagtcctcgactcagctctgctcagttagaacaaaacgtgagaactgaaaatagagaattttgtgtgaaatctactttttgctttacctaatttcattgttaaaattttgcatgtagcgaaacagactacatgctagattccacacatagctgccgaaccttttcgtttcccatttcaatgacatttaatagaaaccctaaactgagatattcagtcagattttttccagacctttttgtttttatctagaaatgagacaatgaaccacgacttgatgaaaaggttcatcttaatatgtttttacaattttaaaataaataaacctaaaaaataatgagtggctgagataaaatagatacttcatgtttttgaatgggcaaaagttttgtggggaaaaattaactcatagaacaaataggaatgaagataggtcaataatattacataatatgttttattccagcatcttttccagctactgtttttgcccctcatacacatgcaacagctacaataacccagataataaccttgattaacagtgagactaagaaaagattattagttattgactaatatctgcaaatatcccttcttcccagaatacaaattttctacttttgtgcctactcatatgtgtaaaaacagataatttctttagaaagttattttttacatttcatcagcaaattataacacactctatagaatattctgttggatttcacaaattggaggcagatgtcttattgtatgttcggtgatgtaagtccacacacccacacaaccgcacaaacacagggatggataagattatgctttggtttgatatatggcaatttttttttgtaatttcttcttttctaatccttgttaatagtgactgtgccaaagggaaaaacaattctgcagttattgatggaaaaaaaggagcttattttgcctaattggtatttgtatattttaatttctttttttgctagaagtgacaaaatcccagcttaaagtggcttaatccaaataagcaactaaataaaaaatatatttgcaaaagagaattactggcttatgcagtagcagattatagcaggtatggcttgattaaagtgttcaaatactatccgcattcttcagtgttgtcttcattccaaagtacggtttgcctacgtgataacatttgcctctttctctgttctcactgtctttctccctcactcctgtctatgtttctgtttctgtctgtctcttttctccccctctcttcttcatctctttctctgtcttactcacctccttaccagttatagttctacagtgtttccttcccaaatccagttcacttcctcaatagttccagtagatgtactgggattgaccaagggaatattacatattgggctggatcttgaagtaggatgggctttacaaaaccacactgattgaggggtattagttattgactaatatctgcaaatattccctcttcccagaacacaaatgactagcatagtgcagttttcagtgaaaggggagactacattaaaggatagaaaagaacaacacttgtcctctacaatgctagtgaagaatctacccaagatttctaagtcactgaatttatctactgctgagggaatactcagcaaaagtgggctcattggcttgttgtttctctaaaagcttttttttcctaaggaaagaatgtcttaagatgaaatgtttgactttaaatgtaattaacatatcaaagttttgtgggtgtccttttactatattattaacaaatgaataatatgaaaaggacacacaagtggattaaaaaatcattggggataaaaaaatagttattccagaacagttattttttctatatttggtgacttttttcagtagttttaaatgatatttccttatttaacacatggtggagcctgttccagcttagctagactatttcccttttgttttcctggtctggttttaatcttgaagaagtaaaactcccgaaagtagattaatctacttgtgtacattttacaccattattatagatgagccaatcaagagtaatacaatagcgcacacttagagtcaaagtaagtcagattgtggtagtttgtccaattcattaacttcataaattaactttatttttctcttcaaacacatctttttctcaacttaagaatccttttaagcgattagagaaaactaaaatatgtccattatctacctaagtcatttgcttttattttccatattgtgttcttttccaagaaatctccttgaagttggaactagaagtttcagtataaagtcttcatagggcataataaatgcatttgggaaaatgtaaccctacactttagtttccgttcgtaatactattttctcacattctatgtgttatacatgattgttagagtcctgttttagggaatctcatgtgattctcacagcaggactaggaagctgactttttcattcctgttttgcaaatgggacaatcaagctccaggaaagttaaatgcttctctatagattaagtcaaaattgagatttaggatcaatatttaatgcttttctattcataagtggtttaggaagaaaaactgcctctcttcttataacacctattataggcttgacttgctttagattgcagtaaataaataaaaaaacaaataaacaacaacaacaacaacaaacagaacagctgaatttcattgactttagttttactaactaagtaactggaggcgtttagattctcaagaatcttgaagggttcatgtgttatcttgatcttaatcttatacaaacagagaggtttttggacagcataatcacatgttgaaagtcatattttacaagcttcagggaaccatggtggaccagagttgattctattgcagaattcagacttgagatgatgagagctggacctaattgggtgaaggttagaaattagcctattaaaactaaatgactagatgttagtgatgccgctatcaaataaaacaagaatcaggaggaggccaaatgagatagtgtttttgtgtactaggtaaatgctcacatatgtaagtgtgaaatacgcttctttggaaggaaagatgtgatatctgacatgggacatgtcaaatggataatgagaggacataacaaccaaatgcaggtgaagaacccattaattttagaaagagggtaaaacctgacctatctaactcagagctaccgaagtggagattactgctaaagctatgaaaatttattagctatttgagagaataaaagaaaaacaattgtttacagacataaatatctttcaaaagtaagaaaaaaataagagaaaagaaggtcataaaagagtcgtagaaagtgtaggggaaaggtataaaggaaaatgcatggagttctaacaaacataccatggttaacagtgttgatactgcacagaagtgaaaggaatggatgtttgaggttcctttgggtttgctcaaaagcagatcacagggcatcctggagagaacgatttctgaaaaacgattaacataatgtttggactgtcagatcctcaagatcaaatcaaggatagacagtagaaagatcacgttcattctaggaagatagtagggatcagaagggattttgtgacaaggaaaaagcactgcagaattattgctgacaatgtgtgttatctcccttattgcttccggtttacagcctgctttagaattaggtgatgctgcatttctgggaatatgagtgctttgttgcatttgatcagatcaggtctgtctgtggtgattaaggtctagtgattggaattataaatgagagtatagtcaaccaaaaagatacacatactacctgggaagacatctgtttaaagttttcttttctccacctcattatatattcaattttaagtgatcatgtaaaatatgcataaaatatacacataaaatagtcaatagttgctcatttgttttagccactgagaattgactgagttctccacttggaacatgtaaggtagtgttgactttacttgaaaggctgacatccatttcagataacggtgtctctttttattttatcatcctattatattctcttctacgtgatttgccttctctgcttttcatgttgtgtaaaattttcatatttttctaaaagaaattttggagcatgaagaatgcatacaaggggtctgcagacccatctaaactttgttagtagactttatatctcactgcggctcaatgacctggaagataaactggccctgtctgttccatcagaacaacaggaatttcccgagttcaggcaaacagaagtttgcttttgtctgatactcaaatttctctctcaatcactcagattctccagataattgcctggcttttttcttggtactagaggagtgaattatctactttctggaggccaattaagttttctaaaccactagtgggcatttcagcaaattaccttttcagtgcactaaaaagctcctcagtaacccaaaagaattaatgtaccaccaaacagtgggcaatttattccctcaccactgatgagggcagacagtttagagcattaatgggagcatttacattgagtcacagtgaagtatggagtcactgagcctttgtgaagctaacccatggagggtgaggaggtgtttatcactgtggagaagggaggagggacaaaggagatgatccctacccttaaaagctgtagataatgctgtcagccattatctggatggaattcctatatcatcatctgtatatttggcaataataggcaagttaacaacccatggtcatgaataattatctggttttagagttgtataaaagtattctttgtgaaataatcaaatcttttattttttcatgtactgaccattgctatttttatcctggtcctgtttgtgaaatgggataatttatttctgtcaactaaaaaaatcaatgacttggatgtaaatgaacctactacatgtaactggttttggttttaactcttctcctgtttttctccataaatgtactgataaatgtaatgattcgtgtctactttattaattactgctatttcctgctgtggtagatattccacctgaaatatctggaaattcaactgaaagaattgtttaaggccctttttcttaggtctcatgaatcatatttcaagcaatatatgcatattactacataccattctaccgaataactcaaagatatcccaccttgtttttaggagatattgtcaaaaacactgacaaataccaaagatttcctagtcatgcttacgaatggataaaattgtttggagaactaaacaattctactatgtataattcaatgttgggattttgttaaaaaataaaattccttcaaatcttacccaatctttatttctgtgaaacatttttgggaggggaaaatatggataaaataggcctaatagtagaataatcaattaaatgaagcctagaaattatttacattatttttataagcatataaagtcttcaatagcctattttcttctgaggagaattaacaaaattccaaatgaaatacagtctcttccttcaatgtgtacttccagaacatttgcataagatcttcactgtaatgaagccaaattactcagccttttcacgtttataaaggatacatgttaagacattgagtcctaggaggaagatggcacttaaatacatgaaagttttgagcatcaatctcagactatattataactgctcctaatgaacatggaatttaaacaactggaacaaatccaataaggagaaaaaaaaaaggcttggcatctgatgagttacttagcatatctttttgtaaagaataaaagctctctggcttccaacaaagagtttgtgagctgtatggcagtgttttgaacaaggagatcatttataaatgctgtctttatttgggaaataattatgggatgcagctgcaagttttaatgacttttaataaagtatgttataaagtgaattagcaataaatatctaacagatgatactgaatcaagacattaaagaacatcattagacctatatcttggattgctaaagcaataaatgtgtttttgttaataccagtggttttttaattttctaggacattctgaaggaaattttaaggcaggttaatttttaatgaatagggttagtctatcaactagctctgctagcccagtacaattttagatatgtaactaatagggtatcaaagctgaaaactcttaaatttcaacaatatatagaattataaaataagtttcaccggtagtatctgaaaatacagtatttcagccacttaaattattatgactttcataaagaaaggtatatgtactttatagaggaaaaaaagtttgttagaaaatctgtgttcaacacttgctttgctggcattaccacaactaaatttcaatgtcaggtggtcagaataccaatgatcaggggcaaatacagataataacccacacttcctgtttgtacaagtattactatgccacctcagtatgcagaataatgcagtaaaaatttgttttaaaaaccaagtttagttaccaacctccagaagtgagcagagccgggctaacatagcattgtgatatcactataagctggctttggaaatgtactcacagatgatcaggttaggaagctgaccctcagaatgtctgcaatttgtttcaagtttcaaatttagtttatgagggagtttagacattaattatgttttatttcatgatgatactccaaaaaggctaaagaaaagttgaataatgtttaatgggtacctctgtatgtaaccatagttcagggcaaatgagcaatctaggatgctgagaaacaagagaagaggcaagttgtaagtcttgcttgacttctcaaatgatattcaatcatggttgaattcccttcgtagatgcagctattggccaggtgtagtggctaatacctgtaatcccaactctcagaaagtctgaggcaggaggatcgcttgaggccaggagttcgagatcagcctggacaacaaagtgagacccccccatcactacaaaaagtaaagtaattatccggatgtggtggtgtgtgctggcagttacagctactcaggaggcagaggcaggagaattgcttgagcccaggagttcaaggctgcagtgagccataatcataccactgcattccagtctaagcaacagaaccagtacctgtctctaaaaaagtaaataaataaaataaacaaattacagatgcagctatgcacagttatgttatatttaaataattacttgtcttttaactttttactttaattataaactgaaagaaggttgcagacataaatttctcatgaaaacttctccaacttccttcatgataacatcttacataattgtaatacaatacccaaaccaggaattgatattatacagtattgacaaatacactatagccttatttagatttcaccagtttttacctgaactaatttgcctgtgtgtgtgtatctgtctgtctgtctgtctgtctgtctgtcgctgtgtgtgtggagttctgtgtggtttatcccatacatagatttgtataaccactctcacaatcaagatatacaactgttttagcaccacaaataaacttccttggtttatctggtacagtgtgattcacacccagctaccctggaaaccactgttctgctctctatctctacaattttgtcattttgagaatgttacataaatggaatcatatggtatgtagcatttgagatccattttttgcactcagagtaaactatccaagttgttgcctgtgccagtagtttattcattttaattgctaaatagtattttgtggtattccagcttttccaatctgtttgctcatttagtgattgaaggacatttaggttgctttcagtttggggctactgtgaataaaggtgctatgaatattcatgtacaagtaattgttattcagtaatagagaactggaatatctccctatgagcacacttgatcacttaataggacgtaataacaatatattttgagaaggtaggtagaccaggtactagagaatgacttgaatcggtcatcctaagttttaaactctggttttcatgggtgggtgatggttttttactggttgccttttctctattagtttcagatatataatactgtaaaacaataataaggttctagaaattaatgtaaaatttaaacaaatcaataaacttcccacacaagtatcgattttctaagaagaggttctaggtaatgtcatatttacttgattttataattacccatatgttctattacgaaaaaataaataggtttgtgaaaggtaacaaaaaatctacacacaatttgtacaagtataatttttttacaatttatattttttagaagttcacaaatatatttataaaaactggagcatatattgtgccataaagaaaactatgctgaacttcaaatgattaaatttcaaacaccatgatgttatatcaatacaatttaattaaacataaattaattaaaaataactagagtttttcaacaaataaatatgaaacaactgaacattcacatgcaaagaaaatgagtctagacatagaccttaacagtattgacaaaaattaacttaaagtgaatcattcatccaaatgtaaaattcaaaaccactaaactccttgaagatatcataagagaaaatatagatgacctttggtatggcaatgactttttggatgtaacatcaaaggcataatctttcaaagaaataattgataagctaaattcattaaaattaaaaatatctcctctgtgaaaggcaatgtcaagagaataagaagacaagctatggaaaaggagaaaatacttgcaaaggatatatttaataaaagactgttatttaaaatatacaaagagcacttcaagcccaacaataggaaaataaaccaaccaattaaaaaatcggtaaaggaccttaacaaacatctcaccaaagaagacatgcaggtggcaaataagcatatgaaaagatgctcaacaccttatgtcattaataaattgcaaattaaaacaacattgagatgccactgcacaacaaaaaaattagaaaattagaatggccaaaatctaaaacactgacaatacaaaatgttgacaagaatgtggggaaacagaaacttatccattgctggtagaaatgcaaaatggtagagccacgtggaatacagttggggacttttttacaagactaaacatactcttagcatacaatctagcaatcacacttgttgttatttactcaaattatttgaaaacttacgtccagcaaaactggctcaggaatatttatagcaactttattcataataccaagcttggaagtaatcaaaatattctgcagtaaatgaatgaatacataaactctggtacttccaggtaagggaatactaaaataaatgagttaaaataaatgagttattaagccatgtaaagacatggactatatgtgaaatatatgttaatattaacttacttaagaagttgagaatatattttaaatattaagttacttaaatattatggtactaagtgaaagaagctaacctagaaaggctacatattatattattccaactatatgacattctggaaaaggcagaattatggagacagtaaaaaatataaaaatcataataaattattgattgccagaaattagggggagggagggataagtaggcagagcatagatttttatcacagtaaaactaaactgtatgacactataatagtggacaaaagtcattatatgtttgtccagacccacagaatgtacagtacctagagagaaccataatgtaaatgatggactttggggctgggagtggtggctcaagcctgtaatcccagcactttgggaggctgaggggtcagatcacaaggtcaggagttcaagatcagcctagccaacatagtaaaaccccttgactactaaaaatataaaataatagtaacaaaaattagctgggcatggtggcgtgcacctgtagtcccagctactcggggggctgaggcaggagaatcgcttgaatccgggaggcggaggttgtagtgagccgagatcacaccactgcactccagcctgggcaacagagtgagactctgtgaaactctgtctcaaaaaataataaataaataaataaataaataaataaataaataaaaataaaaaagatggactttgggtgaagatgtgtccatgcagtttttttgtttctttttttttgagacagagtctagctctgtcccccagactggagtgcagtggtgtgatatcagccgctcattgcaacctctgcctcctgggttcaagcgattctccagcctcagcctcccaggtagctggaactacaggcactcaccaccgtgcccagccaatttttttatttttagtagagacagggttttgccatattggccaggctgctctcgaactcctaacctcaggtgatcctcccacctgggcctcccaaagtgctgggattataagtgtgagccaccgcgaccggccagagattcttagactgtaataaatacactactctgctggtgtgcaacaaatgttgatagtaggctaggttgtgggtgtggcagcgcaggagctatacaggaactctctgcacattttgcccaattttgctgtcaatgtaaaactgctttaaaaaatagtatatttaattttttaaaaattagaaaattttcttgtttgtaaaattaagaaatacttttccccagtgcaagaaaaaaaataatattttttaaatcagaaaatattttaaacaaaaaagtaataaaatgttatacatatgattgtttaggacatgcataatttataagtaattctctagccttaaatatatttttggaaagaaacaaagaataaagatgactaagcatccatgtcaaaaattttaaataaatctaaaaataatcacagtggaattggacaagaggctataattaatataagaatgtaattaatgaaaacaaacacaaacgtagtataggaaaacaaagaaaaagctggcttttcaatagatttatatgtgaacaaattatggtaggacatcaagaaaaagggaggacttaaataactaataaagaaaataaaatcaagataacatttatttaaaagttagtagtatattgacaaccacttcccatcaatattttagaaattttattttcaacttataaattcctagaaaaatataattcattggagaggaaaggatgaaagcagggggcatgggattcattcctctcctgaggacatgataaaggccagtgactcatctgaatctcttcctaaatatgcagccactggcctcttactcaatggtacttgctaggcggagaaggcaagcccgcatctatgtagagcttgtgcaggccatccctgatttaggattgattatgggttccccgaagaatgtcatagcaacgatgcaactttctgggctgtgaaatggaggtcttttgtgaggtaatctgtgcatcccactcagggacatcctctgacccagtgagtgaggccggaaggacgcacctggggggctgcccccctcccatcccagcctgtgctgctgggtgacaggtgtcagtagctttatcagggaggcctgacactggatgagatccctgaatcacggatttatggttgagcaactcagccctttgttttagcttatttttttttaattttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagggtgatattccccttcctgtgtccatgtgatctcattgttcaattcccacctatgagtgagtgtttcctcaagaggcagaaaaccaaaataacaaaacaagtaaacaactaaaacaaaacaaaaccaaaaaagccttataggcattgaagtaataatttaattgttagaaaaacataaataaactacaagtccagactgcttcgaaaacaatttatactaaatagccaagaaaaaaatatcttggagatgaggacaaaaagaagtctcccatgaactttataaggttatcaaattttgaatttaaaacataacaagagatagtatgagaaagacaatacataaaatagaaaaccacatccaggaatagtaaaaaaaatcattcttggtgccttttttacatttatatcagtgaggcaaggttattctattcaaaaagtaataaagcaattagcactattaatagattgtgagaatcatactataacctcaatatatagatttttattaactaattaaaaattattcaaattcctgataacatctaataatctagcaatctagaaataaaagaggactttcttaatctgatgaaggagatatataatatatatgtgtgtatatatatatgtgtgtgtagcatatgtacatattatacatatgtgtgtgtatatatatatatatgttacagaaaccatcattctttatttatatatgttggaaattttctatttgaaaccaggaacacagtaagaacaccagtaaaaccacttcctttccatattgcattgaaagtcttttccaccacagtaagcacattaacgacaataactgacaaacattttaattgttagaaaggaatacaaagacacctgccatactttccaatatttgcacacagcgatgctcccaaaatttataaataagatattagtaagaacacttgaaaaaatgctgcatgaaatatgaaaattaaaaaataaactttgtttagataccagcaatatatacattaacacatctatagcaaatgatacatataaaatagacaccttttaatgtcacacaacaattaagaatgatcaaaaagtaagcctacctaaagcaataagaaaaagatacatttcaaaggcaaaaactattaaaagactttgcaattccccaaagaggaaacccaaatgttgcataaagaaaaggtgttcaaccttactgattctcatggaaatgcaaattaaagccataaaaacagatagaccaaacaaaattactaaatgtaacaagctctgatatacatgcagagcaacaggaactctcatattgcaggtggcagagtaacatttacaatgtggccgaccaacagtttggccttatttattaaattggaatatccacatatcctataaaccagggactgtaccctgaagaaacccttgcacatatacacctaaatacatgtgagattcatagcagcatatttcataaacaagggaatcatagacactgtagactactagagggaagagagaagtgggggcacaggtggaaaaactacctattgggtacaatgctcactatctgggtgatgggatccgtaacccaaacctcagcatcgcacaatatacccatgcagcaaacctgcacatgtaaccctaaatctaaaataaaagttgaaatatttttaaagtgtgaaaataacctagaagtctatgaaaaaactaaccaaaaaagcaaaaataacctagaagtttataaacaaactaacaaacaaaatcaatatcggtatgtattcacacactagaattccatcagcaatggaaatgagaggatgatggctacttgctcaatatgaatgaatgtcgcaatcacaatactgagtgaatacaacaagatacaaaaggaaaagaacacattatgattccattcaaatgaagtttcaaaactggcaagaaatattgtttttagatgtatagatattaagtagcaccatggttggaataagatggcttctggctgaatgagggaggttatgagattctggcgatattcactatcttcatttggacagtcattagtagttactagctttaaacacataaaagtatacatatatattttatgcattgtgtgtgcttaattttttataattaaaggaaaaaagttatacaattgaagcattaaaacaggacagtaagtcctctgctcacccttccccatttcatgaagcttcaaatcccttttgtggaagagacacagatcactaaaacaggtcagttttacttcaaccactggtgcttactcagttttctgttttagttcctattacagcttctaaaacatagtaagtgctcaaacacatttgttgagtgagtgaaggtctaacattttaaagaaaattaataacttttgctctgttgtttaatcctaatgcaattctatttacttttcttctaactttttatttgaaaaatgtcaatcttagaaaaaaattgaaagaacccacaaagtgaacacatataatatcttcactgagatttattaatattaaataatattgaacattattattgaataatatataactttcattattaatgtccagtgtcgtattattacacatggtttctatccatctcaaactagtcattatgtctttaaaaaaaaaatagtcagaacgtatttaatgacaatttatttgatccctgttgtttttttaaaatacattgagatataattcccataacataatacttaccctcttaaagtgtataatttagtggcttttagtctatttacaaggttgtgcaaccatcaccactatttaatttcagaatgtttccatcatctccaaaacaaactctgaaacattagctgtcactcctcattctcctttcctcccagaccttggcaaccactaatatattttccatccctatggactttcctattctggacatttaatataaatgaagtcataaaatctgtggtcttatgtgattgacttctttcacttggcatactgttgccaaggttcatccatattgcagcatacctgagtgcttcatgctttttcatagatgtataatattccattgtatgatttttttaccacgttgtatttatccatttattacttggtgaacattttgatgttcccacttttttattattatgactaaagctgctgttaacattcatgtgcaagtttttatgtgaacgtatgttttcaatttttttggatatatatctagcggtgcagttgctgggtcatatggactaacatcatgaggaaccacaaaactgttttccaaagtagctgtacattcccaccaacaattcatgaagtttccgatttttcctcatcctcgccaatgcttgttagtgtctgtcttttttattatagccatccgagtggatgtgaaggggtaactgactctagttttaatttgcatataattagcgactttttgatgcttatgattttggtgtcacatctaagaaactattgcctaacttaagagctcaagattcattcctaaattttcttctgagaatttaacagtttagcttttccatttttgtctttggtccgttttgagcaaacttttttatatgccatgttgtagaggccaactgtatttatttacttatttatttagttagttatttttgcttgtggatttccagttgttccagcaccatttgtttaagaagctgttcttttctcattggatgatcttagcacattattggaaatcaatttgctataaatgtaagtttttgttttttgaactctcaattttattccattgatgttgatgtccagtctcatccaaatattacacaattttattattgtacctttgtactaaattttgaaagagatgggtgtgagcccattcacttttattcaacctgtttgatgcttattaattcatgtgatgcatatttattggtaacctcctggacttggttgtggaggtttggcagggatatcgctacatatttatggtctctgcttaggttaggaataacgtgggaaagggaaaaggcataaatgtgaaaagataagtaaacctataatttatatccaagatgtttctttctttctgtctctcaacaaattcataacagaaattaaatactctgagaaggaaaagtgaataaatagtacaatctgtgagatgagtgtgtggacgtaagtctcttatctagttaggatgtctgggctgctattcaaaacataaacctaaatttgactgggttattctctagtctttataaggtataccttacttaaattgataccttccctgattacacatacctttccttgcagcaagcatctttcctggccatgatcacctctcctggtcatatatactatatagatctatctatctatctatctatctatctatctatctatctatctatctatctatctactcaacccacctatctacctatctatttatcatatcatttttgtaatattatcatgtagactttctttgagagaaaatataatagaatggtattttcaaattaggcaattcacaaagatttcagccaattttcaattcaatataaaataactgatgcaaggtgaaaatgctatgataaagactaatgcgaaagtggaagagacctcagagagaaggtgggactaaattactcactggaaattatacccctgaagagtatgtgtttaatgatagagtttgctctggaatgtgaaataattgcaaaataaaggtaataattgccattgtcatgattatgtcgacaagtcctatgacatttcatcaaaaatacagatgcaaatataagagcaacatgtttgtgtatgcatgtgaaaacagtaccatgtgtgaacaagtaaataagttggtttaaaatctaatctccataagaaaatatgggtttcttcatgaaacttccatcagcaaaatagctcaaatgggataggattagatgagcaacctggagaaaaaaaaatgctgaaacaaaggaattgtttctctttgaatttgtgagggaaaaatgttaaacatattttcaaaagaaactattatttatcttcatgagaaagcataataaatcaatgccaatgctgatttagcaccagtaagtttaagccatcccgtaccataaaggttgaagaaggcagaaaaggtgttgtctagatcattggttaataaaactgaccaaacagttgtaggaagcatttgaaagtatgaatttaagaacttattccagacttgctaaattttaatcttatctgtggaatgagacagcagccaagcagaagtgtgtgtgtgtgtgtgtgtgtgtgtgtgtgtgtgtgtttgtgtgtgttaaagcgcttctgaatgttccgatgacatcttcttagaagaaatgtttggagagcaacctactccgatgaggactttgatgcatgtcttaggggattcccatactatttcactcacaaagggcccccaaagccattaattccttttttttttttttttggtgtcaagcacaggccttcaatgactgcagagatgcttaggaagaattttacaaatgggaaatgctgggtcactggaaaaaaagtggcttcatgtgaggaaggagatgtaaaccaaaaaaaaaaaaaaaagaaaaagaaaaaaaaatcatgcagcccaggtgactctatccaaatgcacaccggctcccattttcccagccctggttaagacagacaggagaaatcaaacaaaggtttgtagaacccaactgatgtatgctcagccaggacatctctcctgtgctcttggcacaatcctttgtcaccagcctgcagctctggcccagtgttggaagccagatttccccaaaccttggcaactgcaaaacccaacactgcaattcacctgatagcctggcagatgtactcacttacagtctttcaaatttgtatcctaacttcattctcccttcatcttccctattggactatgaggtataactgtgccttttctattttttaaatgctcggctgcaatatctgcgatcttccctctgacatggatagcagtgaactctggcatttacattttaaagggacgaattgattatgtgaaagtgaatccaattaaaactaattaaagttgaaactaaaaatgtttatgaacactgaaaaaaatcctaattggaatggttcacagagagacttattcagcaattgttgagtttccaatatgcaaagaactaggggtcattgcaaactagtggatataatttaaagggcttagtgcaggcataaggacccttaacagagttaaccaaaatgttgtcagctgacttaacgccttttaaaaaataaattttataattgatttagatacaaagaacattttccttttttttaatgtggctcctctatctgctttgaaaattcagtgtgctgaaagtgtcgaggtcccttttgctacagtttccctgtttattaatatgagttcattttatagggaatctgaatataaacaactcgaaattttagagaattatggtggaagtatcactcacgtttggtaactaaaatacaaattgtcaaattggttcaaataaagtaataaatatatcaagtacttttgagaatgaaaaatataaaaaatgatttcctccagaaaattcactttggcactatttatgcttttttacaatatgctctgttttctgcaatttgaaaaatgtgtcactattatgtaaaattcttcctgccacttactcattccacttcctgacttttctttttgtacccaaatgttcatagcacccttatctagtcaaaattagaaataacccaacagtccatcaacaagtgaagagcaaacatggtacatccacacaagggaactttttcaagcaaaaaacagcaattatgtattgaaatacttattgatacatgcatcaacctagatgaacttcaaaacagttatcctggctgggtatggtggctcatgtctgtaatcccagcactttgggaggccgaggtgggcagatcatctgaggtcaggagttccagaccagcctggtcaacatggtaaaaccccgtctgtagtaaaaatacaaaaattcgccggacgtggtggcactcgcctgtaattccagctactcaggaggctgaggcaggagaaccgcttgaacccgggaggcggaggttgcagtgagccaagatagcgccactgcactccagcctgggggacagagctagactccgtctcaaaacaaacaaacaaacaaataaacaaacccagttaggctgataaaagaagtcagaccaaacaaagggaaaaaagagtacacattatatgattccaattacataaaattctagaaaatacaagctaaactatagtggagtggatcaggagctgcctgggacaggaagaagcaggaacgtcaggagaaagggatgacatagaggcctgcggggacttttaggggtggggttcagcgtgctgataatggcaatggtttcgaactatacactttaaatatgtgcagtttgttatatgtgaattatctccataaagctgttacaaaattaattctggctttttatttgtactgtttcaaggtgaactagaacatttaaaattctctatgtagctcacattacatttctattggagagtactgatggagatctaactatggtttttcaggaaatatgaaggacaatgaaacatgctaaccacaccactgggatctagtcagctacactcaaaatgtggaaaccatagtgaacaaatgattaggcttttttcaacaactaatgacaagggaaaccagaggtaaaaagggtcatgtgaaaaataccaaccaaatgcaatgtgtagcttttcagactgtgattttacatttccttttagagttattcagctgtcttggaggcagacagttttcttttctttctcctttcctctcttctttcctgccttcctccctcctccttctgagttcctttttgaaacattattcctgtcagatccacaagctaatatttttggcatagtcattgacttgtccctcccttcttttctttatcctatcagtgatcagtcttaaattcggccttgtccttatctttgaacctgcctctcccttccctggctacaaaagtagcctcattattggttccctgactcctttcaaatccatgccatgccactctgtcttattttctgaaacccaaattctaatcattccatgaccttgactattaacctccattggctacccacaactgaccatgtaattccttggtgtaatttgtaaagctattctcaagctgagcccaattgtctctcgaatctcatatatgatcattgcccatgatgtgttcccaaataacaggatcagctcagtgtgtgccaagcattttgcatgccttagctaatttaatccacataataatcctagaaggtagataataattataatccccactattttgtagacaaaggagcatgtgcatgtttattaaattggatactcaggatgaaaatcatcactacatagacaggattcaaattaattgcagggctatactattcttccagtgccaaaaggtgcatttgtggaatttctctttgtccctccctatcttaccatgccttcttttcttttgttttcttttcttttcttttcttttcttttcttttcttttcttttcttttctttctttctttctttctttctttctttctttctttccttcctctctctctctcttccttccttccttccttccctccttctttctttttcttcctttctcccattgtttcttggacttcataacaagagtttatttttttcctatgaaaatataaatttaaactagataacatattttgactgtgtaataaatttgtacaaattgtattaaatttcaaatcttgttctagatgttgctcttttccttcagcattatgtttgttggaaatctcaccatgttgtttctgaagctttagttcagtatgtgtaagtgtttcatagtattccacagtggtgccctatcacgttttaccagtctgtctcctagagatggattcttaggttattttcaattatcagatactatgcatagtagtgaaataagactttaggatatttcactgattaacttatgagtgtgccgattcaaaatgttttcacattttaaattttatttagtactgcagactgtttttagaatggccatttcaatttatacttactctttccactagcgtgttaaaatttctgttctctaacattctgtataaactttggcattagccaccctttaactttaccgttctaatgggtataaattcatatgttggcaactaaatttgtatctgtattactactagtgaatgtgagaatctctttaattttctttcaaccattaggccctcatctatagcttgtctatttatagtcagttgccaataaatagtttaattgaataagacccttgtcattgaccacttagtatacacaccacaaatgctcacttaataaaaagcaatgtactacactttgtttgttgttgttgttggttttttctgaaacagactcccactatgtaaaccatgctggtcttgaactcctgggctcaaacaatcttttccactttagcctcccgagtaactacaattacaggtttaggccaccgtgcctggcctgcttattttgtatgtcaaattcctgctatgtcttttgagttggctcagttaaccatgggtaacaaggcataaaatgaccttttcaaactattagtcattaagccttttaaaataaccaaaatgaacaacttgttctctgtggtatattctatgtttagcaaaggcccaccctcaatttctctattctgctagaaagcattgggtttcagaagttctaaccatgggcttcttggaaagtcagcagctcctgagaggtctagggtctagcaggccgagagcatctcttttctgccttttacttaaaaacgaaaaatgaggaacaataaaatatgtggagtaaaatataagcaaaactgaaaaagtcttatgatacacagtaataagataatacatgagaggatatttgaattcgacatagcatgagatgatttcttggcttctgggagttgactccatcaggctttggtctgtataatctggagtctgtgaaatttgaggtgcttgggttgaacaaaaccaatacagagaaattgcacactgagtccttgaggtggcaggatggcacaaaccaaatgccctgaaagacctgggaaactgcaccaaaaggtagtcagctaggtaacatgcaccaaatacattgagcagggatgtgcaaaatgcctcgaaagacagaggatcccagcacccaggcggtattgtaatcacatatctgaggaatggctgtgcccactcttggggtgggtggtggttggttagcttagcgaaaaagtagattttcctgggaaatactgtctcagtgaaaaggggaatggctaattcagtcacagtggcaggtgtatctttatttctacctgctttatctcttaacttgattatatacaatatgaaattcatgtaaaaaaatcctttattttgactctgttttttatgaagcaaactttcataacatttggcttcctctcaggtttgctcaaggagagacaatgtgttcaacagatgacatttctgtacagtctctttcaccaaatgacgttttgtaaatacttattgaggacctaacatgtgcccaatattgtactaacaacagagaactcaaaacagttatgaccctgtcctcacagaacttgtagtcagatggtagagagagataccaaatattaaacacagaaatattgaatattttaagtatgtaatcatacatgtgaaaatagaacacatgttgcaaaaacatcatgagacaggatactgcttatgtgaatactttagtctcaggggtcaggaatgactgctctgaggaaatgatctcttagctgatattctaagtttaaaaaactttaactgataaaatcaacatatgtttgatggagcaacgtttaaggcactgttggaacagcccttgccatttagagatgggaacgtggactggactgaattcatcaataaaatgcccctttgtgggatgcatctgagtggggcaccccctcttctcaggacaaactcttcagtcctgtagcactctgcattcaagctctgacaacgcaagagtgggtggtttcacaaaggggggtttccctttgaccctttccctgctttctgtccaaaaaatatgaatataacaactccagcctccgtgcagttccttttgaggagacttaacattgctgaagaggttgaacagctcccttctagaagagccaccctcttcccagaagaagttgtctttatggaactcctacacctttaaggctcaccagaatggtcacctcacttataactgatattcagaatctgatatcactttcttctgacttttcctctgaaattcattaaacaaatgtttatatattatatattatattaatatatatttacattaatttatatacattatatatttatatttatatattatatatttacattaacttttatatatatatatatatgcatatttgaaatggctctgaagctggtcatggaggcctttgcacctgcttcaggttcatgggcagcctggcctgcggcctgagtgagcccctctgggctctggctgcctgcctgccttgaagtctggctgatgttccagctggaagcctgtgtcacattccactagcagatgtcctgaactctgggataagtctctaattgaagggtaggaagctttctggatagaggttggatttgtcattctaatatatgttaatctgtctagaaggatataaatgaccttttctctctcgcttttaccattttgtgtttatttacttgtttttagattaatagattttattagtatgcaagacctactgtgaacattgcactggagtaaaaatttcgagaagtgttcagacatatgttggtcatatgtttgacatgaaaaggtatacaatctagtggcatatatgagaatgtacacaaataattagagataaatatagctcaaaaagacaaaagggaggaagggtacgctaaatatagactaggacagacctgccttttcaatctgaacattagtagagaggagtaaaggtaatattgtaaaccttgcccacaaaatctgataagaagttttctgaattgatgccctatttgtcttgactgagacctacccaggactgaagacaaggaaaaatttactaacaagtaacacaactttcatttgcatatcactttccagcttacaaagctctttatagacaacatatttctttttcaaaataaattttattttttgagtagtttttaatatacagaaaatttgcaaatgtggcacacagagttctcaaacaccccatatgaagtttcttttattattaacatcttacactagtatggtatattttctaaaattaataaaccaatatcaatgccattttttttactacagttcctacttaatttaagttttcttagtttttatctgctgttcttttttctgcttcaagatcccacccaggacaccacaggacattttgtcctcatgtctcctcagcctcctcttagttatgatcatttcccagacttcttttattttcggtgaccttgagagttttgaggcataattgtcagatattctatgggatgtccctatattggggtttctttgatgtttcaagtatgactagattgagtttatgtgatttgaggtggaagaccacagaggtaaattgccatttcattgcatcctgtcaacacaacgtatcaccgttgatgtggacttcagtcacttggctggggtaatgtttgtccggtttctcctctgtaaagttactttcccttgcactccacccacctccatactgtgctctttggaaaatagtcactatgaggatttaggcttcatctcttgagggtttattatctacaaaaaatatttgcaatttctcttcataagagatttgcctcctctccaccatttgatgttcaaatctaatcattcattgtatcagtatgaactcatggatgtttattttgtaatttcagtcataatgcaatactcctttattttgttgctcaatatgtttctttaaaaagtatttaaatccaccctgttcaaaaagaagttgggagtgaaagaacgtttcagaaaggtgaggtgatttgccaaaggacacacacccagggattacatccaaattatggtactcaaaggctgtattccttgcttacaaaaagggatccttcgatctagtggagaaactggccaattaaagaaagaattgcaaagtgggtgcttgcagtataaagatgaaatgtatgttctagtaactattggtaaatactaagcactaagtacaagtgctaatattttaggataatgttaatggcttcacatctctgaaactgctattgttcttcctgaaacagaacaaagaggaacagaatacttgttcaggctaggagaatggatttaggatacaaggtatgagtgtggaaggatctttttgtctgaaggcttgagaaaacatcctgtatttccaaatgacttctcttttgtccaatttgcagaattttaatccttgcccttctggccctataatccatgcatttaaaatttcactgtgagccccacattaatataaaacttatttggatgaaaatatttctgtacttctagtactttcagattacattgcatttcctcttcttttaaaatgagtctttcttggaaaagcaaacttttatatcacaatgtattgtatttgcattttatttccattttaattttggttcaataaatatattttagtacccacttaagtttaaatgattagtttttgttatcccattaatttgagtaatgcatttatttttttaaaagcttttaaatattaaagcaggaaaatttaatctcattatagttcaaaagcaaataaagtggttacaatatgaatgtagaattaaggaattttatctcactatattatcactgaagtatttgttgtataataattttaaaaaatatgtttaaatgtccccttccaaattatttcagcagttactatatccttatgttgtgtacctcttgattctggtgtgataggatccaagtaccaagtctttgaaaggtcccaattctaacacccatttcacaactctcactgagaaaagggcagctcctaggagagttaaacagtatatcaggtttgactttgactttatagagctctgtaggctgtagggtgtgagtctagaattctatttcagggattaatggaatttgctacatccttcattctacagatcagtagatgctgtgctaagaagaaatatttggaaaaaaagatatttgcataatttcataacatacattctttctttctttctttcttttttaagatggaaatcatcattctcagtaaactatcgcaaggacaaaaaaaccaaacactgcatgttctcactcataggtgggaattgaacaatgagaacacatggacacaggaaggggaacatcaccctctggggactgttgtggggtggggggaggggggagggatagcattaggagatatacctaatgctaaatgacgagttaatgggtgcagcacactagcatggcacatgtatacatgtgtaactaacctgcacattgtgcacatgtaccctaaaacaaagtataataataaaaaaaatccatgtaacgtctacttcacctttagttaataaatgaattcatcacctgcaagaaaaaaaaaaaaaaaagatggagtttccctctgttgcccaggctggagtgcagtggcgcaatctcggctcactgaaaccttcatctcccgggctcaagcgattctcttgcctcagcctcctgagtagctgggactacatgcgcccaccacaatgcctggctaatttttttgtatttttagtagagaccaggtttcaccagttgggcaggctatatattcttacttctttaatctgagtactaactactgattttttaatgtatttggtattgttttccattaaaatattaagcgccatgtaattttctcctgtggtgtgatgagtattctgaataggtatctaataatcatagatttagtaccctacttaagatacctggtcatttatttcatctttagtctttggatttacattgttcaaaacagtgttggaagtctggtaggttaacttcaatacttgaatacacaaactcacagactgttagaatctatggctacaggattgccctccttgcaatgtggaacttttgggagcagcatcccagcaggccttgtatcctctgctaaagcttacaggatacaaatgctttatttttaaaggtagtgtggtccatcgtagggcagctccaaataattagaaagctgaggtctgcattcatttaacctttcgtcatgggtcttatgttaagcagcagttgccccagtaatgctgccttataaacaaaatgacttacaataagcttgaaacaagcctttgttttcacattcaccagccagcagatgacccgtgttcagctgatctatgcaggactcagtcttcctgcagattcgctgggttcatgcactttgcctgccagggcccaggctaaaggggcagcagttgtgagtgtccttttccctgtgtggatgactagagcatgacaggcaagcctcagcacacaggcactgaaggcctctgcctgtgtcagttaactcaaggtctacctgtcaaagcacatggccaatcacatggccaagcaggaaaggagcaggcccggaccctttgtgcacagtgggaccaagaacaaggggatatttgctggacaataattcacaatatccttctccttaaacgtcatcgctgtatgaaagcaggtcattataagcatcttctgtttgcaaataaagtaactgacaatcagaaagattaaataccttgctctctaggttttactaactaggaaaaccaggaagcaaacttggatctaagtgactcaaaagcccctattttttgccaatgacctctctagtccagcatctctatctatcatctatgtatctatatcatctatctattatgtatttataaatgtaggaagtactttcctaaaggtttatcttttccagctgtaccgtttttgagttactgtcagcattctttttctgttgttgttcatgtaaatctgactcctggctacttttgtcaaaattatttcatactcttaagcatataaaagtccgttactataactggataaaatattgtaaataactttgtagacataatagttcaatatacattctctctaatttaggctacaatgagaccgtgaataaaatcttgaaaactctgggagatacgtgtatggtggtgggatatatacacataccaaggatttcaatcctccctaaattttacctgggcttttgaacattttaaatatttgaaaggcactggttttaacatggcttgcagtagcttttatattatagaatcaaaaaggaagtgatttcagaatattcttttctttactccagaaataaaaagctgatttttttttctgttctttggaaaagcagggaagtgtattaatattgaattaagtctcacaatatttttttgtagtcaaagtgggccgtctgatgtaatctgaatctggttaattttatgaaaatcaaccattacacgatattcttgttccttttacctagacaaaatctaaatcatgaaaagatgaatgttgtatctccatgaaataattaataggacatgtaacttctagttggattcaaattccacttcaattacattgcatgttctttcttcttaaaattaatgtccccaaatattcatattttcaatgattatattagcatattcaacatatacgtttaacacattcacaacaaatttagcaattcgtaatagctacgagaggtataaacaagagtaaaaagagcaattttggccaagtgtggtggctcatgcctgtaatcccagcactttgggaggctgaggtgggcagatcacttgaggccaagagtttgagaccagcctggcccacatggtgaaaccctgtctctactaaaaatacaaaaaattagacaggcatggcggcacatgcttgtaatcccagctacttgggaggctaaggcaggagaattctcaaacctgggaggcagaggttgcagtgagtcaagatcccaccattgcactccagtctggatgataagagcaaaactccgtctcaaaaaaaaagagtaatttctgtcctcaatccgtttacaactttttcccagtgataagataaacatgaccaatgtttaaccattttatgtttcaaggccataaagagctgtcctggtgaatacattctttttgttgtcaccactatctttatgagggtccaaagcaaccagagggcttttaccccatttccactgatacacacgtacacagtataaatggcatcttccaggaaggatacttcttcttaaacttaaatgtattctaatatcacaaagatgttgtctatgtagatgaacatatttgtgtttcccaacaaggagtgacaattggtaacaagttgtacattgctagaagactttttaatctccttgagagttgcctgaggagtgactttgtgtaattgtaatgaccagtttctaacttttctggagatcaaatcacaggagcttaacattttataggaaaatgctcaaagatacttaaacatcatccaaaaaatatgttttgactctattaaggctctgtgttgatattaaaagttgatatcaggcctggcgcggtggctcatgcctataatctcatcactttgggaggccgaggttggcagatcacatgaggtaaggagttcgagaacagcctggccaacatggtgaaaccccctctctactaaaaatacaaaaattagctggttatggtgtcaggagcctataatcccagttactcaggaaactgaggcaggagacttgcttgagcctgggaagcagaggttgcagtgagctgagatcttgccactgcactcaagcctgggtgacagagcatgactctgtctcaaacaaacaaatgaaaaaaataagaaaaaacacagaacctcttaattattctctcccttttaatctcataaaacctctgtaaattaaactccacagagactgatattttaattattttaaaaatctaacattaactcaattcatgttctaagctgggcctccaaaaactgttttatgtatatcatcttattattcattaattatcatgggttattttactgtggtgaggaagttgaaccttaaaattgtttcgattttctctaccagacatgaagattgtagatctattgttgtgaggaacacaatgtcttccccaaatctgctgatttttctctcatgacccttgtttggtgcattttttactatgtaatttaagatatttcttcaatttgaatgttgtagtcactgaacaattactatcctcttcttaaatcatctactgaatagtttagtttgaaaattatgttcctggacttttgaatgttgtactcgaatcttcttaagtactcttgttattttctttggtgcaaaatatcctctgtctcctctagaggctgtattttggtacagtgttcttggctcattcatgattgatgcctaaagctcagtttcggcaaaattagtgagaaggatgcagtgtctctgctcctcgggctggaaggctgtcagtcttttgctgaggcactggaaagaagcggttctcccctgagctgccttacctacaaattcctaagagcccccgggctcacggcatggagaggcccagtccaccttttggtctttcctgctacttcttccctgatctttgccacccttctctttaagtgctgcagagcttctgagatcacgccttccacaggagaggtgcaccgatcctcacccactggatttcaattctggacccaaagctccctcaggttaagtaggaaagttctttccttgttctcacactacacacctttagtgtttgaagtcatattcgttctgtccaggcctgatggttctaaaagttgctcttcttaggaaaggcactggtcattggtttgtggttggtgaagagaccagtggggatgttgtctaacaaatacttaccaatgaatcatttgaaatggcaccacacatttacatgaacacaagaatcgatgtcatcatgtgaaaaatggtgctagcaaactattctattttattttaaaaaaataatttacagcttaattgaaaatcaagatgaatactgaatccttaggtgttggactacatgtatctcagtccttatgttttatctataattcactgatcttcttgagaccactctcttttttttcttatagacatgaagctcacttcctggtattatagttgctattttgaattgcataaatccatgtgaaattatttggagtgaactttattaattcctggccttcatgtagctcattgtaagaaacagcattacttcatagatggactcagtaatgtctacgatttttatatttttccgttaaatatggaatatttagatctttcttgtgataaaagagacatctaaattccatgtgctcataggtaggttgtttgcctaagattgccatacttccagaagcacaagggaatacctgttaacccacgtttggcttcattgagctatccttctctagttatgtttttgtggtcaattgttagtggttgaaattcttaagtatatttcagttactattaaagtattccttggccaggcgcagtggcccaggcctacgatcccagcactttgggaggattgcttgagcctgggagttcgagaccagcctgggcaacatggtgaaacctcatctctaataaagatacaaaaattagccaggtgtagtggtgcacacctataatcccagctacttgggatgctgaagcaggagaattgtttgaacctgtgaggcagaggtttcagtgagctgagatcatgccaccacactccagtctgagatacagagtgagatgctgcctcaaaaatcaatcaataaaaaaaaataattatttaaaaacgcattccttaaaggaaagttcaaaggacaacttatgtcattatatctttacagactcttctctgagtaaattttaaatgttgcttgcttaatttctattaaaatgaatgttaaacatgttatcatctcaaagtcccatggcacatgataaatgcaatgaaattgtattaatataatttatttcccagttaattacaattggaatgattttgaaaaactgctcaacattttatatgctattcctctagtagttcttatttgtactaatatttatgctatttttaaaatttttaaatggaattggaaatccaggggagatttttttgccaattaagtaaaatacaccttattaatatgccagtattttgtcatactaatgtaactaattttcataccattatactatactaattactgtgctaattcatctttttattaggctatggcaaatacttaaagttgaaggcagagatatttcatctgtgaaaagggaaataatcagtggactaagaaataaaagtaatatgttgtgtattttgcttaagaaaaagggtatgtttgatcatgtataaaacgtctaggcagctggctttgatttggcatgcaaaaaggctgtggactcctaccttcacatctgctaaatgtggctataccaaatgctccccagctctcctctacttctcacagctctgagacatgtgaagttctcctgaaattccagaaaatattgtcactattgtgatgctgtgcaattctttacttgcaaagagctcactttattttttaaaaataatttttaaatgttataaatctgctgtccgaacaatacctaaaacgtcttttgttcattggttattcataaaacccttacaatcttagggttggcagagaattttgaattaatctattctaacacttgcatttggggggatagtaaaattgagactaagaaagattatatctttactctgactttatgcagatagtggtcaaagtaaagctagaaattaggtttgctgacatctaattcatcatactcttatgctacggaaaatacttaaaggtgaagacagcaatattttatctgtgaaaagggaaataatcagtggactgaaaaataaaagtaaaaataatcagtgttattaagacaatgcctagtggcatttggttacaatatctaaataaatcctcacaaatcttgagagacaaatgaaattagtccattttactgctgaaaccactgagacacagagaatgtagacactgagacgctggccccatcagataaccaggaaatggcagtgctgttaatgggaaacctgattccttagaagtatcgcaagaacaaaaaaccaaacaccgcatattctcactcataggtgggaattgaacaatgagatcacatggacacatgaaggggaatatcacactctggggactgtggtggggtggggggagcggggagggatagcattgggagatatacctaaggctagatgacgagttagtgggtgcagcgcaccagcatggcacatgtatacatatgtaactaacctgcacaatgtgcacatgtaccctaaaacttaaagtataataataaaaaaaaagcttaacaaccttaaaagaattaaaaattatatgatgtatagtctctgaccatcaaggacttaaactagaaatcgacaacagaaggaaatctggaaaattcacaaaaaaaaaaaaaaaaaaaaaaaaaaaaaaagaagtatccattgaactccttgaggcaatttctgagtgaagggagtagtaagggtaggtactgggaaatatatcacccagaactactcttttgtttgttgttatgagcatagttggaactggattgatctcaagaagattttggagcctggggaaagctttctgcaagaaatgttattttagatctaaatgtttttatcatcaacagactgttcttatagtgcttttattgtttactgcttttactgtttgtcttcattcacataacttccatgtgctatatactgtatcatgccatgaaaaataaaacaataaagcaagcccctgtcctcagagagcatctgaggaaagacagtagacagattatgagaagtgttgtaaagacttttttgtgctgttgtgttaaacaacgcaaaatcctgatgagaatatggggagagaagacctccctctaagggtgagaaccgaagagaggcataaaccatggtgagaggcataaaaccatggtgagaggcattccacagaagagaaacaactcacaaacgagcatggaaatgggaaagatcttggcctgtctgacaaattagaggctgctgtggctggagctcaggaatgaagaagatgctagcatagaataggttagagaaataggcagtaggctgagggtttaaggaggtacgtggtaatccacccattattgctactgttattgttgttcttatcaacagccaccaaaaagtatctgacttgggatgaggcagtgataggattgtgcagaggctgatgccacaccagtggactaggccacacatgacagtaatgtagatgtacagatagatgctggcagatttggaatgtgttaccagagttaaatatataggactttttaatagctttgacttaataggtaatcataagaagaaaccaaggtggaccttctagatgtttgacttggctaactagttgagtaggatacaaattactgaaatggaaataacttgagatagaacaagtattgactggtggcataggcagaaatcaattgttcagtatcatgtacgttcatgtagataaatttgttgccttccatgcagagatgcaaatcaataggtagatacatgagtatagggctctgaggagtctgaaattgacatataaatttagaaattattagcttataggtgagatttatatttataagaattaatgagatcatcaagagtgacaagaagattaaagtccaggaatgactttgaagaactccaacatttagaagaacaaagtaaggagaaaccagcagaatagactgtgacagacagggctctaacaggaaacaatgaagtcaaagcccctcctcctcttgtccatagatagagtagaccaactcacagaacttcagtcttctctccagggatccagccagtctgagaggacccttggggggaaacagaggataaatttcctgtcctcattgtcctctgtccttccttggttctctgttgatgctgcccattggccatatttccctgggaactagagattacaagtgcccttaccatacaggtcagggtcccaggtgctaaagagggtagacaagctggggagtcatctgaagatgcccacagaaggtgcctggcacagagagtaaaatattttaatttaagattatgaagattatatgctcttttcttaattttgatgatatgtaaatgcaaaggaaatgtagaagatatctatttgttatctcatcagggtatgttcagaattaagttacctgagacactggaaatttgctggaaaagttcataaccctattcaggcattggtattgttattgctgatgtcgggtcgcccattgagtaaaggaagacacatcctgtcagaaaaataaaaccagttttgtgcagattccgtttgcttattggaaaatcctgtctgtgaaaaaggtactatttcagctctgcagaggcaacttgaaattattttatgtagtaattgcataactacaacttgctgctttttccttcatgcacttctattatattcatagcaaaaatgttctagattgaaaaccaaaagatggaaattcctttatttctttagtgaaaaaagttaaggattgagatcatttaataatattttctgttacaatcaaattgtagaagacaagattagcaccgttatgagaatgatttgtataaaaagatttgtagtcacttagcatctattttaattccatctttatctttctgataattgtaaactaactgggtaatttttaaaggaaatactaccagagagagaatcacatatggttagaaagtaaaacttaaatgaatgttattgtcttaaagtgtagtaattaaattagtaggccacattcagagagatgtcaagtagctaaatggttcaagcacttgattagtaactatgtatcaaacataaaagtcaccaacagctctcctttataaaaattatgttaggctgtaagatctaataagtactgcaagtgaaagtgaatttgtaaatgctgctatttagaggagaaaggtgatttgtttataagtcttattctgtggcaatttttcaccaagaaatacgtactcaaaagcaatacttgaaagaaccagaaactgtattttctctgcagtttctttcagtctttaattttttattctaatacaatttgtatttctaaattgtcatgctaaattgaaattttacatgacagaagcccttagttaaatcttcccctctcataaaatactgagccagagactgatgacaaagcttattttcattattataagtccagagtttttcttttccaatgttaatgtttcctatttcttttttaaagcatatcgacttacttattgttctgcaatattactgtaagtaatatgtcttattgtattactccaaagaagaaactttgtattctagaaatattgtagaaaactacaacaatttttaattatttgagatcaatatatgctaaatgtttattttccagtattccagtaagcagaatgtttaactggcatctatttaattggtctgttatcaatgactcaaaaaatgtgatcaaatctgaagtgtttccatgaacatccaaagaaagattatgcttggcacaattttaatattaggtatctttagtgttatgtttataaaaggttcataatttatacatgttataagtgagaacactcttagtcagaatatttggcacacttcatttcctttcaagaccaaagaccaaagactttgtgtaatctatttcaatatacattcagttatctcctaaatctgttgtgtgtactgactggacaattcactctttgttttttgctagctaaaataattttaaacctaaaatgatctcattagattgcattcatgcggtaaagtgatgttgtcttccaatagagttccagtccctgctggctcgatggcaggctgtcttcataaggagctcagcacgcacattgccctggcacctcaggtgaggcagagccttgcactatggcagggtccagtgaatgcttcaagcctctttagcccattcacatgcacaggcaagaggtaaagctcttacagttacaaatccactgggagtaccttttcatcacttacttgtctttaatgggaaatgaattaacatgattggctcttaccaggaacttagtagtattcttttgattttaattgacttgctgcttacaaatgttgttaactcaccagaaagggaggagttcccaatattcgcattggcagtactctcctcagtaaaagacaaaggctaaatctttgtccaacattactagagatgctgccaaaccactgtggtggcccacgctgcaaaactgcattgtcacacatgaaaagggctctgtattccctcgctgtgtcatcatggagattaatatcatttataagcttttctcaggcttgtcgatttatgggcagtaagctctgagaagcccttgacattgacttctgagcccttggcaaaataattctaggacccaagtatgtcatctcattttctatgccatgtttcttctgctttcttttcattgccatatattgttttctctgccagaatacgtttctctccagctagacagatttgctgatcaaagaagtctcctgaagtgttacatacatcaattgctatttatttaacaggtttcaccgatactaagatcatagggatttaaaattctgatctgggttactttcattttgcagaaagatgtttaacttatttttgcaaatatagtaattttaggttctgcaaagacataatttaagcatttgagcaaaacacattgtacaacttgtttgagaaccttacaaagccaatatagtacaactgaggcaaaacctaaaacaaacaacccaaacagtgtcctttgactgaagtatccaaattgacaaaatctaatcttttcagataactggcaatcttcaactttattttgctattttatacagtggttctagcatatctcctcagtgtgtgttaaaactaatgtgggtggtaagtaagtttggttcagctgtgaaattggatgggtcatgtacagccaggcagttcatagcgtagggtagctctgaccagacacaggtttgtctccagatccacatttaaaaattgtacttttgttgattagtgtttcccaatttcatttattttactgagggttgcaaaatagcagttttctacctggattatattctctgcatgtatttgttttcatttctctttttttttaattttattttgctaaacagctatatgaaaggatcagacagacatatcctggacccactgatcatccttcatataaataaaagtaggaaaacaaagaaaaaaaatgggactttaagaaccatggtaaataatatattaacttagataagcatgggtaattcagtctctctcttttttaaagattttctttcccctcctccagctttatttcagccagatatagaaagacaaatactgcatgttattgtttatatgtggaatgtaagaactcatagaaacagagagcagaaaggtgttttgccaggggataggagggtgagggaaatggagggactttggttaaagggtatgaaattttagttacaagatgagtaagttaattcagtcttttaagacagcatgctaaaaagctctaacaaaagtagcatagtcagtaacctaacccagttctagaagcacatcattaagatggtgcttctgcacccctaactggtgttcatgtggggatcctgaagaactgtatgggtcttgtctcattctcacagtttccagcagacagccatgttttgtaaaaaagattgggaagagcaacatcagcaaaatgccattcccctgagctaattttagctatgacagtcctacatagagtatatttcttctcattccaatgaaatgaattcattttctaaatgtattattaactacagttgttgtttatctttatgttcctttacttcattattgctgtactttgtgtgaagtagtttaagcacttgaagttggtctagcctcatgtaggggggtaagtgtgtcatgattagtgtgtctccacacaccagatgagtgacaagcaggcagaatgtttgggaaggatagtccagcaggaaagaaacatgttccagaatgcagagaaccctcgattacttgattttacagttatgcagataaatgtaaaaactggaatgtcattcagtctgagccaggttacttactcagatgcttaccttcccctttgccctttggttgggttttggagagttgaccgaaaggggtgatggctttaaaactacacagatgaagcagactgcacaacatggggagaccctatctccacacaaattttttttttaaaagccaggcatggtggtgtgtgcctgtagtcccagctactcaggaggctgagactagaggatggtttgaaccgggagttgaagtccagcctgggcaacagagtgagattgcatcttaaaaaataaacaaataaataaacattattcaaatgacataggacttgtggatcatgagattagagtctagctcttaaaaaaaaaattctgctgtccaagtttaatgcttgaacttccacagttaaagatttaactcttcagtgttggtaagaggttggggattcaaataaatgtggagaccacgaaatgaaggtaggtgagagagaagccatttactagggctccaaggaagatgcagaggcccacaaaaggacaaaggcccagcctatggggatcacagatcagcactttaggttcactgtagggctgaacacaaggcacacatccagcagggaggcacatacctgcggacagaatggtggaaaaatgatgtccattttgacaaaatagggagtgaaaggacatccattatggagagatgaacagctaacagggggcagtgtcctacaattccaggagtgagtggcttgtcaacattttctttgttttctttctttttttttttttggagacagtctcgctctgtagcccaggccggaacccagtggtgtgatctcggctcactgcaacctccacctccagggttcaagcagttctctgcctcagcctcccaagtagctgggactacaggcgcctgccaccacgcctggctaattttggtaattttagtagagacaaggtttcaccatgttggccaggctggtcttgaactgctgacctcgtgatccacccgccttggcctcccaaagtgctgggattacaggcgtgagccactacgcccagccaacattttccttctaatccaagaatttactactatgaaatgtagttaggatcactcttaggcaaaaacagtatagcacataattacagataaatcattactggtcatagagtagaaagataattcttattatcagagaaatttctccatttgggtccccaaagcaaagattatggccttcataacagtgtaaatgtagcttcaaacaaagcctaaagtatcttgtgtttgaaagtgtgcttttaagcataaaattacatgctttttgatctgttagttaatgtgcaaaatatgattctccttgcaatatacacgttaaattcatctaattagctcttttgaatttttttgtttgcttcattatttctcaactactcaaaataagtagctgatatgaaattctcgatattttcattagtaattgttaaatcatattgcaagcattttctgatttatggaaattaggctcagaggaaaatgtacgggtgccaagggctttctcctccctccttgctgtccctgggaaagagcatgctggtgaaaagcaagaaggcaggacaaaagggggagacaagtcttttctgttattcttgattaaatgtcattgataaataggactccactgacttggagccctcagtttatgggattccaaatgctctggcatcacactcattggcccttgacttgttttccacagaggtgttgttagcacgctagcagtcactccccactgccccatctcagctctacacagacactaatctgctttctgtctgtatagatttgcctattttggacatttcatataaatggaatcatacaatatatgtgttttttgcaactgacatttttacttgggacaatgttttcaaggtccatccatgttgtgtagcacgtgtcaatacttcatttaattttatggctaaataacattccattatatggaaatgccacattttgttcatccgtttagcagttgatgaatatttcacctgtttctacttttgggctattatgaataatgcttttgtgaacagctgtatccaagtttttgtgtagagaagtatgctataatttacagttagtttttagaatacaaatggtaacctttccctatctgcatggcacacttgcttatccatgaatgttactgaagtccatttgaatcctttaaggtaaaatggatgaggatttctagtttaacccttatgcttttgagatttaaaaaactggatcccatgaaattaataaattacccaaggtgttacagctaattagcgtcaacagtataactcaaaatttgcttgagattcagttcagcattcttttaccgtgcattgtaaacccacacagggtgcaactgaactaagctgagatcatatgagctgacctgagaagcttccttttgtaactgtttttctttggagaatagatttggtttccaaacagacctatatctaattaccatatttgatgcttcataagaatgtgtgtgtatgcagtgatttgttttcttgactctcaatttgtatcgatttaatgtaacaacaaatatctattgagcataaataatgctgttaacattgaatattttggaatgcaaaggcaattacaactgtattaataaatcaagagtcaagataatacaacagttaataataaagtaggtaatgaagggttaaattgtatgtttttgggccacttacagcataatatacagaattgattgctaaaagatggattttgatcccacctttagtaataattagaaatctgattttgaaaaaagaaatctatttctttgagtgaaagttacattacctttgaaaggacgatatgttgatatctagggtgccttatagccataagatgctacagttcaaatggcaccatgtgttagagtaatacacacatatatgcagagacatataatgggcagatgctcacatatatcacatgtaagtgagtcagaaaacaaggtcatcatgaggaaagagctctaaaaagatctgggtcttgttccaactctgtggtgccactcaaagcccatgtgactctctgagtctgtatttacctcagatagagacaatagatgcatcctgccctcctcctcctctctttgggatgcaatgagataatggcccctctattcttgggtagagtattgaatatcttacgtggattaaggaaatgtggaggactccctagggccctacacaggaagagcattatcaggagcggaaagttacctgtataggaaaatgtgcttttattgaaatactatcttgaaaactttctatttgataggactgtcatcttccagaatcctagatgctggcttgggcaagaataaaacatatggacagttgtcagtggatctacaggtttagctaagcttggttatgcagggtcaccctgttctctgtggagtctacttcataaacatagctggactatttttatcccccctcagagctgtttccactttaaaataaatttctattcattgttgtttgccaggcaaaaatcatatgcagcaatgctactaacattgatattttatttaaacatgttgataagaatgtggcacctaataagaaatccatatcccaccatcagccataggcccagaatccactgtggatgagaaacttttgattataggaaaaagaataattggtgctttctaacctgtagaaacttggatgcctgttggagccacttgctattccttaaacataatcattcttgcatcctgacccacattcttcctgaaacaaaattttcaatattgtcttttttgttgctgttgaaggtctgtgtttgcaatgattaccttgctaaataaaaacttctgagtatttctacatcactgctaagaataatattttagtggaattccttagaataagactttctactatacattattgcacgagaatatgcctgatatacttaaaagagaacaatggtagctaacattgattgaaagcatctgcggaggcagctatttgttgaaatgccctctctacatcagatcacatggctcacatttacctcgtaaatttggaactcctgtcacccttttctaatggagaaggacacagacttgggagaattcaatgacttgttgaaaccacacaattaagtactatcaagtcacctcttgagtgtccatccaagtatagaaaaaatagcgtcttttctactggctttacaaaagggatttgtaattgactttcagggagtttgagaatggcaagaaaagccatgtcaatggcagccggacaaacattctccagcttcccctctgctcccagggcctccctggggctcagattagtaggttgcccttgagcggacattgagaaacaaatgcaaagccctgtggaaggcagctaaggtcagaggtggagaggaagaggtgtagggtggggagagcacaggtgactgtctgaccataagatgagcttcataatcagatgaggcggctagttggaatgtgaggtcagcaaggatgagaagcagatgagactagccctggggcatgcaggaagctgagagacttgagagagtggttcttttttggggggcgggtgatatctagggtgccttatagccataagatgctgcagttcaaatggcacaatgtgttattttgagtaacacacacatacatgcagacacatgtaatgggcagatgctcacatatatcacatataaatgagtcaggaaacaaggtcatcatgaggaaagagctctaaaaagagccgggtcttgttccaactctgtgctgccactcaaggcccatgtgagtctctgagtctgtatttacctcagatagagacagtagatgcatcctgcccttcttctcctctcgttgggatgcaatgagataatggccttgctctgtcacccaggctggggtgcagtgatgtgacctcaactcactgcaacctcttcctcccagttcaagagatgcttctgcctcagcctcctgagtagctgggattacaggtgcatgccccacgcccagctaattttgtatttttagtagaaatggaatttcaccatgctggccaggctggtcttgaactcttgacctcaagttgttccacctgccttggcatcccaagttctgggattataggcatgagccactgcgcccaacaaagagtggttctaaccacagattcccgggctgtttgtagcagggaggcaggcagtatctggcaggagcaggggtacagccagggatccacgactcctgagtaggtgcttctcaagccagaggcgggaagcgcaatccaagaagtgaccgtctccttgcagtttcatgacagcacctcctgtagttgtagcagatgaaagctaaacagattagttaaaggaatacatgagtggatgcatgaataaagtataagggaatgaatccaaccctaagttagaaaaccctcttcatccttaatcataccacctccatagttttcccttcctcaggaagcaaagcgccaagacatctacccacagcatgtgctgtatgaacggtttgctgcaaacactctgccaggattcaaataaacaggagatcagaaactagtgttggaaaatgtcttttggcacattgcccaactgtgatcttggcacggctgattttgttttggtttatgtcttgggctttcaatgttcattttcatactgctgtttcacaattttattttcttttttgagtcatagtttgtaagaacttggtttatattactattccaatgcaatagtgtttttcttttggtatgtagtatgctctccaataaattagaagtcactagtcttgcctctttaccatgcagaaaactttcctgatcaagcaagcattgcccctatatcttgctcctctccattctgtcagctgggtggaattcagtccagtgctaacaggttgaggtttcctttactacaagctactggtctttgcactgtaccttctgatgattgtttaatctcaaatgcatgtagcaatgctatgaatagctcccactttatttcagtgagttttaaaacttcatgaaaatagaacttcacagagacttcattttcttctctgttttccatagccaatatgataaaacgtgtttgtaaatcttttcaatttagaaagactttttcttcagcttctcatcaatgtctgatatttaagaacttatacataaagctcaaaatgagaaaaatagcttgcatcaaatccattaaattcccagaagttattttcaactccacccaagttaaattaaataacatgtatgcctcacaaaagtcacagcaccttgtttatagtaggcactcagtgtgattgatgtgtcaacttgtctaggccacagtacctagatatttggttaaacattattctagatgttcctgtaaaggtattttttagatgaggttaatatttgaatcagtagacttggagcaaagtagattactcttcaagtggatgaccacatctaatcagttgaagaccttggaaggataagactggctccccacaaggaggagggagtcttgccacatactgccttcaggcttgagctgcagtgtcatctctgccctgggtctgcaactagcagctgaccctgcagattttagacttgtcattctccacagttgcatgatcacatgagccaataccttcaaatcaatcccaatgtttctctagttctctctctctctacatagatagctaggtagattgatagacaggtagatgataactaggcagataggtagagattatatacataggtgaataataggtaaacaggcacaggcatatactctatctgttctgtttctttagaggactctggcaaatacttactgacagttggattagtccttctttcttcccatgtgggaaacctctggaacaggtgcgttctactcactttcaccttgtttaggcatatttgttgaaacaaagtttccccttttctcatttctacatttttattctattttccatttttagccaacattttgatatttatccagttccatgatagtaggtattcattagtgatctcttccaaaaattgtctttgttacctccaagatagatggaattattctcagtataattttgaagtttagtgtatttcattttttctataattgatagccatgtatggcacattaagtattatcaaaccacattagaaatagaatttaatataaattagagtttatttatacagtagttattaaggcaagttaaaattaatggcataccgaacaggatagagcatgggatctctgacctttattttcagttaaaatagaaaacattgaaatgataccactgtttcatgaaatgtctagtatgacgctctggcactgaccacactcgtctattaaattggcatgatttagctatcactgatatttgccattaattctgcttatacctatgagggtgataaaagtcaactgtgacaatctacacatcaatttagcagtaaggatacagttctcctgtggattctaacaaatctagtacagaaggaggcactcagtaggtgatgacgatgatgttaatggaatgtaatactcctttttatatgagtttctttatgaacttctggatatgtatacagtgactgaggcctggatatatttgctaatgcaacaactcactgtctaatcagtctgttctcctctcaaggacatttcactttgattctcatgcttactcaccttaacaaacagaaaatgaattcagaaatgaataattgggcttatgagtggaagctcaagagaatcctgctctggacaccaggacaatagtctctagggaaatgtgaaatctccataagcagacactgggttgcttttagctgcttaatgtggttgttgtcatgcgccttgattgctccaacctctctagccccatcagaaatgttccatttttagataaccgaatgtttttcatgaaaataacacaaatagggcccactctggcttttgcaatttcaaagatatttaaaaccaaatggcatattacaaattttagttatcatcctcctcttttatctattttttcccaaatgtcatttctactaattcagtgtttttctaacttcctcctgtgatctttcatctcctttcattttaccttttctttcagtctatatggaaattaaagggagtccatttttgagttcctgctgtttcagtgttttatgctggactttcttatgcctccccttcatctacccaactaagctctgtgcatcttccttgttatgactttttgctgcaagtatactcagcatgtaatgttcatctctagaatatatctggtttctatttctgattcaatttctacttgctcaagtctctcttggactatttttcttgtctctattgggaaaatctgagaaaaaaatagagtttggagcctgtctaattaggtttgaagctttggtaaagttgcttctttcaagcctcagtttctgtctttgtaaaaaggtatatttatagttattagtccataaaatcattgtaaatttgttgatttgtacgggaaatacagtcagtactttaagtgtttagttaccatttttgtttttcctgtttaaaaaaagtctatagcttattccagtctttttttaaattaattaattaatttttttttttttgacagagtctcggtctgttcctcaggcttgagtgcagtggtgcaatctctgctcactgcaacctcagcctcccaacttcaagctattctcttgccttagcctccctagtagctgggactacaggcacccgctaccacatctggctaatttttgtatttttagtagaggcggggtttcaccatgttggccaggctggtctcaaactcctgacctcaaatgatccatccaccttggcctcccaaagtgctgagattacaggtgtcagccaccacgcccagcctattccagtctttttgactaaaacacatatttaacctatggaaataatttatttttattttacttttattccattggtagtgaatttgtaaccaagaatgggtatgatgacgtgtgaaattatttcctttactatataggcatatttttatgtgctactttgtgtatatctagcatatattaaataataaataattgttcgatggttatattgcaatgcaaatagatgtttatgtaaatttagtgccatatcacaaatttgctagcaagatttttttcaataatctataaacaatgtcaagaaaatatttttgtgctttctttactatttggagagcactctattagaaaaaatgccaggaataataacaatagcttatactcactattggccaggcattgtcccaagggcgtaagtattttatcatcctcataacagtccttcgaagctgggccagttgtgatttttatttcacaaatgaaaaaacagatgtacagtataggttatttcttccccaaagtcacatgtttaatggcaagaaaaaggggcttgaagaatgcctgtctggctttggagtctgtcctcttagcatgcagaaagcctgttctcagggagcttacagtctgttctcaggatggtgttttgtcacatgtgacacagccatttgtttcatcttgttttatctattataaaatctacttctgtagacatgagactgtgaacttttctgtattgtttactttctgctttggtagatacatttgctcattgcacatacgtggtgatgcaagtttttcatctgataaaatcttcacttttcattgatttttgttctcaatttttattaatttattataatatataaactttgttttaattcgaattggttaatttggacaggaaaaaaagttcagtaaatataatttttagccttttctcaacctgccttcaccataagagtgccaggtgtctgagttcaaccctttctctgaaatagctttttcatttgtagtgagaattgataagtgttaattatcactgaaagtgagattaaagcagtgaaaagttccattaagaagaattaattactaggctggcatttaatggaaaggtcttaagcaaataataagatgccatcagcatcttattacatctcgctactgacatttgtagtttaagatcatgattatcaaattaatctggctttacagcagcttcctccctgtccccaggactgtgcacttttctacacagatacaagagcgagggtattctcctcagtcttggtcctatccttcagtgtcttgcagtacttcagagaatcaccctattcatcttccaagtccagttatgcttactctatacctggtgaacagtctttgtttttttttctgcaagtaaatacaatggtcttttcaccatatgtcaatatataccattggaaggaaagattttgggcagagcagaaggaaaaatgtattttgttcttccaatttctttgtgtccaaagccattgcccacatccttcattgaatctgatgatttaaaatgtgcccccaaagtctccagtacttaccaaaacacaatatatttgcttatgaaatttcagcaccttctcttcccccccaattatggtgtattttgtctcatgtaaagatcattaaacttttttgacttttgattcttgtgacttgagaattaccaataaagaacacaagcaaaaatattttacccattaggttggcacaatgtcttgacattgcattaatttttcagttccaaaattttcataagatctaaagtggaaagatccagatcactagatgcaatactgaaaggataagggcaagaacttgtaataaagtttaaagtttccaggtttctacatgcaaaagacatctccttattcagaggaaataatatcaatttgggaggatcagatgtagcttcaggatgcaggttataccaaagagatagacccttattcttccagatagaccaaagctatagctggaagaataatgaagacttctccatgaaagagaggacctcccaggcaagcaagaagccatttatctcctgcaatccaatcataattatttacaggcgctgtgttccagagttccagaaaaccaaaaggcagacacattccggatagaactggggatgacagatctttcccttggactgatgagcactacaggcaaagggcgatactgaggcagaataatatatttcaggctgcatttaaaactccagagacttgagtgccaagtaaaggagtctggataaagtctggaggaaggggacagagagagaatatttttgagctttggaaatattaactgggaattagtgtgtaaaatgaattggaggcagaatgatagacagattaggtgacagcaaagtaactaatggattggtggcttgtatgtgtgctgcttaactcaaaatcttctgcattgattatttttctttttaataacgtggtgaataattttttaagaggcttggtttactttttaaatttttttcttttaattatttatgagtctttaataattcagagagaggcattaatgcgaggaaaccttggatttgcttcaccacaggatgccataaactactttatgggaagttgtagaatttacaaaaattctcaaaagcaaatacacattttaattcatttaatctttttttttttttttttttttttttttgaaatggactctctctctgtcgcccaggcaggagtgcaatggtgcaatctcggctcactgcaacctctgcctcccatgttcaagcaattctcctgcctcagcctcccaagtaactgggattacaggtgcccaccaccatgcccagctaattttggtatttttagtagagacggggtttcaccatgttggtcaggctggtgtcaacctcctgacctcaggtgatccaccggcctcgttctcccaaagtgctcagattacaggagtgagtcaccatgcctcgccattcacttagtttttcaagttacatccattacatatgatcatgtagggtggggtcaggttaaagaagagagataccctcactgtcaaaacaacaatgacatcatggtgtatgttccaagttacagaatttgaaaagttgctatttcttcttcactcttcctcagccacactcaaaatgctgttatagattcatgctgctttttgatggtggaataaaaaacctgtgtgtgtgtgtgtgtgtgtgtgtgtgttttcaggctggtgtgctattgaatccttataaaacaagactgtctcatgtttttatttcttattttactcaaattgccaatacaaatacttattaaggaaacagttagaccaatctcagggtgacttgagaataggattggcgtaaagaatgcaacttttactctggttggcctcttactgctaaagggtttcagtgatttgacaactccagtaatatctctgtatctcaccatctggcaaaatttcacagtgcctatttgatgagtaagaggtgctacgagatcatcacgaggaaatttcagcaccaacaaacagcttcaagaattgtttatgcccactgggtagtgctgcaaacagacacatacactgaaatatgttgctttgttttagaaacacatgtacttcctgttgtagtttttaattttttcagtaatgcatgtgtgtttagccgcactctttttaattcattcaacatctagcatttagtgaccctgtctgatgtgaacagtgcttctcttccagggactaatgcagttgttttagattattgtttcttccctgcagcttccaaaataattaatagcaaatcactcatttcatttaagaaataggtatttcctcccttggaatccaaattatatttagatgtttttatttgtcctctattccataagatcactgaccacgtagagggtcagagaaggttataacttacgtagctctaattcgcatgtctctagagaagaacattctgtcgtcctaaattctgcagctagtgagactggcaaaccacttatttttaatgctagagactcctttctcccaccttgaagagttggcagctctggttagggaatgatgccagatctaagcaaagctgacttaaagtatgggtaatctgggacaccagtggtgctatgaatgcacacaggactcaactcccagctgggttcagatgaaaagagtctggctgatgaattctaccacaggtacaaggaggagctggtaccattcattctgaaactattccaatcaatagaaaaagagggaatcctccctaactcattttatgaggccagcatcatcctgataccaaagcctggcagagacacaaccaaaaaagagaattttagaccaatatccctgatgaacatcgatgcaaaaatcctcaataaaatactggcaaactgaatccagcagcacatcaaaaagcttattcaccatgatcaagagggcttcatccctggtttgcaaggctggttcaacatatgccaatcaataaacaatccagcatataaacagaaccaagacaaaaaccacatgattatctcagtagatgcagaaaaggcctttgaaaaatttcaacaacccttcatgctgaaaactctcaataaattaggtattgacgggacgtatctcaaaataataagagctatctatgacaaacccacagccaatatcatactgaatgggcaaaaactgggagcactccctttcaaaactggcacaagacagatgccctccctcaccactcctattcaacatagtgttggaagttctggccagggcaaataggcagaagaaggaaataaagggtattcaattaggaaaagaggaagtcaaattgtccctgtttgcggatgaaatgattgtatatctggaaaaccccattgtctcagtccaaaatctccttaagctgacaggcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccagcttacaagggaagtgaaggacctcttcaaggagaactacaaaccactgctcaaggaaataaaagaggatacaaagaaatggaagaacattccatgctcatgggtaggaagaatcaatatcatgaaaatggccattctgcccagggtaatttatagattcaatgccatccccatcaagctaccaatgactttcttcacagaattggaaaaaactactttcaagttcatgtggaaccaaaaaggagcctgcattgctaagtcaatcctaagccaaaagaacaaagctggaggcatcatgctacctgacttcaaactatactacaaggccacagtaaccaaaacagcatggtactggtaccaaaacagaggtattgaccaatgtaacagaacagagccctcagaaataatgccgcatatctacaaccacctgatctttgacaaacctgacaaaaacaagaaatgaggaaaggattctctatttaataaatggtgctgggaaaactggctagccatatgtagaaagctgaaactggatcccttccttacatcttatacaaaaattaattcaagatggattaaagacttcaatgttagacctaaaaccataaaaaccctagaagaaaacctaggcaataccattcaggatataggcatgggcgaggacttcatgtctaaaacatcaaaagcaatggcaacaaaagccaaaattgacaaatgggatctaattaaactaaagagcttctgcacagcaaaagaaactaccatcagagtgaacaggcaacctacagagtggaagaaaatttttgcaacctactcatctgacaaagggctaatatccagaatctacaatgaactctaacaaatttacaagaaaaaaaaacaaccccatcaacaagtgggtgaagggtatgaacagacacttctcaaaagaagacatctatgcagccaaaatacagtgaaaaaatgctcatcatcactggccatcagagaaacgcaaatcagaaccacaatgagatatcatctcagaccagttagaatggtgatcattaaaaagtcaggaaacaacaggtgctggagaggatgtggagaaatagggacgcttttacactgttggtgggactgtaaactaattcaaccattgtggaagttggtgtggcgattcctcagggatctagaactagaaatgccatttgacccagccatcccattactgggtatatacccaaaggattataaatcatactgctataaagacacaagcacacgtatgtttattgcggcactattcacaatagcaaagacttggaaccaagccaaatgtccaacaatgatagactggattaagaaaatgtggcacatatacaccatggaatactatgcagccataaaaaagatgagttcatgtcctttgtagggacatggatgaagctggaaaccgtcattctcagcaaactatcacaaggacaaaaaaccaaacaccgcatgttctcactcataggtgggaattgaacaatgagaacacatggagacaggaaggggaacatcacacaccagggcctgttgtggggtggggggaagggggaggggtagcattagaagatatacctaatgttaaatgacgagttaatgggtgcagcacaccaacatggcacatgtatacatatgtaactaacctgcacgttgtgcacatgtaccctaaaagttaaagcataataataaaaaaaaaaaaagaaaagagtctggctgaggtccagatgagatgaaatttactgcttcactttggtgagtcttggctttcattaatatgcatcagtgtatcttatagaattagaaatatttgaagcaaggaataaaaatgaaaacacagtatatactgaagaaaagagtattcctgttcatttggcatagatcaaatcagttgaacttaaaactgtagaataaaattacagatacagaggtcaagaaaggaatatttggagaaaataaaaatgaaaacaacaatgataaatttggataccatttgataacatatagaatttcatttcaacaaaacatacttctacaatgctatagtaacgacattaagttctgtgttttcattcaaattaagtaatagaagattcttgatgctaagaattctaccttcttagtggaaatcatataaatattttaccataagccccaattttttatgtcgttagaatgttaggctgtttcctctttgaattcattaagagtattcatcatttcaagttttcacttttttatactaggaagtatgctgttttccaaagagaatgaatgtaagttacaaaatttcaaatcatccagcttccttattttcctatctggaagcacatgccacaactccattagcaaaacatagtaacgatagcccgataaaattaattcccaaaaattaccttagagttttaatcttttccaaatggaggccaataaaataccacagccacaataatattccattgatgagcgccaataccttcctagccctccatgttgtagcgggtgccttcatatattttatttgcttctttggacttctcaaatattccatgagataaagagttaaagcatgaataaaacatctgttttccagaaaaggaatctatatgcccaagggcacatagttaacatatgatgaaatcatcttcaggtctttcacttcaagttccttgctctttcaactatttctcaagatgaatgcaaaagggattatttttcttttggtgtcataagagagccctggcctggcctaggaattggaagaacatagtcctcacgtgccagatcagtgatttgtataggctgtgtgactttgtggttccctacatcaactgtaaaatgaaggccctgaactagatcattttaagtacttacagctataaaatccaacgactctatttaaaataatgtaagaagcttaagaaaaattgcatctataataagttttattgctgaaagtttcccagaatgtatcctgcaaactacagtgccacatatgttaatatatatattatggcataaaagaatcttgtgggtaattggttttgggaaatgtagagtaaaacaaaattaggcataatccctttatggcagaacttctctgtgactaacattccaattgcggagtgaaactagagaaagaacatggagagtgcacaggtccaggcagggtccatggacacgtccatggaaatgatagtccaggaaaggttctctgagaaaagctgtcatgtccaaactgtcagtgatggttctcaatgggcgaatcatggctctcttccaaatggacctagaggtggctatgggctgtgtacttaaagacatatttggcggaataaaattaaaagaaatttcttaataaatataactgcaaactaaacttttagactgccttaattcataatcacctcaactgccgagattatttagcaatattcaagagattttttcattcttctttacctatagtagtgctggataaaaggatttctggaatttcttagaatttcatattaagaatacccgattatctttgccttagtatgcttgttgatgttggtgatatgatacaaagctattcaaggaagcttcctaaggttcatgtttcgattaatcgccacaacatgcacagcagcgcttgccttcaagatcattggagctgtgcagggttgtcaaattgacatgcagtctccacaatctgataatttttttttcttattactgttttcaggatgagaatatgaagctgatctgaatgcttttgacatccataggacttgcaagatagctctccaataactataacagacaggttctctatacacataaatcataggtagtccacaagaaggggactcttattttcagtccgaggaaagatttctcctgttttaaaacaatatgactgtgtgcctgcaagactcacaaaacatatatatatatatgtgtgtgtgtgtgtgtgtgtgtaaaggctccattcttgatatataattttaacagtttttgtcttagagataaattaatgggattgagaatttgttaaattgacttttcttcaacattttttcctacttatttgtttattttcatgttggtggtgaattacatgaaattgtctttcatttattttttcagtgaacagctagttttacaaactacatttgctccctgagttagttattcttatttttatttcaaaaactgtgatagagaaagaattggaaagaagacctactgtcattcttggcaactattactaattttgagatgcatgtctcaatttaccccagaagcaatattcatccagaggtaccttgcaatcagtgatacatttaattagatcctatatcttctttgagaaaagcaaggcctgatgtgaaggctcagtgtgtgtatatttgtgtggaaaatggaaagaaataggaaaataagttttttttgtttcataaagtgatatttatatgaaattatattagttaagtgcctcagacacaaacagaaaggattggatggcaagtcatccacttattctctgtgtttttgcatttttgtatttcttctaaaaatgtacatattgcctgatttctgccaggttgtggggctgaataagcagatagttccctagtttcatgaaactttcattggagtgtttgtgtttgggaggataggaggaacaggaaataagaaacagaaatagcctgtggagtgttcctgagtgtttggcacagaatatttaaatgtcatgccaaaagaaaagtgtcttaaatttgtccagggaagcctactctgaggagtgaattttaaactgagatgtaattgacagagcaaaaccaaccataccaggattagaagagttaacagcagagcggaggcgcccaggtaggagtgagcccacaggttagaggaagcaagagaagggagctctgagtcctgatcatgcaggatactgtaaagccaaggagagaaattttgcttaaattctgggtacaatgggaagccaccaccatattttaagcaagactaaatggcatgctttctttgattttgaagagatcattctggctactatgtgcagaaacgaatcatagaggaaagcagctcagagactggaggtgggcttgtctcagtgaccatgggcagaggctgacaatttgcagcaggaagtgcttgtgagaaaaaaatggatatattttagactttgattccatgttttaataatgaggtgtgggaaggcacagtcattgcaactcaattcaaagagaagagcaaccagtctgagagggaaggtgggtgggaagtggagagcttagagaagtgtctgcaagatgaagtaaggatgaatgacaagtcctctcagcaagccaaagcagactcaatagataaaaatgggcatatgactgcaaagcatgtttaacttcttgtgctagacccataaataatttagactgtttttttttcagaaattaaaaaaacaacagacaaagcaattcagaaaatgtagggactgtgctttttttcattcccattttgaacgcagtgctttgtttgaaactaggaaggatatgaaaggttgttttgagagtgctccatcccagagacctgtgcaaggtcacctccatctctgaaacccagcccagtgctcttactagttagatctcatctttatatactgaattcattatttttatcttccaagatcagaacattttcaaaagaaaagttaagtaggaaaacagagcagcaaacagaaacatccgagggtaagaggctaggcatgtggcctgggcaaggatccctgaggggaaagatgctgatgaagatcctatttgtgttcacttatctttactcaaaggagacaataaataaataaataaataaagaccagatgcccttttcaccctatcttacattcattcctcttttccattgtcaatcctgtcataggcagaagatggaaaggcgaaggcttcatagcaagagctgatcaaagataaagttagaaggtcagaagacatgcagactctgtagtggagatgtggcaccacaaacactgcttgggcgttagacggtcttcagttggcttcccaagaaagctgtttactagatttgtgaccagggggatatccttggagcctcagttttcatatcttcataaggggaaataataataatacagatgcctggaggatcatttgtgaatacctgcaaaatatttcccacggggcctgttgccaacccagctcacaacggtccactcaacctaatggacgttgggatgttgaaatgtaggtcactcttttcttcaaagccctttctgcctttctacagtaaagagatgctgggatatgaaagagatttgaaacaactaattccccaacttagactagaatgcactgaaatagagagagcgggggagagagggagagagagagagagagacagaaggagacagaagaaagggggaagaggagaggagagggaagaagagaacagggctagaatggaatgagttagtcaggagctaattaatgaccaaagatgaagaaaagaaagcaatgcaaaaaaatgaaaatgcagccaaggcagagcacattggataggactatacttaacagagaaatgtcttgctgttgtgcaggcttcctcaatctaaaatagcatgggtggccttcattcatggccacgatcactgaagtggctctgaagtgtctttgtacctgtaaaaatgggcttgttttgattttttgaacatacaattaaaattgttgtctttattgtaaaggcccatgtttcatttaatagtctaccagaagtatgaggacatcacttaaaaacacttaaattagaatgaaatagtaatacaaataaaaataagaaaaacagccattttattgagagtttagctgagttgggcagttacttgtttccctcattatctaatgttgaattccaggtagcaggttctatatttctgttcattttagaaatgaggaaatggatgtttaagaagttgagtaacatccgaaatatcctccaattattagctgacttcgggattcagtcctgggtctgcctgaccctagacgtcagtgtcactaaccactatgttaggaagaaaatataggagatatggatgaataaaggtaatcttcttccacacttgggtaaaatcacaagcttgggagaattgacaccataatgtaggaattcttccttggacaagctgaaaatcattctatttcggtacattaaaagccttcacgctgttaagattttggagaagaatgagcgaatttggtagtgtaactagcaggcggggaaggactgtcccttatggcttagcaatgagcagcagggcagttcacaatggcgagacgcagacgcctttggggcggtgcagccagagcggagtgcgcctgggactgagtgtcctcctcggggactgcatgggccccgcaccgccgcctgccccgcgccacgacagcccagagcacggatgggcccagactgtcctacagccgtttcagcaggcgagggtctgtccagcagcacctaaacagcttttgtatgtcctgtctccaaagtgtgtggctttaagtcaggttctgtgcttttgatgacaatattttctttgggtcgggatcattttcatctgttgccccttctgcccaacctttgcacttccccccgatcctcctcaccccttcccttcctctgcctgtctgcacaccaacgtccttgggctccctcattctccagttcttggcttggtctgactggggacttctcacacctagcttgtcgtcgcgctctagggccattgcatcttggttaaaaggcctgtctctgcagactgaaggctctctgcgggcaggaccaggccagtttggcttctccctgcccgccctcggagcctgctccaggtatactggctgaatgttctgagagacccgcagcccaggattgctgagtcgcttgtgtgtccgctgtttacagctgtgcgtgcgtgtgtgtgcagggaaacagccaggcagatgcacatggttatttatatcttcagattatttctgtgaggaaaattctatcctggtgaaagagcttgctgttgaaaaacagtaactgtacccatatagacaccacagtattcgctcaatgtatttgacagacacactcatattgtcagggtaaaaggaggcagcagcttctttgaaatgcagggacagagcaagtgacaaggaaaaaaccacacagcaggtatgtccacattgttgtgcaaccaatctccagagctctttgatcttgcaaaactgagacagcgtacctattacacatcaaactcctcgttcccagttctcctccagcgcctggcagccactattctactttctttctctatgaattacattactctggatatctcttccaatttttattatagcctgcttgacgttgtaaagaaatcaaatgtttggcccagtagccattctcctctctgcttgctccatcacgctgaaaatcaactggtagcttcagctgtagcagacggagccctgagctctcctgacttgtacatgcgcttgtaagtacacaaaatgccctgctccctagtttctgcctgcacgagttcctccatatccctgccccagggcttcctgctttactttctcctcacatcccttcctgtagactccttcgcaaaaaaaaaaaaaaaaaaaaaaaaaaaaaattatgtttgcctcatgagctcccagggcacagctttgctgcctctcagctgcccagccgactccactcgcaagaacagtgtgttcctgaatttttttaataaaataaaataaattgtacttttatattatacattataattgagtgtggtagaaataaaatttaatttcaggtacttttgataatgtggctctggggtttttactgaaaaagtaaaaattcaataaaaagtattctttagggaaatgtgtttttaagccttttagacacttaaagctaacttttattaggggttcattcacagactgtacacttttatgatttctattcatatttttctcacttttgcttaaaaaaatcttttcttagagaagaactgtttttccaataaaaatggaatgaattcccatacattagtctcttctctgtaagtgcccttctgagccccatgcacacagaagagagtgaagaccagtgaagctctttagggagctaaataatagatgcagatgagtgtctaacatctatacagactaggttcctgataaacattgaattgaatctcctggcaggccagggtattaatctggggagaaggaaagccatgtgagttaaaaggggaagtatcacagaacagaagcaaacaatagtacctgaagtaaccttagcaataatagcctaatagcaaatgaagaaaaggagagacgggaaaaaataaactggcaccagagacccctgggaaagactcataatcagaggtaccaataaaggcaaatgtaaatacagagcctcagtcttctaaggcctcaggctcagaaattttacccatggttgctagaccatggaagtcactgtttcctttatcttggaggcaggctagactgaaatgataaagaaagaatctggactctgacatttagatttacagtagtgcactattgtttgtaagggcattattgattagagtagggcaaaaagatgggccaacataatttgttttagtctatcctgtattatggttacttgtttgtctgccaccaactatgaaatgtgactttaggaaagcaaatatggctatcattacatcttgttataataaatgaataaaagtgaatcattttatcattttcaggtggtcaataattgttgaaatactataatcttttatgcattttttaatttttatgaaatattttcctgttcctccccaaaggcatataaaatattttgctttcaattaaaaaattaaaaatattacaaacaaaacaatccttgccctctttgggctttcagagtatgtagactttctaaaaagtctttgtagtgaaataaaaaatattttaaaagttaaatgatgtctttagaatatcttaattttattttttgttgttgtgggtgtgaatattattaattttttaccgcaggtccttcttaaaaaaataactaatagataataaaatctatggagaaaacaatagctttaaaaataaaagtctttgaaaaaaatgagcatggttttcaaattgacttgatccaatcaaactcttatgtctcctttaagttaaagatgctttcctagttccacatgaaatcacttataaaaagaaaaagtacatctatgccctggagaattactcagtgagtatgtcagatccttcagttataatatgtatgggcacataaaaatttataagtctcagtggtatgcaactgctcaggtagttggcatctgaatccttcattttgagagctcaaaatattttgtgagttcaggtgactttgacttcttcagtaaatgtttttggcattttgggcccatctgctccttggtagacacagttctaaactctggaaatacaaaagaattctgatagctaattttgaatcttttctaattttgaatccataactatatatattcattatatatagtgcaaaatatcacatatatgtatacatgtatacatacataatgtgtgtgagtttataaatatgaaattcatcaggtgctgtggctcgtgtttgtaatcccagctactcaggaggctgaagcaaaaaaaaaaaaaaaagtttgagcccaaaacagtgtgtgtgtgtgtgtgtgtgtgtaattatatttacttgaccaaggaccaaggatgctaccttaacttgcatttatctttacaaaaaaatagatggcttaacctagtatagtttagatcattcctagttttatttttagaaaactaatcaagtggatatttgtctattaacacttatgtccatgtttcctacaatactcatagaagatgtcagaatacttcagaattagtattaaattgtgagagatgggaactacagtaaaattgatgtaatccaattcaattgagttgtaaagttattgatttttaaaaagcattaaacattatgcactgtgtatacttttaatacagtttttcaaaggctacagtgcttgtctaaagttataccaatgaacctttataaatgcagtttcctctcatccctacccaaaggatgcttcaggaagagggggatttataccacagtcatttcatggaccgtaaaacctcaagtgttatgccatagttatgcaatcattttgatgcttgacaacttgtctttgttacataattatattatttgaaactcagctataactgaaaaaggaaaaacattaacataggaactttctgattaatcattgtaaacagcgagttgtctattcatcaagtaaaagtttagagaatttgaagcaaaaataaaatatttgcacatttttcaaaattcaggtaacatctttataaaattgtgcatttaatgtgctttatgtgtatatatcatttatactgcattcaataagaatatcaaattcagtctttaaacataaataatgtgaattttatatatttaaataatccttttgttttttggatttctaaatacaaataatctcgtttgctttttattattgagaaatttatgagatcacagcttacataaccaaatgagataatatgtataagagcactgagtgtggtgcctaaacacccaataattcactgctcttgccctggatagccctgacttaccagctgaaggccaacatgggtccttgtcagtcacagcaaccaacagaggcccccagagagggctgggatggtgctgtctacttcactgccctgatgcttttaaaaggtttgcagaacagtggtatagaataatcacagttattgaattcttgtcttgcccccgtttaaagtaagaagataatgttgctctactgaaaatttgaaactacgtttcattttattcatgagaaaattcattcccagtgagatgaatggggggtactgttatcctgtggccttggtaggatttaactttcatggatgtgccagttcagtttattactctgaggcacaattctgccttgttctcttctatagccactgtatttcttactatccattatactagttttcttttgtgacattttatctttcaaatattagattaaaaatcctgtttggaatgaagctcaaacatttggcattatagttcatgttgtgagaatttcttgtttttactatttctaaacaatatatttctcttggattggatagggtcaaatataatttttttatttttatttatttatttttttttggtgagacagagatttactcttgttgcccaggctggagtgcaatgacatgatctcggctcactgcatcttccgcctcccagattcaagcgattctcctgcctcagtctcccgagtagctgggattacaggcatgtgttaccactcccggataattttgtatttttagtagagacggggtttcaccatgttgcccaggctgatctcaaactcctgacctcaggtaatccgcccacctcggcctcccaaagtgctgggattataggcgtgagccactgcgcccagcctagatagggtcaaatataaattatttccagtatcaaatgaatgacttgagatataaaattttccttaatgttttacacctaaatgtataacttatatggttcaattacttgtattgtttgttgtaaaatcttatttaaaaaataaatgttgtttttaaattttatttaaaaaataagatcactacatttcatgcaaagtaagttgaagaatcgatactttatagtaggaagagaatcagcatgctaagtacagcatgctaagtatagtttaaggaattcttacatggctgatttcattaaaaggttgcccattccccaataatagcattaaaaatgtttggctggaggtgtgtcatggaaagtaagttgtctcggtaatcttaaaattgtaagcatctgtatcataaagcaatctgttcttctgttggagtatgttttttttacctctgccttaccaatttccagaaggaaaattgtctgaaagttgtttttggttgaattctaattaatcagctttccctctggtggccaggattagattcctaaggtactaaaatgtcataataatgaattgagaatgaaagtttcagaggcacaaagtgatggttgaaatatactgaacatgttttaaaagtggaagcagccacaatgtttttttgtttgtttgtttaatttttattgttttgagacagggtctcactctgtcgcccaggctggagtgtagtggcacgatctccactcactgccacctctgcctcctgagtagctgggactacaggtgcgcatcgccatgcctggctatttttaagagagatggagtttcaccgtgttggctaggctggtcccaaactcctgacctaaaatgatctgcccgtctcggcttcctaagtgctgggattacaggcatgagccaccgcaccgagcctacaatgttttaaatctattaaaatcaatattgaaatcacatttcttattatctctggagaggatattaacaatattaagttgtgataccattttgttaatatagattaggcttttagttatagatgacaatagaaatttttttatcattacaatatgaggggttaatgactaaaaatagttcatataaattatattacataaaataaatacagttaaataaggcgcataaacaatggcaatgcaagttttgataatcaaattcactactgcaaataactcagcagaagggatggttttcttcagttatttggtggcatattctctcatgataggtaataccaaattcatgtgattgttttttaaactttgattatatttatagacacctgtttggcattcattccatgatgataatgataatgatctctatttgacttagtaaatctgatatgacctttatattttataagtacatatttttcatgtatcaaaggtttcatagaagtctacttattaaaaatccaaataatttctttttataacaaagacctagtgagataggctttatagaaaagtgttagagttctacaaataaaagaattaggttcatttgaatttattgaagtgaacaatattttagtattagttctattataaaacatcctaaaaactttcaaagcaaaagttgtgctgatcagacctatcgaggtaagtttctggcattagggtaatgtataaaataaaaaaggggaaaaatatgcccagatcaacagaaaaactgcaataatctgaatttcttgtgccaagcagaactgtatatattttacttccactttcctgataaaggatctaattgggtcactgttcttcagataatgaagagtgttctacagtgtgggtggagcactcattatgaccccctctcatatgactggcctgaattggagtaagattctaattatcgattaagtcaattgtggttaagctggaggtatcacaccaggcaaatcattgggattgtgcaatattaatgacttttccaatttcttgtgttgccaattttatcagaatatgtgtacatgatactcagtatagcccagattaaataataaacatctgagtggccatgcctgtaatcccagcacttttggagtggttcatgcctgtaatgtggttcatgcctgtaatcccagcacttttggaggccaaggagggcagattgcttgagctcaggagttggagaccagcctgggaaacaccataagacctcatctctacaaaaagtacaaaaaaaaaaaaaatagccaggtgttgtggtgcatgcctgtagtcccagctgctcgggaggcagaggtgggagggtcacatgaacccaggaagtcaaggccatgatcgtgccactgcactccacttgggcgtcagagtgagccacggtctcaaaatagataaacaaataaataaataaatatgtaaatataaataaatatctgggtatggagaagaaaagtcttctgtaatagatgctgagattaaaatgcaagagtatcccaaaattcctagctagaatgagcaattccatttgcccttagcttatgttgggaaatgaaaagtaggttatgtttggaaaagtatgacaaattacattttggaaattctgagtttgaataacatgttggtttccatgaggagatacttccaattaagttgaagtgtcatactggaccccaggaggggggagtcatatctaagcagatggtgaatatgtagtgaaaacaatatatataagagtgtcaaatacaaaatcataggatgcctgaaaaattaagagtataaataaaacatacaagaataagaatgagttagaagaataatttccagaatggcaatgtgaaacaaccataaaaattaaaattataaaacaaaagtaaataaacaattatttaaagtctctggaaattatctcaaaggcatactgcaggataagatacacctaaaaagagtcttcttggggtcacaacaacctcaaaatctgtttccaaaatctattcttgaaatagggcccaaatttaattggatcagacagtggaacaatttatgcccagagcatttttgaatatagttgtgaaattatcctgaaattagtggacgctaacagcctgctataatattaggtcggtgcaaaagtaattgtggattttttcctttaattaaattaacctttttttttttttttttgaaacggagtctggcactgccacccaggctggagtgtggtggcgtgatctcggcttactgcaacctctgcctcccgggttcaagccattctcctgccccagcctcctgggtagctgggactacaggcgcccgccaccatgcccagctaattttttgtaatttcggtagagccggggtttcaccgtgttagccaggatggtcaaaatctcctgacctcgcgatctgcccacctcagcctcccaaagttaaattaaccttttattaaaggttatgccactacctttaatggcaaaaactgcaattacctttgcacgaacctaatattagcaatgaaggaaagaaagagtcaaaagagttctattaaaaccattgataacccagggtgactgtacacaggctcaaggctgtgacttgtgaggagtgacaccagagactgtacatggcaggaaaagagactccagagaaataatctaaccaagtagctagagaaacagacacaaaacaacaaaatgccttgggataaaggggataaaaatgggcgtgcagagttgttacaatatattatctaaaatgttcaattttcaacaaaaaaattaggacacaaaaacaaacagaaactgtgtcccatacatatgaaataaaccaagttacagtaacttctagatgccagatttagcagaagacttcaaagcagctattatcaatatgttagaagaattagtgcaaatgatacacagagtaaagaagtgtaggatgacaatgtctcatcaggtaggcaatataggtaaatagagaaaattattttgaaaagaatcaaatgaaaattttggagttaaaaagcacaatcaataattgaaatgaaaaatacactacatgaattcatcagtaggtttgagctggcagaataaataatcagaaaatttgaatgtatgttgctagagattatgcaatctgaagaacagagaaaaagaaacaaagaaaatttaatagaactttagagaataaccaatgtatgaataatgagaatgctttgcacaaaatactttgatataagtgaaaatgaagtcacaacacacaaaagcttattaatgcatagaacttaagcactacatagagataaatttatagattatatgcctatatttaaagaacatttcaaatgagtaacctagtctttttcattaaaaaatgaaaaagcagcaaaataaacagaaaaaaggaataaaaaagatgagagaaaaaatatagtaacagtaatttactgtatatttaaatacaactgaaagagttattggaatgtttctaacacaaaaatgtcataaattcttgaggtgatgcatacaattaccctaatttgatcattatagagagcatgcctatgtgaaaacatcacctgtaccctataaatatatataactattatgtatccagagtcactaaaaataaattttaaaaaatgtaaagtagaagatatagaaaattggggaaaccaaaagttggttctctgaaatcattttctaaaatcgacaaacttttagctggaatgaccatttaaaagagtgaagattcaaattactaaaatcaagaatgaaagaaagatcttaataatgaccttacaaaattaaagagaatgataaattagtaccctggaaaactgtatacaaataaattcaataacttaaatgcaacgaattaactcttaaaaatgatataaactatagaaattgactcaaaaaacagaaaatctgaatagatatataagcagttaacagattgaattattattttgaaaacttccaacaaattaaagtccaggttttactatacctttcccttctggtgaattttaccaaacatgcaataaatagtcaatataatttttagcaaaatctttctaaaaacatggtaagatgaaacacttcccaacttacattatgaggcgagtgttaccctaatgccaaaaaccaggcaaaaacattaaaagaaaactacatccccctgtctctagaaatatagacacaaaactccttggttaaatactaatgaatctaaatcagcaacctattaaaaggaatatgcatcatgaacatgtttgatttatctcatgaatacaaggtagttttaacatctaaaaaccaaacaatgtaatatattgatacagtaataaagaaaatctgtgtaattatagtaatatggaagtaatataaaagaaaagcatatcacaaaagtcaatatcctttcatggtagaaacactaaataaattaaaaacaaaagtaaactttctcaatttgataaaaagtatccatgaaaaacctatagctaacataacttattgtgtaaaacagagtatctttcctgtaagatcaagaacaaaacaaggatctgtgctcttgccacttctatgcaacattattagaagttctagcaagggtaattaaggggaagaaaaaagaaatgaaagaaagaaatacaactgtctctatttagaaatcatatgatcttgtacatagaaaatcataaattcaccaacatttattaaaacttataaatgaattcagtaaattatatttctatatactataatgaacaatctgaaaatggaactaagaaaaacaattacaacaccaacaaaaggaatgtaagactgaaactgtaaataattggatggcaacacgtcccatattgatcaaaagattttatacaatctttattagattctagcttggttacttatacaattttgcagaaattgacaatgtgatttgaacattcatatgaaatgcaatggatccagaataaccaaaaaaatcccctaaaagaacaatgttagaggcctcacaatttcttacttcttgtatatatgtattacaaaactacataaaatacataatgtattacaaaactacaaaaatcaaaatggtgtaatattggcgtaatgatagacatagaggttaatggaatagacttgagattccataaataaacacctatatttatggtaaatctattttcaatttgtgcacaggcattttaatggagaaagaagtgtcttgtaaataagcagtgccaagacacatgtaacatgattaagtttgactccttccccacataacaaacataactcaaaatggatcataagcataaataaggcctaaaactacaaatattattcttagaagaaaacatagaaggaagtcttcatgatggtgtgttatgggaagacttcttagatatggccaataagcttgagtagcaatagaaaaaatggacaaattgaacttatcaaaataaaaatcttgtattcttcaaaagacaccattaagagaatcaaagggcagcctagaaaactggaaaaagtgttggcaaattatgtatctgatgatagacttgtatacagaatacatgaagagcttttacaactcaataataaaaagacaataatttaacttaaaatggacaaagagtctgaacaggctctcctccacaggaggtatgcaaatcaacaataaacacatgaaaaagatgatcaacatctttttacctgccagttgcaaatcaaaaccacacaattaaatggcatttcatatacactaggatgcctgtgatcaaaaagaaaggtaatagaaagtgttgatggggatatgaaaaaattggagccccgatgcaaggctggtgggattgtaaaatggtgcagccatctgtgaaaacactctggccgttcattaaagtgttaaactgtgaccacacaacctaggaattctactcctagggttatacccaagagaaatgataacataacatttatccacacaaaaacgtgtacaatattattcataatagccagagggtgaaaataacctaaatatccatcaactgataaagagataaacaaaatatggtacatctctataatggaagaatatttgagaataagaataagaaataagaataagaaaaagaaagaagaaagtaatgatacatgctgtataactgagatgagctttgaaaacattacgctattgaaataatccagttacaaaagagcacatatgttgtgattccatttatatataatgtccagaataggcaaatccatagagacagaaaataggttcgtggttgccagcatatggggtagagaagaatggggtgtgaatgcttgtgagtacttctctttggtatggtggcatgttctaaaattagatagctgtgatgtttgcacaactgtataaatactacaaaccaatgaattatggcatttaaattggtgaatattagggtgtataaattctatcccattaaagctgttaaaaaataatgtctgaaaggagaattcttaatgatttctcctcctgagctatcattatactgtactgtttccacgcctcccttacaacatgtcttcctttgcgggaacagaactggaacacactggaaacttatacatatctgacccatatttttggagctatgtaacatagatttgtaaatagaaagagactttccaaattacattattgtattgtaatagttttcagaataagaatgtaagaagataaaaaatattcagaaatggtaccacgttgtataataggtcaaggtgtgtgggagaaaaaagtaagagagttgtgaataagcaagttctacagggactaactgtacctccatttgtagcaggtccaccaccgggcactaacttggcaattttgcatattaagagtccattttacatattaggatttgatatatttcttaaatttggggaaaattttttatttcaaatgtacagaaatttgcacacttgatttgaagcaagttaacttttctattattagagacacttcatagttaactaaaccttggtgggtataagccttaagtgcatacagggagcctcagcaaccttgttacctggaaacaaactcccacacatctgcattgacaaatgggtggtgttggaagaaacttaaattgcctttcatgatagtgcctaccatcagcagaaagggggaattctaagcagcatgcttgtcctgattaaatgctttgccatcgctgtatgggtggaagtgggttttatttagtaatggacctcttgagaacaattatgttttatgtattgctttaagtattaatttataaaaatagttcaaaatataatgctgaaagcttattcttagtaaagtgctcacacatactaaaatcacctttattagaataacactagtgataattatattttgattttgcatttgttcactttcttggctagagattaaatacatatagatagaggaagttgaaagcaaagtattatttctgcagaaatgtgtaattaataaataccatttacatgttttaaatcttttttttgtggaaaaaacactagtcattgcatgcatgcttatatgtatacttaaaattatcatatctttaagaagttcaaggagaatgatacataagggttttattcacccaaaaggtgggaataagacttttctctgggcttatttttcccaccacatgcatgggagtactggcaggtgcaaagcccagagtgaggtcagggccaaagcgggaggggggcactttacaaggttctctaagtatgattctttgacactcactctatttatttctttattttcagtaatagcttttatttaaaaatttttcttcctctgttgtaaatttttctgaggttttttttttgtcgtcgttgttgttttattttcattttactctaagttctgggatacatgtgcagaaagtgcaggtttgttacgtaggtatacatgtgccatggtggtttgctgcacctatcaacccatcatctaggttttaaacctcacacacattaggtatttgtactaatgctctcctctccttccctcccacaccccgaaaggccaagtgtgtgtgatattcccctccctgtgtccatgtgttctcatttttcaactcccacttatgagtgagaacatatagtgtttggttttctgttcctgtgttagtatgccaagaatgatggcttccagcttcatccatgtccttgcaaaagacatgaactcattcttttttatggctgcataatattccatgtgtatatgtgccacattttctttatgcagtctatcattgatgggattttgggttggtcccaagtctttgttattgtgttctctgggatttatgttgaagagtggtgttgattattgaacgaatgaaacattagaaccattatattcctgttgaaaatacctttgaattcttaagcatgtaaacatatggggaaagttctcttcctctcaaatcctttctaccctctacctttaaccttctagtccctcaggatatccattatatagtctgtagtttattgaattttactacaagccttttcagtgtttttaaattgtgatgggtgtatatgtgtacatacaagtatatggatatacctataaaacttatttcctgtagtataatatgcttcgtcttagtataattgagacatgaaaaaataaattcttctttcctattatccacatgatattgggtataatattcaagattattatttttattcttctttttttttttttttttgagatggagtctcactctgtcacccaggctagagtgcaatggcccaatctcggctcactgcaacctctgcctcttggattcaagtgattctccagtctcagcttccatagtagctggggttacaggcacccgccaccatgcccggctatttttttttttttttgtatttttagtagagacggggtttcaccatgttggccaggctggtctcaaactcttgacctcaggtgatccacctgccttggcctcccaaagtgttgggattacaggagtgagccaccgtgcctggccaagatcattattcttataatggaactttataaagagctatgtgctgaattgtagtaacccaagaaatacggattcatggctaaaaaaaactgttaaatattatgtaatataatctcctcactttgactatagctactcattttttttttctctgaacctaagaaacatcctcatataatgagatgaaagatgacaatgttttatggaggaaaagtcaggaacttagtaagacactgaatgggctaaagggtacctcaaaggtagagaattaaagataatggctactttttcatttcatttagaatcatcccagatcttaaaatgtagtaaaggacactttattatttcaatgccctcatgggtcttataattaacagaatgtaagtgctaggaaaaaggtgtagtaattgcatagccaaatcacctcataatttaaataagaatgttgagtccaatggtaagatgatgtgaacttggccttttcttttaacatgtgagaatcgagagattgtgaaagactaatggaaatgaagataataatgaaataagagaagaagaaataatcagtgaacagaggtttcaaaaattctggagtgaataaaatcctgaactctggtgaagagttcaacattaagattggcaaggccactcaatggagtgtgaaacagaaaatgaaaaaaagaaaggacagttgcagctatatgaatatttgtgggagtttagattaatgttgatgttatttttaggtggctttttaaaagaaaaatacaaaataaggctatttgctgaaaataaatcaggtggccagaaggttatgtttgagaatagagaaattgttctgaattcttgtctactgagaactggagagagtattgacatagaaggattagtgggaagagctaagaacccagtggagtctggcatccacaagacaatggtagcactgatgtgtgcatttgtttaatttttctccaatagcattcagcagttcagggtttttgcagagctggcagagaattcggatttattcaggtgaggtcccctcacacacaaagtagcaggtcagtgtaaaagaatactgcagtgaaaatgttcaggatattgacagagtaggcattggaatctctgctcattagagagagaatgagaagtcagctctagaggagcacaccctctgcggtgtctgtgtgggtcaccctccatgccttatgctcaggcagggctcattgccttgtcaataaatcctcattttactctgtcacttacataccatttattcagctttgtattagctgatcgcaagatactcttatgccctaaagttttttctcatttgatgcctatgcatccatatctttaagcataaaaactgggtatgttttaatgaatctataacttcatgctgatagccagggagtagaactagaaggaaaaactgcaagtagaactctcaattttacagaaaaagatgaaaccttagaaattagttactgtaaactagaaaatatatgatatttacttttattattaaaattgaattttttggtttgtcttttttattgccattttagaaaactttcttcatccttccattttctcagatttatatataaagctaaataagatagaaggtttaactaataatactgcttgttttcttctgagatgatatgatttttgtaagagaggagaaaaggccaaatcaccaaataacttgcattacaattcttggaaataaggattgtaccactccttattattcaataagtgtatcaaggtaaaaaattaaagaagaaacagtaagaagctttttttttttacctccacaatgtttgttgaaacattctttaaagaaagagcacttcattctccatgtccttgccttctccttttccttcagttctaattttatccaaaagcctcatactgcatcttggagagaaatattttgtcaccataaagcttggaataaggacaagcttaaaatacagaatatactttctaataggacttcttaaaatactacacattaaaataaattttatttgaataaatgaccaattgccagtccaaatgtttatttacattatctagattgtctggcaattatctagatagatatgccaacacttttcactactttgtcccatcaaaagggttattgttctaatatctatcatttcacagaccttgaatttttaacatcccggaccttcatattaacaaggaactaagaaagtttcttgctttctgatataaattccaagatagaagctcataattacatagtttttagattgtggcaatcctggaataattataattgcatagccaaatcacttcataacttaaagaagaatcttgaggtccaatagtaagacgatttgaacttgttttatgctatttaatagacttattttatccaatgtctgtgtaatgagtggcacacctagaatataattagctttttaaaagggagccttctgtgagctacttacttactttgtcctttgagaatataaaatttaagctgtatttacctaaactaggcaactctgtgactccacgaagctgttctctgtctaaatgaacactgaggaatcagaattgtacacattttattgtgataattatatgcatacaattgtcttgggtctatccaaagctgcaccatccacttttgtatctcaccccattccctctggcctattcaagagcatcgctttccataaattctttcctttttctattatatctttagtccccatgccttcatagattattcccataagtatataaatatattgttattttttcaatcaaaaaagctaaaaattaattttctgtaattaccaccttatttctctgctcccttaactcagaggagtcatgtacttcctgtatctaaatccttccctcctttatttcactatgaattccttcaagtcctatttctcccacctggatcactgaaaatttttaaggttaccaccaagccttatgttgctaaaacaataaacactcatcttagtgagacctagtggattagcaatgagtatatttgtcacaactgatcattcccataccctagaaatattttatcacttgacttccagaaaaaacttgtgtcctggttttcctacaatctcacaagttactccttcttagactttttttctgttattgttgtttttttagcatcttgatcttgagatcttgtagtgtctcagtcattagaaatctattgtttcatctggtttcatgtctttagagattatgctaagaatacaatttcctagtcaaccaagacttctcacctgaagtctagacgcatatacagtcatcacttttcactaaataatgggaatactttctgagaaatgtgttgttaggcaattttgtcatgtgaacataatagaggatacttatacaaattgagatggtagagcctactgtacacctggtctatatggtatagcctattgctcttaggctacaaacccatacagcatgtttctgtccttggcaattgtaacagcatggtaagcatttgtgtatctacacatacataaacatacacatacataacataggtaaagtacagcaaaaatacagtatataagatcaataacggtatgcttatattgggaacttaccacaaatggaacttgcaggacttgccgtggctctggataagtgagtgagtgagtggtgactgaatgtgaaggcctatgactttacttactatacattgttgtagactttataaacactggacagccaggctagactaagtttataaaacatatttttctttcttcaataataaaccttagcctgctgtaacttttttactttataaacttaatttttttaactttttgactctgtaagaacaaagcttaacacacagacacattataaaactgtacaaaatattttttaatatctttactatactatatgttttattttatttttaatttttttctttactacttaagcattttgttaaaaattaagacacacacacacacacacacacacacacacacacacacagtatcctaggcctacataggttcaggatcatcaatgtcactgtcttctgcctccacatcttgtccccctggaaggtcttcagggacaataacaggcatggagctgtcatctcctgtgataatgatgccttcatctggatacttcctgaaggacctaactggggccattttttagttaactattttttgtatatgtagaagtaataatgatagataatgataaaaattgtagtatagtaaatatataaaccagtagcatagtcatttattatcattatccagtattatgtactggataactgtgtgtgcagacttctatagactggcaacacagtctataaaatggatttgttgacattcacttgtgtaatgcattgcttgacactgtgatggctaccatgtcaccaggcgaatggaagtgttcaactcctttataatcttacagaactgctttcatatatggtgtttctttaaccgaaccatcattgtgggatgcatgactgtacatgtagttcaacgtagatcctcagaggtctaaaaagaatatgaagttaagatatccaaacctaatacttgatttttcctctcaaacttttctacttttctttaacggtgcccagtttcacagttgctgaagtcaaaatttttcttctctttttctccctctacatttacatcattaagagtgtagcagctcattgtctcactgcctctctgctgcaatctcctctgagcagcctgggtgagtacggtcttctgcctggaagcagagtgtttcctcatctgtcattattcactctcctccagtctattcttgacacaacagccacagtgatcttgttataataaagtcaattcaagtctgattagtatctctcagtgacttacatctcactctccatggcctatgatgagtctgaccattcgtccctattctttttgaacattctctaggcctacatgggcctctttatacagtgctttgcacctgcgattccatgtgccagaacactcttcccccaatgtctgcatggctctccccatttcttcctggggcttagctctgatgtcaccttcactgccagggctttttgcccgtttcctgaatccagggctcggctctcccaccgagccagtgcttcctgtttccaccttctgctttattttcctctgtggtacttgatattggctggtataataattacactgaatatttcacctaacttcatttgcctctgtccactagaatggaacctctttttaggaacttgaatgattttttgtcccctctattttgtttcctgttgtattcccagggcctcgatcagttcctggcttaatacatattgttgaattgaataattgtatctggtattgacttgcaatccttcttcactacaagagaaataaatcattagtttggtaaggccaagagaaagtctgttcattcatttaacttttgtttttcatttagtgctgaccatgatgactggcaccgtgccacactggtccagatgtcatcttttcatactgcaagttcctgccatatgatctgcttctgtttttcctgcttgtcattgtgttgaaatgattgattgcttacttccgggcttttaatatccatagcaaagacatttccatctctttctgactgacattattccagttcagattttaagcagaagtatcatctagtatatttctaaaaatctatcaagctctattcctccgagttttaaaatcacagaatgctagaagtgcctgtgtgtattttgcaaactgctgctcctccgagttgttctggaatgggtcttatttttttatgttgtgctttagttatgtttttctccttctctactcccctttcagattctttgtacaatgtaaagggtgtttaaagacttacatttttgtgaaaagaattaaacttcagtgcataacctgacttaagaaaagcttgcctgtagtgcaaatatcacagactctgtgctacttctcataagcaatataaaatagtctccttggctgcaataattgaagcttttacgctctcgtgcccctaaatgtcacataaatgtataagaaatgtatctgtgctttacaaatgtagtcaaaaataactgctccctgctagttacttaatgtacttccttttattcttgctagagtcctatagatctggacaagaggttatccttcctgtcagtagcagacaaatttgtttattttaggagaacaagtgaaactgtttcaccatatctgaactcttggccctctgaaaacatcagagcacatttgccaagagatagagttgtcaaagcctttcttttgccttcaattttctttccagaaacttatgttaaagataaacaaagcaggacaatagttgacatggtaaggacagattttaatcagtcatacgccactgcattagggaaaagagtccagggtgagctgagctcaactgtgacttgtgcagaaatgactgtgtgttacacaagaagaacaagtgagtggggagtgggtgtgcaggggcttagtattcagagaaatggaaaattacagaaagtagaaatgagggttcggtctgtgtgaaacctatctgggttttttaattggtgcttattgaagttggattcccaccctcccacagagactgagagatgaggatcctgtcttcaggtgtcggctgaaacaaacagtaaactctttgggcagccttgagttttctcaggacagcacttttagggggcttatggtgagcctaggaaggtggccttgaactgctagaaactatattagtgtttactgaagtctttataggacaagagtgaggccttgtcaaaagagggcccagaggagcctggctagagttcagtcaaggagagaacactcatcatctattgtcttacatacctctggctcattggaactgtggaggcaccaacaactttcagagtttcgtggattttcaactcctctgtatacatcagactgtatattgttgtgaaattaaagcattaagttatcttgcagttctaaacttctgtgaattggttactgcttggtgaagtgcaccaataacttccctctgagaatcaggaagtagcactctgctaaagtgtgccatgtcatacccagagacctcatagcttgttcaaggttaaacagcgagtttgcagcaaaacttatggtttgtagagtaattccacaaatatcagtgtatttgatttatacaaccttcttaggaagaagacagggaactgagctatgttttgtagataagaacaataagcttagagaaagaaagtgcttgtggaaggtgacccagacagtaaagctgacgaatcaggctgggaaggaggttttggggcttgtagactaccgctgtttctgagcggcacttcacctaatcaggtttgtcatgcacttagcaccaccaacactagacatatttcataatatttaaaagtcttattactgaatctctagaaactatgaagaaacaaaggtaaattgaaatgatgagaataagatgttgcaggaaggtaatatatcacaaagtgggtatttttttaaaaggcccaactccaaatgttttcctccttcttcagatacaggacctcgtgcttttgtttagccatcggcatagtccactgtatttttttctttctgattttccttaatccatgttgtcttcccaagtaccttgtgatcttctagaagataagagtggtatctcttattcatatgtatgtagaaaaaaagatttcaaaaactcaatattgcctgtttttctgtgagttggtttatatattttcagtaataaaagtgcaatattttataatatgaacagtcatttaaggtcaacaataaaaacaataagcacaattttaatattttattacttttttctttattttagaaagaaatataaaactatattgggtggattacttgatttttctgtttgtttccagtgagttttgctcaggtttcaattcttaaatttatttaagagattacacataacacctcctccaaatcaggttgatatgaatgttgcataataacagaataaaagttaccctatgatgatatgacccagcaattttgttacaaatatatacccaagaaaaataaaaacatatgcccatacaaaaacgtggaaaaatgtgaatagcaacagaatttgtaatagccaaaaaacagaacaaacaaatgtccatccacagatacagggataaacaaacagtggtatttccatacagtggaatattatacagctgtgagaagggaaaggtactgatacatgctacaacatagaaatgaactctgacaacattatgctaagtgaaagaagcaagtcacaaagtcccacatattatatgattccacttatatgaagtgtgaagaataggcaaatctatagagacagaatgtagattagtggttgtgaggagcttaagagataataggcagtcatatctactgggcacaagcatttcttttggggtgataaaaatgttctggaattagattgtggcaatcattgtacaacttatgactgtattaaaaaccactgagttgtacacttaaaaggtgaagctgatgatataaaaattgtctcactataactgttataaaaatataatggcattttatatttgttcaaagtaaagggcaaggaagatatttattcttatcacttaaaataaaaatgaaatttgtaactgtcagtgctttttttgccaaacaattacagtggtcttatgtgaaaaacagatgctttagaaaaatcttcacggaaactggcaacaatgatcacttttaattaaattcttgaactgaaaacattctactttatttaatttaaaagataaatttaaatttaagaatagaaggcaatgcattttaaatgttgatgtaattatggaattttttgtcttactttaattaaaaagcaagattacagtgcgaaatttactttttccctgaagaaccttttagaaggaaactctatttagaagatagacattttttctgttgtaattacttggtatttactttttgttctctcaagaggatctgctctcgtatatattaaaataatgtgttaatgcctctagggggaataaaaatgatttggtcattttctttctggaaaacacccaaatgaaaactgtttgctcacttggcatgatcagttagaattaagtaacttccaggtgtctctctcctgttttctggagtctgttactggcccaaaacaatctgggggaagtgaatttcattgtagctgacctaggtttattattctagttaaaagaatttgccaatgatccaaagttttgttagggcttttactcctgttttgatcgtcaggacttgcaaagggtgcagagtatggcagtatgagtagcatgtatatacggggatcaggaaaagctaataccctgaggccatcatctagtgtccttgtgcctgagttatatgaacctaccattaatgatttttgtaaggagtcagtatgaaaacgtacacaaacctttagcataactacctcacatagttgtaataatgaaaataaaactacttaaattccatcctctcttccggcccagggatgtttaacatacattattccaactcacttcacataaattgaggatcactgagttttaaaatatgtttattcctagttaatttggaaaacatgatcactttaagcttttataacaaaagctggtggtttcccaaatctaagtaggagagagaggacaatggtaagtcctagttgctgggaattaaatattttccagaatctagaggatcctcacttactgcaactctgcacccagcgttgtgcttgctcactccaaacctcattctcctcttagtaactccccaacacgtcctttgccattttacttttggtaaggctgactccatcttctcatctttttctccatagaaaaagaaaaattgcttcagtagcactccacccactgacaatatttgctattgtagtgattggcacgtgaaccaatgtggtccaacaatttctatgcggagatttctggagcctttagagaaagaagtaaacttcctttgtctcctgaaataacttccagaagaaatcttctaccctttgagagagaagaagcaccaggtagccctatggctacttagaactaaaagggcaaccagcattagaatgaacccgacacacaaaccaaaccaaaagcacacaaaccaaagcagagaaaatgaacaaagttggtgtttgtaagattattgcactgctgaattaaactgcgcatgaaacctccctgactgttgatttccattagttaaaccaataaatggccttttccgcgagccagatacattttatttttgttgtttctataaatataataaaataccagaaaaagtcatgtatgtttttgtattatttctgttactaatatttataaaaagatacagactaataaagatctaaaatctatttcttgatactgtaaatgataatttacataaatttacataaaagcatacctaaagaagaaaaatatacattctaaactagaaaacaaggaaaacagagcataacagacatatcatcaagagtgttatacaaataaaaactattattttatttttcaaaatgcaggaattttttaaggtaataaatataaattatctttacagaaagattatttacctttaattgaacatatacatcttaaataaacccaaaaatttccttttatgtttctcatattgtaaaaaggaacagtggagattatttcaatacaatgacatagtctacaggtattactgcaaaaaaaaaataattgatcatttagttgcgtatttcaatatggtatatatttgttaaatagaatttaaatagaattttattgaaaataaactaaaaatatgcaataagggttactatatacatacaaatacataattacatttaccttattgcattattttgaagtacaatgaaaatgttgatttacatatacagatccttagttcaggtagtgtaggatgaatagttgaaattcagatataaaaccctccatgtgataaaattagatttgctgatgtgaatattgcctattttgtgactgtaaaaggtcccctaggctatactattttttttcagtatttttctctctactgtttccaatgggtcagttctgtggacctgtcatctagctcaccgtctctgtcatctcagctccaaaactgagcccatgtagcttgctgtatttatttctgttactttacttttcatttccattacttgcacttttttttttttttttttttttttttttgagatggagtctcgctctgttgccaagctggagtgcagtggccatctgggctcactgcaacctccgactcctgggttcaagcgattctcctgcctcagcctccaaagtagctgggattacaggtgcatgccaccatgcccagctaatttttgtattttcagtaatgacggggtttcatcgtgttggccaggatggtctcaatctcctgaccttgtgatccaccggcctcagcctcccaaagtgctgggattacaggcgtgagccaccgtgcccggcctagtagcactttttgataacttctattcctttgttaaaattttctatattttcatttgtttccagagaatttgaaattgctgttgaaacttttttttatgatgactgctttaaaattcttgtcagataattgtaatttgtgatttgtttaattattggtgttctgtgattgtcttttatctttcaagttgtgatcttcctagttctcagtataacacatactttttaattgtgttctgccttttggcttattatgtttcaaggctgggtactatttaagattttttttaaaagagggcatttaccttgtttggatttagcacataggtcctggcctagttttagagactgattgtctggctctattagctgtctcacttttgagcctgtgaggtgctatttattctgaatggtttatcttgtgccaatggggcttcctctggtccctactgatgctgctttgggtgagcagacgaaactatgcaggccaggttgctggtgccactaattaggaaagggatcctttctcacaaggtgactaagaacatttccagcctcgtgcttgtcaagctacgtctgccagttgaaaaagtggaatgatgaggagaacctctcaggctgctcatgggctcaaggtcacctttgcaggtgtttcccacagtgtgatatccctgcctagggtaggggagtcttaggccctaggggactaagtggcttcccaggttgagcattttgtttgtagcagttgcccctgctgctgtctctggtaaatggaatcactcagtgggaggaggagtcccaggacagggaaggagagcaccacttattgccacagggcttctgatcagtcccctctactggtttgcctcaacttgcttggtatggtgggactctatttccacacacatgtggtatgagactagctgatcttccctctttgaggctgcgggtcaggaaatgttaggcttggatgtccttccactgttgcatgggataatatgacatcctacttctgggctgctcctccagttctggcccctacctggcctgctttctctttgaacatttcagaactctccttgggtcgtctttcatttttctccaacatgtctatagttgagcttgtggggaggaggagggagagatagttttcaccatattgtctggactggaaatctctttcattttaaaacgtaggcatttttcttacccttcagtgatatttcattaactggaggggaaaataaagattagcaagatttagggattcaatgtgctgagagttgattagacaaattttaaaggtcagaaaggtaaaaaccatataatgtagttgtatgcgttggtttcagatatgctacatggcaggtcatgagtgattcctgaatgataagagattccataggatttcagagaagagtcacagtgagctaagagggtggggagatttctttgaagagagttgcagctttcttgggaatgaatttagaggaaagagaatgtgttagtcaattttcacaccgctataaagaactacttgagattgggtaatttatttaaaaaaaaggtttaattgactcacaattcctcatggctagagagacctcaggaaacttacaatcatggtgggaggcaaaggagaagtaagcacctacttcacaaggtggcaggagagagagatagcaaagggggaactgcaacacacttttaaaaccatcagattttgaactcactatcatgagagcggcatgggggatactgcccccatgatccaatcaccccctcaccgggtccctccctcaacacatggtaattacaattcaagatgagatttgagtggggacacagagccaaatcatatcagagaatttaaaagaatttatggaaaaaaacccacatgtttctatgtaggaagcaatacttagttattaagagctctagagtgacaaattttggacaggaatattcactctttccggtagctgacatcacaaacattatcagaccctctgtactgcacttttcttgtatgaaaatgagccagtattagtacctgcctcaaagggctgtttccaggactaaatgagctaatatgtacacatttcttagtgcagtgtctggataagcacctgattattgttgttctattattaaacacatcctgtggaaattattgctcttcttagaaattgggtctagtcttccttattatgtaaagtttattacggagatttttttaatcattaggaatgtgatatgtgggcacatggatggatagatggatggatggatcaatggacaagtggatgaatgaatgaacggatgatagatgtatgatggatagacaaatggatggataggaaactgggtggataagaaacaaagaaaaattccatcaacctgatagtggataataccagataatgttatgctgatttaatccttcctacagcttgtctcagttaatcaaattatatgtcagccacctgttttgtcatattgctgatttattagaacaagtaaattagattcctcataagatttttaaatgattatattaagatttgtatagatgcattacttaaatgcatgctatatctagcttgttcatagttgcaaaatcaaatcaatatattaaagaggcatcttgacatttttgcccaacatgtaagtagctatcttgagtaattttcaagtaattttagttttcattcttcaatcccacagtttgcctcttatagggaatcaatatcccagtcagtgctttatttatttatttatgagaagttaatttattttttattgaattttggattcccatgcttatttgtaaggataatatctataactatttcagactttgctaaagtaccagattgtcatttctggagtcctctgcatccttattctatatggcctgcatgctatttgactggggactgatttttatatagcatgttgatctcacttagattgtataatttaattttagttgtcatgcttttgtcaactttaatttaaattttggatatttgtggagtttaatgttcttattgtgcatgatatagggattgttatataagtactactcttacgggaattatttgggtagactggactaccttttctctgggtctaaagggcatggaaatgtaatttggtctatgtttttcacctttcgtgtaaatgtatcctaaaggaagtttgtctatcatctaagcattaggctaagcatttttgcatgggggttttgtggtgccgtttagtttcatacattctagggtctgagaacaagttcttgtcatagccattgtttctatatttgtctgtagcaaattatctgaaacctttttcattgttgccaatcttccaaaatcaagaggttcttttgcggtattataaagaaaaatgttgcaaagtgtcaagtattatttagtcaaataatagtatgtacaaggctgcctgtggtggctcacgcctataatccaagcactgtggaaggccgaggtgggtggatcatctgagatcaggagtttgagaccagcctgggaaacatggcaaaaccccatctctactaaaaatacagaaaattctctgggcacggtgatgcatgcctgtagccccagctactcaggaggctgacgcagaattccttgaaaccaggaggtggaggttttagtaagccgagatcgtgccattgcactctagcttgggtgacagagtgagactctgtctaaaaaaacccaattatttatttcttgattctcctttttgtttttcctttttatcaagtctcaagtcttcttaattaactttactttcttaatgattttcttgtaatcagtttgttttaaaagaaagccactaacatgtatacaattaaggattttgctcttagtagtctcctctaatactagtttgggattgtgtccactcaatatcaacatctaataataattgtgttcaattataccaggcagtattcaaggtgtattactcagagtaactcacttaatcctcacaaactccaatgagacctttccttgtctcattttacagatttggaaactgaagcacagagagcttcaggaacttgcctataattacacagttaggaaggagtgctctttgacaatttaataattttaacaatgagatgcaattaattcttgtcatagccatttttcattcactaatgtttagaatgaattaatcaaatgtctgacttcataaaacaaaatctgaatgtatgataggattactaacacatatggatgaaaaaaaatcatataccctaaagaatcaccagtatagtcattttctaaagaatgacaaattcactaggtgcacctgacaaataccaatgcagttatcttaaattttgataaactctcttaaatggtagattaaaaaaaaattcttactaaaaacatccccgtaggtatactcagaatatttaagaggaattctgatgtttctgaactgggtgactatttacctgacatatccaaggacacaggcctctctttttttttttttttttttttttggtgaggtggagggggaagaggaggaagttagttactgttgtttcagattcctttgtttacttcaacaaatagagttgtgttattttctctatattttacgtcttcatatcatcacaccattgctcattcattttaatggtagtgaaataatttccctaaattgaaaatatatataccacttgacttactgtgaatgaataaaatgagactgatttaaatgatttatttcatatatctgggttttccattaaatgcaagactacatatatgcttgtgacttcacatggccctgctttgaaatgacacaagctctgtaataaatattgaggatgacagaatccatctcctcatctcattgagaaatcttttaaagaactagaacatgacaaacattattctgaatttcagctctgactcttactagcttctaaccttaaagaagttaggaaatgtacctgaaatctctattagcaaataaaattttaaaataccccgttaaagattcttgaaggatgaaaataatgtttgtaagagctagacacttagtgcatgatacttattgttagcccaatgcagggaggtgccatgaactcttccatatttttaagcacaaatatttttaacttttatcaagatgtgtgacaactcagaatttgagggagtttgatgaagttatttatcattacatggtgtttttaacctcttaagtatttctttattactagctaaatattaaattgatgggttgcaatccagtgctgccaaattctaataatttttatacgtgattccaggtcactatcccaaggtgaaattaaaaaaaaaaaaagatcttttgagccttcctggttccttctgtttcctttggggattatggaattatttcaattttattcaaagattatcactgttttaatgtcaatggggaggaatatattttgttaaaccatcctttatttctcatagtgaacactggacacgttggtgggagttgttctgtgctgagagcatagcaatgaatacagagacagcagacctgccttcacaggttgtatgttctgatgcaagtggcaacaacttgaatgtcaatgaactttagtgctttctttgatgggcaaagggcagagctataaatgctatcacctttttttcctttatatttggaaacatcccatggcccacaaaacattcctcaagtttgtctttgggtagagtgaattcagctttttgcacatttagaagccacattaaatatgtctgtggcaaaaagtttggtgaagttggcaagagatgagtaattattttcacacacatgttaatttcaattttaaaaagtgttttatttctttaaatttaaaaaaaatgagcacttacaccacatgagcacattggctttttttgtggacgttgcctgcatcttctttcctgtttttctatcttcatgaagtcaagtgcaactgaggtggtttattttactacttgcatgtcaatggaatgtggatatcggggctgttgtatgttctggatggaaatgtggtcctgctgcaatacaataaatctcatcattaccctatgtgaccacaaaaagggtgaaccagaaaaatgctaggaagtatggagtcttcataatactaatcacttacatttgtacaaacttaaaaatttcagaggttagatattggctgtaatttccaaaggctctgaggttaggaattcaggtttttaaattcactggagagttaggccttgttttaaaatgtagttttattattcagatgtagtgaggctgacagatcaggagattactgccattgaaaagacagtttgttactcacagttccctagaagaggtgcctgctatgccatgggggtcacatgggggagcacttgggtgagtctggagacagagacaaaaggggagctgtgggcaagagtctttattgtggtttgtctgtgaaggaatgggtgaggcaaagtaaatgggtttaggatggactagattgagtaatttcattgggttttgagacagcagctgcagctgtccctacttgtctggtacctcatcctggggtaactagggaaagtaaatggtgtcccagagcataaaagcccagtaaggaatatggttggaatgtgggctctggatttgttggtttgcaaatggaaggctgcacactcacagctgaatcctacttctaagagttggtgaaaactagaaagagaagggaagtccctactgtgttagcaaagccctggatatgaaagcattagaataaaaggacacatttaacacaggcccaggcactttattcaataaatatttgttaaatgaatcaataaataacggatttgcaaatctttatactgtagtcttgctagtgtttaatcttcatagaaacagtactattctttgagtgacagagtgataaaaagtttattaaatgtgtagaagactgcaaagattaagaaggatatcttaaaaaatagcaactggcaaaatagcacctcgtcatagacttttatttgcatttgaatttctgaaattcaattctctgtgaaagatttgcttgacaactttctttaattattgattcctcctttattttgtaaaactttcttttcattaaatctataacctccagaatggggatagagagatagatagatagatagatagatagatagatagatagatagagatatatatgtatgtgcacatatatacatatatatatacatatatatggctctctgtgacagtaactatctggaaaagtaggaaaaagtactgtgtttaaaattttttaaactaacacataataattttacatatctgtgggatacatagtgatgtggtgatgcatataattacggtaatgagatcagaataattagcatgttgtgcttttttaaaatggcaattttatataattgtataaaacttcacatatatttaacatttttcctgggggaaataataaaggaatatataagcataatcatgggctcagggattttataaatacccatgttaagggaggacttggaacctgaaaagtttacattggagaaaacattgcagaatggcagagtgaagatcttggttaactcagttttcctctaactcaatgttaatgtgaaacatcaaaaatacaacaagacaactaaataacccatttttgatctcagaaaaataaccaaagccacagaatgtactgaggagaacctattcaaaagaaagtactaaactacagtatgacagcaggcccggtgatgttttaagttggtgctatccccatcctttccaccacacacagcagctcagtggcacagtagccaaaggctaagagcattgcagacagcagacagatgtgaccatttttggagcttcactaaaaatactatccccagagcacagtcaatattttgtccaaatctgtagctccctgtgaaatctctgagtgtgttagctatttgatttgacccacagctcaactcaggcaggacaaatacaaaatgtgcaccccacattattacagaaacaatagaaaactgctgataacattttagtcacctagggctgtgattttagttgggaaaacggagcctggctgagaatttaaaaggaaattctaagatctacacaatgataaggactaccaaaaagctctgaaatactcttgggtatctaaactgatgcaaagccatgtgcatgactaagaaagatcttagaagaagccaccagctactcactgaccttacggtcctccctaagcaggaagtgaaggctagtctgtcttgtaatacgctgcctgaagttggaagacatggactcacatacagatccccacggcaaaggatagaggatctataggcaagcaatgtagggaaaacttctaaacaatagttatacactaaattataatgtttaaggtgtgactcctaggaaagcagactttaaaatagtaaaaagaactttaaaaaaatgtcagaagagatctcagtggccacacacagcaggaaatacgtaatctatagaattattccagtaaagcttctaaacaaataaggaatataaaagaaaaaacagctacaagacacgttaaggggaaaggtatggaagaaattatattatctaaattgtccagttttcaacaaaaactcatgagcatgcaaagaagtagaaaagtataccacatgcacagaaaaaaaaaaagccaacaaaaaatgtcctacagaagcccagattttgaatttagtaggggaacaatttaagtcagtgaacctacatgcatacaaaactgagggaaaccatgttgaaataattaaagcaaaatataaaaacaatgtctcacacaacagagaatatcaagaaagagatcaaaataataattttggaaagatcacagaaattttggtgatgtaaagcaaaatatttggaataagaaatccaccagaggatttaaacaacagatttgaataggaggaagagagaatcaggtaacttgatgataggtcaatagagattatgtagtttcagaaagagagtggaaaaacaatgaagaaacatgaacaaagcctcagagaaaagtgagacactatcaagcataataggtgtatacagacattcacagaaggagaagagaaagagaaacagacaaattatttgaggaaataatggctaacaattttccaaatttgtgtaaaaaaatgttaatgtacacattcaagatactcaacaatctccaagtagaataagctcaaagagatccagccctagacacatcaaaagtgacttacgcacaagggagccttaatatcagtttagtgcaaaagtaattgtggtttcagatggtgaattttaaattactataactaggctcaaacacatctttattaatcaaaataggaaccattacaatcaacacattgttgccaatgacaagtcagtttgtttattcctgtagcataaaaatctgtgctttggaatttgatgaactcttggaaaacattctctgcaaaaaaatggttgggctgcttgaagaagttgtagtcggttggcaagaggtcaggtgaatatggcagatgaagcaaaacttcatagcctaattcattcaacttttgaagcattggttgtgcgacatgcagttgggtgttgttgtggagaagaattgggccctttctgttgatgaatgtcagctgcaggccttgcagttttcagtgcatcacattgatttgctgggcatactactcagatgtaatggtttcacagggattcagaaagctgtagtggatcagaccgtcagcagactaccaaacagtgaccatgatcttcttttcgtgcaagtttggccttggggagtgctttgaagcttcttctcaatgcaaccactgagctggtagtcaccagttttcatataaaatccacttttcatcacatgtcacaatctgatagagaaatggtttgttgttgttgcatagaataagacaagatgccatttcaaaatgatattttttaaaatttttcactcagctcatgaggcacccacttatcaagctttttcacctttccaatttgcttcaaatgccaaaggaccatagagtggtcaacgttgagttccttggcaacttcttgtatagttgtaaggggacaacttagatgattgctctcatttagtcattgtcaacttctgatggccagccactatgttcatcaccttcaaggctcttgtctcctttgcaaagcttcttgaaccaccactgcactgtatgttcattagcagtttctcagccaaatgcattgttgatgatgcaagttgtctctcctgatttataacccattttgaacttgaataagaaaattgcttgaatttgctttttgtctaacataatttctgtagtctaaaataaacataaaataaacagaaagtaataagtcattagcaaaataacataaagtgagaaatgtccattaaaatgatgtataacaaaccacatttatttaagaatgtattccaatatcaaacagcaaattccaccaatacaaaaaaaatgcaatgagtttgcaccaactaataagactaacaactgacttcacgtcagaaaccaaggaagctggaaagcagtgagatgacatagttaaagttgtggcagaaaagggctgtcaactgagaactccatctacctcaactcatattcaacaacaaaaagaaaattaaacattccagaaaacaaaaactgagagactaatacaattaatattaaagtgaatctttcaaactgaaatgcaaggacagtatatggtttctcaaatacaaactaagaaataaagaacaccaggaaatgttactacattgtccttaggtcaatatctttctgtttgttactcatttcttgttctatctcttttaaatacaattgtataagcaataattataaaattatttgatagcttaacaaaaaatatagaaagagaaaaagggaattttaaaactatgttagaaaataatctatttaacaatcacaaaagacaggaatggatgaataaagaaatttttaaaaataaggcacatagaaaacaaatagcaaataacagatgcaaatcctacttcatctgtaaataaactaaattgaataattaaacatcccaaattgaaggtggatattgaaagaatggataaaaaataaatatgatccaataatatgctgtttacaaggacacatttttcatggaaagacacaaataagttgaaaataaacaaatggaaaagatatacaaggcaagattgaatcaagatggagatggaatagcaatatcaggcaacatagactttaagataaaatgttataagagtcaaaaaaagcatacgttataatgatgagtcaaaaaatggaagatatatgattataaacatatatgcacctacaaataaggcctcaaatttaatgaagcaaaaactgacagaattaaagacagagagaaagacagagagaactaaacaatttatttgacgattcaatacccactttcaataatggataaaacatctacgcagaagataaaaaagaaaacagaagacttgaacaacactatgaaaaaaggtctagcagatatctaaataactcagcacttaatcacagcagaatgtagcattttctcaagtgcacatggaacaataaaaaatacaaaaatttgaaagaaattaaatgatttctaaataaatagacagaaaatccatgtccatcaatcataagacttaacattactaagctggcaatataccttgcattaatctacagatcctacataatccctgtaaaaatcctagcaagtgttttgcataaatttttatgatgcttataaaatttgtatggaaagataatgattcagaatagtaaaaacaagcttgaggaagaatatttatggaggtctcacctttcccaatgtcaaaacctattttaagcttcagtaataaagacactgaggtattggcatatggatagaagtatagatcacttcagaagtaagactttacatttacactcaactaatttatgacaacagtgccaagatcattcaatggagagggaaaattcttgttaacaaatgttcctgggacaactggatatgcaaagaatgagttttgacctctacctcacaccttactcaaaaatccacacaaaatggactgtagacatgaatgtaagatctaaagtaataaaactagaaaaagacataagagtaaacgttcttgactatgtgttaggcaatgtttttgctgttgttgtttcgctttttacttatgatatcaaaagcaaaaaagatagataaaatggacattatcaaattaaaaacttgtgtatcaaagagcaccaagaaagtgagaaaacaatgcatagaacataagaatatgttaatacatcatatatatggatctagataaattagataaatgcaaattaaagccacagttttgcttcacactcactaagatggttataaacaaagaaacaaaaaataacaagtgttggccaagatgtggagacattggatcctttgtacattgctgctgaaaactggtgcaagccactgtgaaaacaatttggcagttcctcaaaaaattaaacatagaattgttatatgatccagcaaatctactcctaggtatatacccaagggaaataaaataatatcctagcaaaaatagagatagaaagtagactagaagttgacaaagctgggtctggggaagggtcaaggaaaagaagagaagatgaatgattgctaatacgtgtgggaattattttgtaattgatgagaaaggtcccaaaattctattacaataaaggctgaacaacactgtaaatatactaagatggaagtgaatattttaaatggatggattttatagtatgtgaaatgtgtctcagtaaagctgcagaaaaattttcattgtctttctgatagatttgaagaaaatgatgtaagttcttttacttggtaagacgttcagtcttgagagtggttttcagggacagacttataaacagaaaatacaaacgagtgtgcataggttcctgcaatgtattaaattaccttaagatggataaagaacagtgtattagttgagtgaaatccaaagaagctctttttacacttcccccttgttcttaataaagtctcttagtttatcttgctttctgtatctatctatgaaaaatttatctgaactattaatgcatctgttcatcatacactcatgtgcccattcattcatgtatccatgcatgggttctttcaattcactttaagaacctcttaattcaaagaaagagacctgataaaactgattcatacattctgtgaaaacataaacaaaatcaaataaccccccaaagacacaaggaaatgttaagagtagagagtaatatgataatgaggaaatgactgtaggcatatgagattgaaatacaattgtacaaactagtgtttgcatagctgttgtctatgctgaggtcctgctgggtgtgaaacatcataagcagtgctatcatgcatgtcaagagacataagagtgtcctctaaacagaggtgttattttatcccacttgtcaaactgagaggctgtgaaaatattgtaatctttccaaagttattaagacactaaaacagatggcaatttgacagcagaatccatgaccacttctattgttaacctttagaaaaaaaatcaggaactaattgagccttttgtgccactatactctatcttcagcatgggattccccatttacattgtgtattaaacagcacctggaatggttatttcttactgagcattgacaaatctggaatcctaaaggaaaatgttttgctttgatgtaaagctcttcccctcctcctcttttatcttgtattacttgttttttcatttaattagagaagataacgcttccctcagtacagagtgaataataagcctttactttcttgggattggttttgacatatttacacaaggtcttagatgggagacacagacaaggcttcctacacagctgccaggctgctattcatctctctttaaaatcattggttttaatgcaagcacagccaagccaagtttattaattacctttgtgaatagtaaactttatatgtacaatgcaatcatttaggagataataaagtttcaattgcattctctttgaaatatattttatctgtaaaatattttcttcttataataatgattgtctaattcatttaggcacatcattaatctgcatggattttattgttgtttgattggttttgatacacacacatctttttacaaaggggctatttattggagagcagatggtgaaaatgcatagactacacccctgcatagattgatgatttgtaatctgagaagctatgatagggaggagagtgaaaatgcttttattctcaggttataaatggacgatccaatgcaccttggattttttactttatgtaggacaaaaaggcattatttacttatgtagttgatatgcccatggattctaagaaatctgatgggaaaatgaaaaactccattataaatggattcttcatcctaatctaacattttagatatgggcaatctagagtttctcaaattgcaatctacaggcctgctacctcagaatccttttagccattgatatgactaggggctactcttaatctactgtgatgaatatctttggttgggcagaggaggtggcatttgaaccacagttccaggtattgcttttgcccacaaaagcctgagtactcctaaggtttttctgtgggtgttcaccagagctaatcccactcaataaaactggctctggcaaatttccatgattccagagttgattttcaaatgaaagagctataagttatatctataatcttccaacatgacttcctcaattgtatctacattgtcattgtttctcaccacctttatttgaatcctgtcaattttactcttgtttgttttgctgtctgttgtcacagctggtacagattctagtttatcctttccagatttgaaacttctcttactttctcccactaataccatatatatggtcaatggctcatttcctcaaatccttgttagattataatatttaatttgatgaattcatttctcccatgagttaattaagctaatgaaattttctgtatgtattaactaacatgagaactctgggaactctagtgggtctggagggtcaatcctgtatcatggtgctgatcagttatgtggtttcatgatcacaaataacccttatcaagcatcttctgctggacactgtatgtggggcatggtgccccaagcccaaaatcccagcatgttgggagcccaaagtgggaggatcacttgatccccaagagtttgagaccagcctgggcaacacagggaatccccatctctacagaaaatatcttataaaaattagccaggcatggtggcttgtgcttgtagccccagctaattgcaatactgaggcaggaggcttgcttgagcctgggagattgaggctgctgtgagccaggatcacaccactgcactccagcctgggtgacacagtgagaccctctcaaaaaaaaaataaaaataaaaataaaaataaaaagaagaagaagaagaaaaagaaggaaaaatgcatagttatttctttaaagacatttcattctaaatagcaacacagtaattcaaaaattcagcatacacctaagaatacatcataatgtaaagaacacattggtatagcaagtatatgagaccaagctccatcactttcttgttgtgtcatttttaacaagacatagaatgaatgggattcagaaatgggggaaataacatccctgtgatggagacaataacaatgtctcgagactgctctgtagataaatgagataataatgcctataaatgctgtaatagatatttgtgcaaaatgctttgtgttatgggggtaaaatgatcactgatgccttgagatggagtggagaaggatccagcaaggcttgagaaggcagctagactggagtccgatgctgccagtgaagtaatgtcaacacactagtaggacagatgatggaaagcaagtgctatctaatcctgggattccagggaaagtagaagaggcagattattaaaccaatgagagcttcagatcctccctagcactgataaatttccttgaaggagacctgaaccttggtcaatgtcttaaatttgtaataaattaaattggatgaaagtggatttaattaagtggaatacagtggtagcctagcagtttgtttgttttgttctttcgttcatctgcctgctcaggactgcttactgtctgtgttttcaggaggcactgagctgccagagcatacatggattaggaaatagtgtccatgttgcctctgttcccactgggctcaaacccaaaatgcacagttcttggttaagtgaagggttgagggtgtggaccttgactttttatttaatctcatacagtacacatgttggtttggggcaaagaagtttctggttctccatgttaggagagtgtttcaaaattatcctaataggagttaaatagacaattagagttatttcagtggcaaacaaacaaaaacaaaaacaaaaaatgtacaaacaactaagttagttaatgttttctgtgaatatacgataggaaaactatgtcaacaccagtctgagaaatccggtccccaaggggagatcaacaaggttggcagtggatggatggtgaagtggaagtcctttcaggctctggaagaacagagtttgtttgatatccatcgacagggagcctgtggagagggacagatggaagagacgggaaggaagcagtgcatgttttgagttaaagcggtgatattaacaatcagaattggagtaagctagtattccattacctcatcattttctccagaagagcacattggttacatggcccaagtttggggagactcatagctatggatttgaataaagaggcatgcagagaagagatattttaatcctcatcaagaagggcagatttataaatttaaaagaagtcaactggcacttaaaatggcattattttattgataactttccaatcacagtagaacttattctccttaaggcgatcagtatgaggttcagagggtaaaagctaaagcctgttgtccttaaaaagtttattcatgtatgcaaatatgagtttctgaaaatttcatgccattcctgaaattttagtaggctgctaaggatgattttcttagctttttgacagtaaaacacttgggaacctctttcctggtcttttacaacaaccaccacatctttcaaagactcctgctgccccagtatgaagcaaatgcagtttcccttttttccaatatatttagtaagtcaatcttcactaaaagaaaggaatgaatggcaattataataacaaaaatgtctcaggtttcatgaaatgtaaataatgattgacatgaaacaggagcctccatcaagggtctttgtgcctgaggccttctgaccatcaaccatgagcattgttgtgagtccatagggttttggcctcataaccatgggatttcaggctctgggcccagaatcacatggagagttcactaaaataaaccattgctaggctttactgtcagagtttctgattcagtagctccaggatgggaaccaaatttgattttctagtaagttcccaggtgatggcaatgcagttggttgagggatcatacacagagaacaggtgggataaaaaatgagaatgcccttctttttgccaatgtctactctatatcccaactattaagagaaaccttatcatggaatcagtttggaatttaagtacattctctcaccatacacattgacctgtccatgacttaactctccaggtgattctgatgcacaatcaagtttgagaaccagagttttaggcaaacagaatccagaactacaaaaaggaataattatataacttcagagcaagacggcattagtcacttactaaaggaaacctgcaaaatcatgcagactggatttcttttaggaaacttatttttaaacaaatgaaaataacttatttcatgtcagttgtgtttcattactctcaatacattttctgtccaaaagccagtcaagcagttccctttatcaaagggaaacacgttccaggacttccagtgggtgcctgaaaccttggacactgccaaatgctctacatgccatatttttcccttctacatgtatatctgtgataaagtttaattcataaattaggcacagtcagagattaacaataacaaaatgaaatgattaaaacagtatactataataaaagttagtgaacgttgtctctctctcgagatattttattgtaccgtactcaccctcctcctacttgcgatgatggaagagtatgaaaaagatggctactaagggattagtgggtgggcaagtagtgtagacagcacagatatgctggacaaatgaatgattcatgtcccgtggcaagacggactggatggcatgagatctcatcacgttactcagtatgcatgcaatttaaaattctacaagtcgtttatttctgaaatttcctatttaatattattttacctcaggtaactaaaaccttagcaagtgaaactgtggataagggcaggcaaggggctgaaggctaccagttgtatttactgaaatgtagtcttttacaccttattcttgctaatatttcttcacagcaaacaccctgaaagatatacaaaaccaagaaaatacttctaaaataaacatttttaaatattataaaaacgttaactctggaacttctctggcacaaaataccatataatttcacatttgaaaagtatatattcattaattttagatatctataataacccactttctcattaatcttaatcttaattcatccaccattctaattattaggtgtattttcctctaccaattttaacatgcattcaattgtgtctgccaaattattaattaacttagaatgttaaattcacccttccaaaaattaatggaagctaagaagtctagtactatgagatgatgtgatagccaccaggcaaaaagtatattttctttttataattatactcagagacatataataaatcaaagagaagagctaataaatgagaacatttgaagaagatagatagggaaagaaatggccatggtaactcctgtagttggaaaacctatgtcggtatttttaagcctttcgatggcaattcaagatttcaaatgttgaggaaaatctcatatttttataaacatttctgtctcagaaaaaagtgtggatatctcagtaaggtaaaaacagtagaaccactctgaaactattattttactttgttattgctttagaaaataactttcctaattgatacattgtaactcttttcttctctcatggttatgtgttggtatgcagaatgcatcctactgattgtagtgaagaaaatacttctgtttctcacattgataaaatgctagactatggttacataaatgagcttgcatgcagccagcaatcctccctggagctctgtatttaggtctgtggcccagattttcttaaacttttaggctgctatatatttagagtagaatacaaatgagtttcagaggaacataaattatctaaaattgttccatactgcaaaacgttcaaatgtttgtctataaagattttctttgatcacttgtatgccattttcaatcaacacgcattctgtttatgtataaaagctatattgttaccaagctcagtttctagattgagtccatgtataccttgccaataatgattttactgtatttgtatggtttttaaaaatgtctttagaaatgtgcagagggtagtggttgactatttagttcagggttcttgttctgaaaaatctttgctttttgaattctatgttgttttgaactagttaagtgaatgtgcacaagagcctaatgtatttttcctgttctaattgtaatacatgtccagcgagttggctcatttggctaaagggagttgataatgagataagggttgaaggttcaaactccctgttgaccaattaaattcataagagttttccatactcctgtccctaagactaccacatcacaaatacaaaatgttgcacgagagacatttatgagtttaaggatggttcaacagaaacccaaaaccaaccatacatttaaaaatagaccatatttagaactctcaaacagaagggtattaatatcttcattcaaaagttatatttatggcatttgtgtgtacgtgtgtgtgtgtgtgtgtatcctaaaaattatcttgcccccttgaaaggaacaaattttaaataaaaacatcaggaagagatgggttgtagatttttaaatttatagattttgcattgtttaaaacctatattttttcactattaagaaaatgtgttttaagtgttgatggtaaaagaacaattaaacatgtagataagtcaaggtcaaatgcacaagccccaaatgtgcttgcttgacagtgctgcttgttcctgcctctggtttccattccctctgggcaaagcccatgtcactcatttgcaggattgctatgtccttccttctagctggccacccacttctagcctcctttcttttgagtacatcctacacaccattagggattgaccattcgacacattatttctaaccatgttatttctgtgtttaaaacaagcaaaagtgggggtgaaagcgggtgctttgatggtcaaagggggaattaagttcatttttagagcaaaatgtagcattacctctcaaggctgcttgctctctatgcctcactgtttgcccaaggttttgttatatttctctggccttggcttctctgatctctcatcagctggtaaccaggtgttgttgacaccagccttatccagacacgtcctatgccattttggtgtccatctgtactgcgttgaacaatgtcttccaaaaatctctgtctacccagaacatcagaatgtaaggatatttgggtaaagggtctttgtagacatagttaagatgagattatatggattagggtggctcctatggacctgtggagacagacatacagaggaagggtgccatatgacgacagaggcagaaacaggagtgatgctgctgccagccaggggctgctgaccacaggaagctagaaaaggcaagggggcattcttcgttaggagagcataggcctgctgatgccttgattctagacttttagccttccttactgtggaagaataactttctgtcattttaatctactcagtttgtggaactttgtaccaacacccaaggacactaatgcttcatccaacacaattcattgtaaatagcacctgttcagactatataagaagtacattgatttttgttcaccttctctactctctcaattcatcccatcccttaaatgattaatcatttttaatcttttcattttggactaactcacagaaagctgcagaaatagtacagaatatccagcatacccttcacccaatttttcccagtggttacattttagagtacaaaaagtaggaaactgacattgttacattgtgtgtgtgtagttctatgtcacattaccacatgttcttgaaaccaccactggcatcaatatatgggactattccattactaacaaagagtgtatatacacagtcacacccacccacataccctagcaaccactaatgtgttctccatctctataattctgtcattccaagaatgttgtatgaatggaatcatacagaatgtgacttttgaggttgactttccatattcagcttaatgaccttgagatggtaaaaactattgtgcatatcaatattcagtttgtttttatttttgagtaatatttcatggtatggatggttaaacagtctgtttaaccactgtttttttcccaaatatattagtttacaggttttggttattgaaaataaagctattatgaataattgtgtatagatatttgtgtggacatgtttccatttccatgaaataaatggccagctgtgccattgctaggtgatatggccgttgcaggtgtatctttaaaaaaaaactgccaatgtattttcagactgaatgcaccgttttactcctctaccaacaacgtttaagagatacagttttgggaggggggagggatagcattgggagatatacctaatgctagatgacgagttagtgggtgcagcgcaccagcatggcacatgtatacatatgtaattaacctgcatattgtgcacatgtaccctaaaacttaaagtataaaaaaaaagagatatagtttttctaacttattgccagaatttaacattttcaatatatttttaattgtttagctcttccaatacattgcgtcataagattccattattgtcttaatttgtatttccctaatggctagagatgtcaagcaacatttttgtgtgcttattttccatctgtatattctcttcataaaatgtcagatcatgtcttttgtccattttcaaattggatattttggtttttaatgttgagttttaataattctttatgtgttgtaggtacaaacactgtggcagatataagatttgaatttttttccaaatcttttgtttgtattttcatcttattaacaagatttattgaaaaaaaaagatggagtccatttttcaatgtttttcttgtgttgtgcatgtggtttcatatctaagaagtctttttacatttgttttatatttttaattattataggctcataataggtgtataaatttacagggttacatgtgatgttttgatacaggcatacaatgtgtaataatctcaatgggtaataatcacagtggagtatccatcacttcaaacatttatcatttctttgtgttagaatcatttcaattccatcctctttgttattttaaaatatgcaactaattattatcaactaaagtcactctgctgtgctattagatactagatcttactcattctatctaactgtatttttgcatacattaaccatccccacattatcctccacctccccacttctcttcctgccctctggtaaccatcattctattctttatgttcatgagttcaactgttttaattttcagctcccacatatgagtgagaacatgtgaaacttgtctttctgtgccttgctcatttcacctaacataacatctagttccctacatgttgcaaatgacatgattccattcttttattatggctgaatatgactccattgtgtatatgtaccacatttcctttattcattagtctgttgatggaaacttaggttgattccagatcttgactattgtcaatagtgctgcaataaacacaggagcgtagatatctctatgatatgctgatttttttcttttgtgtatatacccagcagtgggattgctggctcatatggtagttctatgttccattttctgaggaatctccaaactattctccatagtggctgtactaatctacattcccatcaacagtgtatgagggttccccattcttgacatcctcaccagcattttttattgcttaccgtttagataaaagccatttttactggtgtgagatgatatctcactgtagttttcttttgcatttctctaataaccaatgatgttgaacaatttttcatatatctgctggccagttgtatgtcttcttttgagaaatgtctattcacatcttttgcccaatttttaactggattatttgatttttttgtctgatagagttttttgagctccgtatatattctactagtctcttgttagatgcatagtttgcaaatattttgtcccattctgtaggttgtctcttcactttattgtttcctttgttggcagaagctttttagctttatgtgatcctatttgtccatttttgccttggtcgctgtgcttttgaggtattactctctaagaactctatacctagctataggtcccaaagatttcctgtgttttattccaaaataatgtatagttgaaaattttacattttaatttataatccattttgagtggttttttaatatatggtataaggtttaattataaatttatatttttgtctatggatagccaattgttctaacaccatttatggaacagactatcatttctccacttattattgtttttcctctcttgctaggcattagatgtcagtacttatgtgtgtctatttcaagattccccattttgtttcattgatctattgtcaatgcctccaccaacaccacaaaatcctgattagtgcataatatttttttaattgaatgaaatgttttcttccaccttattcttcttttcaaaattgctttagctattcttaaatcattgcctgtccatatatattttagaataattctgattatatctactaaaaatgtggtaggattttggtaagaattatgttaaacctgtatacacatttgtagagaattgacatatttactatgttgagtattctaatccatggatgtggcattttttaatttagttcttatttgattttggtgtcagcagtcctttatgatttcaacatgaaactcttatagaattttattagatgtatacttaaatattattttactcattgtaatattatactttaaatttctacttccatgtgcttcttactaatacatataaatacaattgagtttttttcttacagattttttaattatacagttgatttttgtgtgttgatcttgttggattctgtgatcattttaggtccttaagcatacaattctcagggttatttctatagatcaccatgtcatctacaaataagttctattttattttttctttccagatttgtatgtcttttatttccattacttgccttactggactgtctataacttgcagtattatgttgaaaagtagttgtaagagtggatatccttgccttggtctaaagcttaaggggaaaacatttagtcttttaccatatgaactgtatgttttcgtagattctctttatcacattgagaaagttttctctcaattcctagtttaccaaagtttttattatgaatggtgctgaattttggcaaatacttttttccacataaatgtatatgattatttgatattccttctttaggttgtgaagttgtatatcatatagatttgttttcaaatgttaaactagacttgcgacactagaataaactacccttggatgtagtgtataattccctttatgtattggtaaatcctttacattaatattttgttaacaattttttatctatatttatgaataatattgtccgaagtttgtatgtactttcttcggttttggtacaagagtaatactggctgtatacaatgaatagggaagtgttgctgcctccattttctagaaaagaatgtgtagaatttacgtcttatacaattccccaataaaccactaagcttatagatttcatttttgagaaggttttaattataaatttaatttccttaacagttgtgaggttaaagttatctttttcatttcagttgaattttgttagtgtacttttccaagaatgtatccattttgtctagtttataaaatttgtgtgtagagttgtttatagtaattctttttatccttttgatggctatggtgactgtagtgatgttccttccttcatttctattttttagtaaattgtatcttctcaattcgttttttctttttcagtcttgctacagatgtgtccattctattgatatttctggaagaatcaacttttgttttattgcttttttcttttctttctattcttcaattcattattttatgcttattattgtttatttcttttttctttacttgggagttaattttgctcttttattctaattttttgagatggcagattagatttttagtttgaaatttttctttttcttttaatataaacatttagagtgctatagtttagaaaacagcactcatggtctaaagttttctgtcttgctaggctgctttttttgtggttctttggctagaaagtgcaaatttctctagggaccattgttgcttttgtttttgtttgtctgcacccgtaggcatttccaagtcactgacttctccagtaaccaatgttccagtcgtgcccaggcccatagctgctctgctgtcttctttccagtttgctgtgtcttcttagtttgtttcgtagatacaatgtcgacacttttcagttgtactttgaagacaatagagaagtaactctccttcacttccaggaagcagaagtcaaaatttggctaatcttttaacactatacatatattttttttcatgttgctcacctgctaaaagtcccaggaaccatcaaattagccaattagctaaaggatataatcaaattttttatcctggtttctaaactcacaataatctggtcccatccccaataatcatgcatcagatttgtccattcttctttagataactactcaaaatttcctacatagacattttattggacctcattttcctctttcagttttttttttaaatcttgggtttgttttagaaaacaaaataagatgttatagataatactgctttgaaaactgccttgcacagtgctaaggaactatgcaataaaaagtgtttttttttttttgagacggagtttcgctcttgttgcccgggttggagtgcaatggtgcaatggcactatgtcagctcaccacaacctctgcctcctgagttcaagcgattctcctgcctcagcctcctgagtagctgggattacaggcatgcgccaccacacctggctaaattttgtacttttactagagacggggtttctccatgttggtcaggctggtctcgaactcgcaacctcaggtgatctgcctgccttggcctccgaaagttctgggattacaggggtgagccactgcgcccagccaatttattattcttaataataataattgatatatacctaatgtctttgtattagtttgctagggctgccataacaaacaccacggactgagcagattaaacaatggaaatttattttctctcacttctggaggctacaaatccaagactaaggtagcaggatggatttcctctgaagcctttcttcttggattgtagatggctgctttctccctgtattctcatgtgattttttttctctgtgaatgtagctccctggtatctctgtgtgtcctagtgtcatcttattattgtaagaacgccagtcagattgaattaggaccacaacaacgacctcattttaactccatcacctttttaatggccccatcttcaatacagccacattctgaggtattgggggttagggatttaacatataaattgcagggtaagacttatttcataaatgttcctattatttggaataagaaggtgttctgtaatctcttgaactgatttgttaaaagtcacagatgggaaaagataagcagtaagagaagagattgtacttttagcagtcactcttctgattgtgatacaaagattatttaattaattgcttttttgatggcagaaggtcacaactcaatgaaaaagaaggtagcagaaatgaaatattttcttctaactgttaagtagctaacataaaagtctggaacaatcaggcacatttctctcaggatctggactttggaaaaaatgagggtgctcttccttctcaatccaaataaattcagcaattggatcatcaaattttttgccagaatggttacaaagcattagaagaaagctttaaaacatgcaagaaggataatacaaatcacactcctatattcattttattgaaagaaataagagatgatgcaacattggtgaaacttttcttagacttgttaactggtgtagttagaaaacaagcaaggttgtctgagctcctagaaatgctaattgttttcactgtttaagaagtttatatacaaggctaatgccagcatttaaaaatcaaagctaattcctttgtttgaaattcctacagcagtgagagcagaggttgctcaccagggtgggattggggtgggggagtctcagctttcacttggtgtgagcccctgccccaaacctgggatttcatgtcaacctggagagtctagtgcaagggtgtccaatattttggcttccctgggccacactggagaaagaattgtcttgggccacacataaaatacactaacactaatgacagctgatgagctaaagaaaaaaatcacaaaattatctcataatttttaaataaagtttacaaatttgtgttgggctacattgaaagctgtcctgggccacatgcagcctgtgggccacaggtttgagaagcttcgtctagtgttttagcaattcacctcattttctgaaagcagtatttgttagtcctggattgtcatgatgcagattgagaccaattacccaccagtgcctagcactcctcaacccaatttccagcagcgggatgaacagaggttccttgcacagaacaatctgcactccaagttgtctttctggctgggtgatgccccacatagttcccactagatgtcactttgttctttcctacttagctaatgtgggatttccttctggttggttcttttcttagcatgcagtgcaccaaacttcttcctgaaatcaccctcattggaagcctcactcactcttctaaggaggctgagctttttgcagtgtttcctcctgggtgtctctcttagagttgatggtatttcttgaataaaagaatccaagtgcccccactccatgtctgcacttatctgcgaacaatcttttactcacacatctcacctctgtgggggctccctctgttcttttccaacttctcatgccatgtcctctccaagtcaaagctacttacctctcccctcatctggcttgtgaacactccctgtgtttcaggaagtaaggtttgagcccacatatccttattttctgggtgtacattttttcccagagatggcacatgagcaaaaatgtgaagattttagaaacatagaagtcaaatattttgtgcgttgttaaacttctcaccttagtgtgaaaatgaggactgtgccttcaggaaatgtttcagtgtgtcctctgtggtcagttcaatccaactttcaatcccatttatcagttgagattccaaattcaggcaaagaaaagactccccaaaactcccagcatcacagttcttcgctgaggactaacacagaccatcacgaaggacccagacaagactgtttaaggaacagagagacttgaagagagcatctgggactggaccggaacacacaaatccgacagcatggagggccagatggtgttcctctgaacaagatctgggttaagctctcggacagatgtccaagcacagactgcacctgccatcaccagactgaaggacagcttggtgaaggccaggtttgggttcatttctcagatcatgtgagaaaaaaagcaagggaaaatataggccataaggaatcaatcctgcaaaattaaaaaaaaattggtctctttatgcatcactttctcttcacaactccatttgggatggtttaggatggtcgaaattggtgtaaaatgtgcaactataagaatataaattaattagacttgtttcatgtgaatgcacaagaatatgcattgaatgtgtttcatttcacagataggctttgacatacattatctctcttaaacacacacaaaaaaagctacaaaacagttcaacaccattttattgataagaaaatgacaactatgacgtctctatgcagctcctgcatagtctttctgttctttaatgtactgtgcccagtgtcaaccacaattctgggtatgctctcttttctctgcttaaaacatattatctttcccacccaactttcactcagttcctgcttggttattcactaagcttcagcatagatagccttcttccaggaagccaccacagtctggaataagttatcctcagaaatagtttttctatcatcatgcttactgcactctatcatcccagctgttttcttgttcatctcctcactagacgagacctcctgatggacaggcagaaagtctcattgttaaggcattcccagctcttagaacggtgtctagtccatgtaaacagacaataatacgtgtcaaatgaatgggtggcatagctgaagatttattatgtataaatgtatatttatttcttatgcataaacaggctaaaaaccaaactcctcttcttcggctgaagtaagcattctctgtaagtttagaactatgatttcattttctaagaaatattataccatcttttattttcccttaaattgtattctaacagtaggcattgttcactagctgacactcttttgggattacacacttaagaaatatacaagaccttatgtaagaattaaaaagttaaggttatataatctgcaatctctggaagtgaatgtctctgtaaatttcaataatatgagttcatcatatttaatgcttcttcatttacaccatagatacataactttccaagctcttgcttttcagcactgggtggtccttcctcccttcctaattaagtttgtgtgacaactggcttgcacagtcagtgaatttattctctaagtttagaaaatcataaacattgtatgtattttcacaatttaattagttggcagttttgttaaagtgcagatcattaaaaaatattattttaatgtaggttatcttaaaggttttttgctgagtctatagtaaaccagtgcttctcaacctttatcaggaatgatctgaagattttcttaaaatggtgattcaggtccagcaggtctaacgtggggcctgagattctgcattctaaccagctctgtgagatggccaatgatgccagcctgtgaaccaggacctcaaaataagagttgtcatctggttcactcgtgctccctaatgctgaaaatgaaatttatagtaaggttgctaataaaatgcaatagataatagataaatagttagaaggtaaatgcttcagattattttgttaatgtgaatttaaaattatcctgcttctcctaatatatgttgtgtattttaaaagaagcaatgatgtaacataagttttaaagccagatttgacttctggattgtccctttagtagccagttgtccttggacaaattcattaattatcttgtcaagttacaaacattgggctagttatcaaatctcaggtctcttggtttgaataaaatgggtaaatttatataatagcaataagccagggatatggtaaatacgtaataaatcataattaaagtaataataacaatctccctttagaaactgatgagagagtgtggaagaattactcaatgttagccatgaaagggactttgtgggtgctctaacccaaaccttcctctgacactgaaatcccttctggcatgccatcttgcctgaaaagctgagcctccttgccctcgcttttaattaaatcatcagaaactccttccacactccaactacgatacgctttcctaagacttccacctcagccttgttctttcttatgaattcatacaggaatggctccatcattttgtcctgttctggtcctcctgtgcttgacaattgcccataggtggtctccttgccttctgtacacgtggaaaacaatcactcttttccacccttccctctggctgatctatgtacccctgaaaatagagcatccagacaaaaggcaagaatcgggtggactaatcgtagatgtgtactgcagaatgggctcctccaagtttctggttctgggaactgtagttctcttagtgcaatccaagatcacattggcactgtggtcacatcacagtaaggacccagtggaaattatgactgagtgtcgtcacaagcaactctatcactcctctctccaaccctcctgtgcagtgggtttaagggatgcacagaccttatcactattcctgtcaaaggtattactatattgcattccttttatattactctcatggcaggccacattgatttagatcatttttctttccatcaatgaatttgctgttcctccccatttgatgtgaagggtaaaagaaaaaaaattcatcactctgatttcaaagttcttgtctaagtcatgaataaaaatcctaaaaaggataattctagacacaaaaatcctaatgaccaaaagaagtgtctcccacctgtgagtcagatctactgacacagatataaagacagtgctgatcgcacatttgatgctctcttataatagtgaatgacataccaggactctatggactcttggtttggctcacactgagtaagcagagtgtcttccgtacatttcactttggttaatcaggtgttggtgtgtgtttcacatcagctgatcatgccccatcaggttgcatataagacttcatccgtggtggtgtaccctgcaggagccctttggggaactccgatgacacataaggatgccttgtgcttctcatagcttcccattatccctggtttcagaaattaaaatggggtcgtttgcttaagatggccatagtaggtccttgcatttatcttagtctccacctgggtgtgatgattgtatctgataagtaacttgtggaataagagttcaaattaggctgggcgtggtggctcatgcctgtaatcccagcactttaggaggccgaggagggcagatcacaaggtcaggagatcgagaccatcctggctaacacggtgaaatactgtgtctactaaaaatgcaaaaaagtagcggggcatggtggcgggcgcctgtagtcccagctactcaggaggctgaggcaggagaatggcatgaacctgggaggcggagcttgcagtgagccgagatcgcgccacggcactccagcctgggtgacagagcaagactccgtctcaaaaaaaaaaaaaaaaaaaaaaaaaaaaactcaagttaattcctaggccatgtctttatctaaaatgggtatcagcacaggcgaggcctctcattgggatgcatcaactgatccattttattttaatcagaatcaccatattatcttcctttaatctttccctatacatttctctaattaatgatttacattttttttgcctatagagtatattccctatttcccatatcaaatcttgccattattagattcctctgagtgctttaatggatgtgaattttactagtttgtatgctttcgttttatttctaattggtcaaatcggtgttatattttttctagtaatttgggaggcagaaacttaaacctcagacccgtaagtcatgattcagaagacactgaacttgctaatgattgactgcccggggtgtggagggtgaaggaggcctttgcctgctacggaagctgcacggaccacagccctagtgcacatgatgtcgagctctctgtgtgccttcgaggaaggtgtccaaggggcagtgcacacactgactcttggacgccacagagttgatgaaatgagaactaagatgagtcatgttgaatccaagacttgtgcaatttataaaacagagaagtggacaggcaagctaagagcaggagtttagaacaccactgactaagcacctgaagcccacctgtgctgctctggcggtcgctggttgttggcactgatgtctctgccttgcctgatgattaagaaaacacctcactttttgcttcaggtagaaatatttgcaccacacactaaaacctactgcatttaactccatatctttttataaaaattatatatgtaaaaaaaatttagaaataaatgagacacagactttttgttataaaacttatagcgtgcttattttttctatctcattttgaggcatttgttatctttctttttaagcatttctagtcattgtaagttacttaaactgtatatcttaatttgttagtggccacttggaatgtgtgcaaactacaccattaaaaacttattggagaagagtgacatgattaagccaatgcagggattattaagtattgcaggtaaattcacaagtaagatattctgtaggacaagcaatcctatttcttcaactaataaatggcaagaaagacaaagggaaggagatgcttataaatgtaagacatttaaaaccaaagcaaagaaagacgttatgtgaacctcatttagacctgggtttaaaaaatacattgatgagaaatctatgagaattttaggagaaatttaaaaatgacttgggtattagatggtattaaataatagttattaatttcattagggattttcatgacatttttgttgtttaaaagtgcccttatctgctagagaagcacaaaggggcattttttaaattaattattattattattttttgagacggagttttgctcttgttacccaggctggagtgtaatggcatgatcttggcttactgcaacccccgcctcccaggttcaagtgattctcctgcctcagcctcccaagtaactgggattacaggcatgttccaccatgcccggctaattttgtatttttagtagagacagggtttctccatgttgcccagtctggtctcgagctcccgacctcagatgatccatctgcctcggcctcccaaagtgctgggattacaggcgtgagccaccacacctggccaaggagcatttgtagttaaaataaaatagtattattgagtcgctttgaaattcaacaaacaaaagcagaagacatgttcaaatgtcaattgctgttggagatgaatggtgggtacaggcagagtcactacaccattctctcccagttgatgagtttttgaaatttttcataataaaacatatttaataaattaactaaaataacactaataaagactctaaacatttaatgttgcaacattaatgacagtgtaaatcactgtgaagctggagagattattgacaacactaagcattgtattcaatgtaaaaataagtcttgggattaaacggaattgagctcagtagaacttacgattgtaaatattttttttcttctaaatcatcctcttttatccagtttgtacaactttcacaatttataccttcttttattcaggcatcacagctgcaggaaatctgttaagggactgtggaaccatatttgtgtcccagttgaaaagcgacaacatccccttttgattcatgcctctctgttgtggaactagtttctagatgtggtatttcataatcattctaatctagactctatgaattgatctttcctcttaatgagtttgttcaagagcaaaggaaaaatattggttactgttctttcctgtagacatggcctttgctcctagcagaggtggctacaaaattcacagctgcacctggatcccatcctttcatactccacacttttgaatatctctatcttgtcttatatagatgttcctcaacttacaatggggttacatccttataaaaccatcataatttgaaaatgcattcaacaccctgataaaccaattataaagctaaaaaactgtgagtgaaaccgtggtatattggggactgtttgtatttctaaccttttcttctcatttttttggtcatcagcctttatacatgagacaatttactcaatctttgattttctttgctttcaataagcaacaattaaatataattttaccaccatctctctctgggatctgttcccatctcttcattcctacagcaatctatctagtcccctccaccaattcccatccccacagcccacccccagggtgctgctgatgtgttgtaggtcctacccctaatccattcttcacagaggaggttgaagaaacttttaaaaatgcaaatcttaaaataattctcatgaactgaaaacttccgcgggctgggagctcctgtagtctcagctacagttgagactgaggtaggaggaaagctttggcctaggaatttgaggttgcagtgaaccatgatagcatcattgctttccagccagggtgacagacagagacggtctttaaaaaagaaaaagataaagaaaaaaacctggtggaacccattgatgaagtgcagtggtgtgatcatagctctttgcagcctcaaactcctgggctcaagtgatcctcctagcccagcctctcaagtagctgggactacaggcacatgctgacatgcctggctaattgacttttttttttttttggtagaggtaaggtcttgcattgttccccagactagtctaaattcttggattccagtgttgcccaggctaatctaaattattggattctagtgatcctcccaccttagcctctcaaagcagtgggattatagccatgagctatggctcgttgccaattttaccaataattgtctatttagcaattaaagcaatgtaaagattttggcttgtgtccacacaggcatgagccattgagtaataaaaaactaaaagttatgattttttaaaattatgtgtatttaaatttatgattactagttttatttatttcccttcctttcttcccttccctctgttattttccttctactctgaaagaatgaagataacacaattttatgcactttctcaaactttaagatgcaaaataatcatttagggagaacatgtaaaaatacaaattttctttatcagtagagaatctatattagcgagtctatattagcaagtctaaattgaagccaggaatatgactttttataagtaaagcaaatgattttgatagatgatgtccacatacagagaacccaaatgcttctggaattatttcttgcatagcaggaaattaaattaggattttttgactaaggcacaaatgtatgctatatatggcataccagcaggaacaagatgaaaattttaaaaagaagtaactggaaaccatttacatgacctttcattccttattcacattgaatttatgaaagcagtctgctttataaaataatttgtgaaggggatgtctttgcacagagttgcaggagtaaactgtgagttccttcacactcctggcctcacactcttgaagctgactatgcgttcctgcaattaagggacccagtggacagatgtttgactcgcacccaggccatccagaagttgagagagtgggtggctccagctttaacagtaaaattaaagatgctttggtattcaacagtattcctaatttgtcagaaagtgttgcttgtggaacagtgagattacaacatagggagataagcactcttgtgcgtgcacacacatacacacacacaccaaaaacagcaatgtaggctgaggtgggaaactgccacctgaggaaaatgcattacgcatgtcatagcagcctagggagatgtccttagtgaggacatttaagaaccaacagaaaatcaagaagctttaaacatctctctggtttagggaaaaataaatcatctatgataacactaatcacataaaactttattatcattctgacatctctctgaatagtcacctttatgtaatactaaaaaaaatttctgaaaaactacaagttgcaaagaagagaagggccatatccccctctttttcgccaggggttaaactcacagaagtccctagttatggaagaaagaagatacaattttaagcaagttaaatgctttgaatgtaacataagtcagacatattttaccagtaagttaagaatgtgtttctaagttgccatcacattttttaaccaagaattatcagataagtaaggggacgaccaacctttttacctaagagcaggagagaaatttacattttagagggaatcacaagacctgcttgtaagaatcctgagtgtcttttaaatttctttcttttgggccaaaattaaaccggatttcaaaagcacattaaaataacatagttgtgatattaatgtcttctaatggtgaaattagcttaaaaatggcttttcatttgatcattctctactggggcatatgagggtcaccattactttgaacatgatattttgtgtccttacttcaggaggtgtggcatggagcctagaacctggacttcttaatcgctctgtaaaataatctggaataaactctgcaagagaactataggttcatataaaggtctaaagctatagccttggaatttcttcttgttttctcataaaataacatctataaactgctgtatataaaatttgtaacagaattaccacattgtttcatcatatttgccattgaaaacttttgatctcacaaggacagaaaaatgtattgattcttcaagaacttccagatataaggacttaagagatgattttatggttataaggaaattttcaatttgttcagtgaattaaaatagatgatatttgcgaaccatttaaaatagtgtctaaaatataggaaggactctgttggtttagatagatagatgatagctagatagataaagagattgagacagactgagagagcaagtctacatgatgtagagccttttcctatggcagtggtgagaaacagctcccagtgttaggagacagtagggtgcagggccagagcacatgtgctggaagtcagaaaacgtgggttgacatccgagcccagtcccttaactcgcttggtgtattaggctgttctttgccttactataaagaaatacttgtggctgggtaatatatataaagaaaggaggtttaattggctcattttttctgcaggttgtacaagcatggctccagcatctgcttctagtgagagcctcaggaaacttacaatcatggcagaaagtagagcatgagcaggcacatcacgtgctcagagtagcagcaagagccagaaggaaagatgcaacacatttttaaacaaccaatctcatgaagacttagacattattgtgaggacagctaagccattaatgacaatttcacccccatgatccaatcacctcccaccagaccgcatctccaacattggagattacaattcaacataagatttaggggggacaacatctaaactttattacttaggatttacttcttttggggagggggtcctcagtttcttcatttctaaatcagagataataaaaactatcaaaaatatgtgttgttgtaatcaaaatagtaaaccaacataccccacaaaaatgattacatatagtaagacaaatagtgggtaattttctaactttcaaactcttctagcaccagatcctatggatatgtgattctgttaggataaaagagacacaaagatgtagtgtattcagcccatctgggttctgattttagttctgttgagaacaatttgtaagacattgttcagttgtactggccaccaaagctctaagaacttcctagctgtgtgaagaagctcaacgagatcaggggttagcaaatttttctttaaatggccaaagagtagagttcaggctttgaagagccacagggtgtgtgtagcaaatactcaactccatgattttagtgaggaagcagtcttagacaatacataaacaaattatcttgtgcttgtgatctaataaaattgtatttatgggcactgaaatttgagtttcacatttcaacttgtcattaaataatatccttctttcgacatttttcaacctttaaatatgtaaaggtcattcttagctacaggccataagtaataggtgacagactagatttggtgccaggactggagttttctgatctccaaactagattgtttccaagagctagcatactctcaaaaccttgattctgttgttgtaattggtgctctttgatctattttctcattctcatccccacactcccatttctgcatatctacttggtattctttctgaaaattacctcatggttgcaagctcataatttgtaaagggctgttatcaagaaagataacatattattttaaatatttaaatgtttaactcactatcattcatcaaatggtaagttaattctactcttttttaaatattctgaaatcaagaatcataaccaccccattctagcgtgaatttatattaccaagacttgggccaagagtaatcattcattaacctgaattcaattaaatgaacctaaaacaaaggagttcatagaaaaaacaaagagaatcccagcatttctctgttatttgtatgtgtttgtttatttaaacaaaagaagtgattttcctctgccacaaatgctgactgttcaatttttgcatcttgtcaaattttcccaggtatctgattttttgatatgttatgtcttagcctcctttacttttacctactagaagttgatgtttcttcataaccaaattattagcctttatacaaataagtttttgcattatttacaaatattagttttgttccagttacactttactgttccaaagatatttaaaatgtcatttatgttattaagttagtttctttgagttttctacattccaaaattcttactctccttttcatttttaggagtattaaattttcttagaatatacggtgaaggtctaaaagaaatttatttttaaattccagcactttgggaggctgagtagggcagatcacttgagctcaggagaccaacctggacaacatggtaaaaccccatgtctacaaaaaacacaaatgttagccaggtatggtggtgcatgcctgtggtctcagctgcttgggaggctgaggtgaaaggaatgcttgagcccaggcagtcaatgctgcagtgagccatgatggtgccaccatgctctagccttggtgacacagagatgctgccaaaaaaaaaaatttttagttcaacatacaatcaatcattaatattatcatttacctatatgcagacctacttaacatttataaacttatattttttcatataaaagaaggctctatgtaaaatgtgagagataaaagttagatccaaggaaggactcaaaattaagagatactaggtaatcataaaaagctattttaattacatgaacagaatacattcatgaccagaatgtttcatggaacaaattgatgggggaaatagttgccattttagaaaactttctagttgtaagacttaaacaaaataactgtcattaagtaagtatatgtaataggataaacataaaatgtcctcccagtcaccttctgcaaagtaaggtgaagggaaagcttatcctgtgtttctcaaacttgactgtcataacaacctgggggtgtcacatgctaagttaaatattctccatgccttagagattctagatgaagatgcgccaaagaatctgtattttaccaagttgctaagatgatttttgaaaattatgcaaatttggtgaatcctgagttagtggttaagacttaaggatcaaaattttaagttttttctgctttaaaattcgataatcatactaatttcaaggtatttttcagagtattaaatgagagggcatatggaatggacttatttgagaacctggcacaaataaaacaattaataaatcatccttgcaggtgtaatacattgtaaatacattttttgtgttggcatccatgaaaaaaaataaagtaatttaaatttatttatcagattaaataacttcctttaaacaatcaggcaaatttattaaatcttctgaattttagtttatcctcctcaaaaataaggggttaaagtgggttttaaaaatattgggattgagggaaatttgaattcttgaagataaaccaagagaaaaaaagagaaagaaaaaaataaagtcatgcccagcattcacagtaaaatagttgtatatatgaaataagaaatctgacaacttgtctttacatttactgctgctagccctgaaaaatggcagagtgtggggtgaatgcatgatcctcatgtgcagcattacctgcacctccaaatgtgctccttcactttagtattatctctttgttttctttccatcttttacaatagtcattaacttaaatactttgatttttaattacattctttcattttcagcactatatttatcaaaacatagaaaaggtgtcagctcctaatgaacaaaacaaatattaaatgaaggtgagaaaactctagttttttcacttaatttattagttctgttttgtagaatgtcgctcatattttttaatactaattagtaaattatggcaatatcataaacctattttttatgtgtttgaccttatcattaatattttggctgatttcttaatattttacctctgacctgaaattagtttagcattgatgtgaataatggcagttgccaagtaagttttgcctaataggactggggtttggtttttaattttgtaattctttacattgaaatttgctacctaattttaacagtatgtcatttacgattgatgcaggcaagaactctgttatattaataaatagtgcatcaatattctaaaccactcaaaaaagttaaaaaaactataattggttgctgagagaattaaaaataaaattatataaaatgctcaattaaagctaaagaaggcaggatagagtgaaaacaaaaaaaaagaaaaatggaaaagagccatgaattgtaaagattagcaaatacgctatacattaagtcaactatgtcaataatcactttaatttaaaatgttctaaatacgtcatttaaaagacaggctaacagaatgcgcaaggaaacaagatccaactgcattatctacaagaaacttaccttaaatataaagaaacagatagacaacttgtaaatatatagagaaatatatgccatgttaacactaaccaaaagaaagctaaagtagctaaattatatcaaataggtcattatatataaaggaggtcattattatatttatgcatggattgattcatcagaagtcataatagtcattaacatgtttgcacttaaaaacagacgatctttatttgtgagaggaaaagctgacagaattgttaggataactggatgaattaaccattatatttgagcactcatctcccctccatcagaaacagatagatccagcaggtagaaaatgagtgcatagtggaactaagcagcacctcaatcaactaaatctagttggcacatatagaatactttatccaacaatggcagaatccacaatagactacattcggggccataaagtacatcttaacaaatttaaaataatagaaacatacaaagtataattttagaccatagtgggattaaaatagaaatcaataatagaaagatagctggaaaactctaaaatgcttacaggttaatcaacttttcaataacacatggatcaaaggagaagtctcaggagaaatttaaaaatattttgaatgaaatgaaaatgagaatactataatacatgtcaaaattcgtggaattcagcaaaagcaatgtttagaggaaaatttatagcacagaatgtatatattataaaataaatattgaaatcaacaatctaatctttcaccttaggaaacgagaaaaataagagtaaagaaaatcccaaataaacagaagaaaaaataataaagttaaagcagaaatcaataaaattaaatacaggaaatcaacagaatcagtgaaagcaaaggctggctctttgaaaaaaaatcaataaaatcaaaacacccttagcgagttaattatgtaaaaaagagagaagacacaaattattaatatcagaaatgaaagagaggccatcattattgatctcatggacattcatagagtagtaagggaatattatgaacaagcctgtgcttacaaatttgataacctagacaaaatggaccatcttcttgaaagacatgatctgccaaaactcatacaagcagaaacagagaacctgaataggttctatatctattaatgaaatttaatcaataattaataaccttccaaaacaaaaagcaccaggctagatgtgtttacttgtgtattcttccccaaattcaaggagtaaacagattgaattataagtaaaaacttcccaaataaaatcctaagtacagatgcttaattgataaatacaaccaacagcttattgaagaaataatacaaattcttcacaaaatctttgaaaatacaagaggagggagcacataaaaactcattctatgaggacaatattaccttgctataaaaaccaggcaaatatatcacatgaaaagaaaactacaggtcaacatcccatatcaatgtaaacacacaaatcttcaaagtaatacaaggaatccagaaacttatttatcccagtattgtaaattgtatttatccaggagtgtaatattggaaaataaattaatttaattttccatattaatagaaaaaataaaccttaatataagcataaattatagctgatgaaatccaacccctttcatgataaaaatacccaacaaactaaaagtagaagagaaattcttcaacttgataaaaggcatctatgaaaaatccacatctaattcatccttattggtgaaagattgaatactttccccctaagactgggaacaagacaaggatatgtgctcttgccacttatattaaacattgtaatagaaggtctagccaggttagtacggcaagaaaaagaaataaaacatacttattttggaaagtaaaaaataaaattacaccagaggacattatctttagatagaaaatcttgacacacacacacacacacacacacacacacaaacaaacaagaagaaaacatttaaattaaaaacgtagcaagataacagcatataagatcgaagtttaaatataaattgtattttgtacactagcaatatgcaatccaaataaaattgagaactgttccattgacagcagcataaaaataataaaatgcttatgaataaatttaatgaaaaagtgcaaacatgtatgcattgtttcctagggctgccatattaaagtgccacaaatgaggtggcttaaaataaccaaaatttattgtctcacagttgtgtaagtttgaagtctgaaatgaagttgtcaagagagccatgctctgaaacacatacaaagatccttccttacctcttcctagctgtcagtggtttcccagcaatcttcagcattcctcggcttatagctacgtaactccatcctctgccgttctgccacccagtattcttgtgtgcctctgtcttcacatggctgtcttcctatagaaacaccagtcatattggactaggaagtgaccctacctttaaatatgttcacattcagaagtactagagattaggacttcaacctacttttttgggggcagacataatccaaaccataacaatttgtattctgggaaccacaagatacttttgaacaaaattaaagatgatctaaatttttaaaaatatttcatggtgatggattttaatattgttaagatgtttatacctccaaaactgacctaaagaaacaatgctttccttatcaaaatttcagcttttttgcagaaattgagaatcagatgataaaattcatatgcaagagacctagaataattgaaacaattccaaaaagatagaacaaagttggaggattcatactatatttcctgatttcaaaactgactaaaaggatagagtaatcagataatataatataatctgattactgtaatgtaatataaagatacacatgtaaattaatagagtaaacttgggagtttagaaatacagttttacactaaaattcattgttacaacattttatcaatgtggccaagacaattcattaagtaatagtatttttatccaacggcacaaggacttctggatatccacatgcaaaaagaattaagttggatgcctaatttacaccatataataattaacttaaaatgcattatgcacttaaatggaagagctaaaattacaacactcttataggaaaatgtaagaataaattcttgtgccctaaagttaggcaattgtttcttggctatgccaacaaaatcacaaggaaaaaatttaaaagtagataagttggatttcattaaaattaaaaaagagtttttaccccagtggacactattaatagatcaatttacaaaattagataaactatttgtcaattacatttctaataagggcctagtatccggaaaacataaacatttcttttaactgacagtaaaaagacaacccaaatttaaatatttaaggaattaaagagatatttctccaaaagaagaaacacatatgcaccatatgcaaatgaaagtatgcttaatatcattaatcatcattgaaattaaaatcaaaaccacattgagctatcactttatgtccactaggatggccattgccagaaaacagacagtaataaatgctggcccagatgcagaggaattggaacactcttatattgctggggcatctgaaatggcacagctgccttacaaaacctttgctaataccttaaaatatttagcctagagttctcatgtgacccagtaactccactgccatgataaatgaaaccacgtcccatattcacccaagataaatgaacacacattaacagaaatgcttttacaaaaagggtcatagtggaattacgcaccatagttacaaagtggaaatgatccaaatgaccattaactgatgaatggatgaacaaaatgtggaatgcttttacaagggaatagtctttgtcaataaaaagaaggaaatgcagatacatgctataacatggtgaaacctcattgaaaacatgaaaacattaagctaagtgaaataagtaaaaaagatcacatattgtatgatttcatttatatgtaatgtccagaataagctaacccatagaaatataaatagactggtggtttccagggattagggagaggaatgattagggaatgatatttttctttgtgtaagtaaaatattttaaaagtagacagtagtgatgattttgctatcctggaatataataaacgtcactgaattatagacttcaaaagtgaacttcatggtttacaatgaatgaattatattttgattataaatatgcatatatataaatatatataattgtgtgtgtgtgtgtgtgtgtgtgtgtgtgtgtgtataatccaggatagtatcctggatagaatcctggattgtttaagctgccaaaacttccaaattagtaacacatgaacttgttcaatgactcctctgtcacctcttgaaattaattccagccatttatttatctacaacacaaaccccaccacaacacatacacattgtgagctaaacttcatttttctgatgacttctctcatattctaaatccatatttcctttttcaagcaatttttgaaacaccaaaactattgattgagctcccatcaggtggagaacaagatacttctcattactagcagggactgtgtcaggcatctcaagcaatccagaaaaatttatgcatcatattcctgcctgtaagaagtggcatttaaattctggctttgatcctcttacttactataatattgattctcaataaagaagacaaagttactatcacccttatgtgaatattcccaaatctccaatttcagcattgggtctctgatgagttgatgattattatttaatggactccaactgtgacaacacgactcatctttcccaaatgggctcccttctgggcagctcccttctcagcaaatgatgtcatcatttacccacttgcccttgccagaaacctgggcattgtttgtaaatgtttcttctcacttacttatattctatattcaaccaatcaccaagttctatgtactttaccttctaaagagattttacttctctccaattatctccttacccactacttatttccttaaccattacttatctccttatctgttactgctatccttggccaaggtatcatcttttcatacttatattactgaacaaaccataaactctttccatctttgttccatatcatttttcatactgttgccaaaatgttccttctcatgagagcatttctcagtggcttccattgttcaaggtaaggtatacaatttttaacctggtgatcgaataacctgctccttgcctactgttccagcctcagttcttattatttatttatttttgagttggggttttactccgttccccaagctagagtgcagtggtgcaatcatggctcaccgcaaccttgaactcttgggtccaagccattttctgacctcagcctctagagaaactaagaatccaggtgtgcaccaccatgcccagctaatttcttattgttatttattgtagaaatggggtcttgctatgttgctcaggctagtctcaaactgctgggctcaagtgttcctctgacctcggcctctcaaggtacatcccaccttggcctctcaaggcataagccagtgaactaggccttcaattttttttaaacttctctcactcatatggctgaaccaccctgccctttcttaaattcttcaaatggactgcaattgtctcatcattccgacttgcctgtaattcagactcactctttcccacactaacctcaactgcttcaatggctccacctagctaacatctgctgaatgttcggaactcactaagctgatactgcttctaggactttttccctgatcacccccaagttggtgagagaatacttggtattaacctcccttaagactttatagtatttatatgttccattttctctactcctgtatacattgctacctctgggaaagcaagaagcactcccattttattatatcttgctttgaaaaaaatccggtgatcagtaaatatttttgaatgaagaaatatgatttgaaaggtgtttaccaggttttcaatgaactttaaaaaacatgttaatgctcctgtttctttaaattgaagaagtccctctcatgaggctccatggtgctggaatgcgtggggcagggaggaaaacagatgtcttcttattcctgtgtgggcgagtttattaacatccctgaatctcaatttcctcatttgtaaaaggcattagaacacatgaggactgtttgtgggtaaaaagaaatgttgtctgtaaagcatgccaattgaggaagcagcgcttgtctttcccatcttttctcagtacctctcccctcgccagtcagtcctgagaaaaggtacctcgaagttggtcctaactcataacccattctttttttctctcattagaaaacaagtcatttgcattacttctaagcaagagttggaaaaacaaacacattaatgtattttataattttaaaaaattgtttgatagacttaataggccctgtttttcttaagaaaatatatgttgctgtctttttattggaaacaatggataatgtaccaggccaggtaattctatttgaccccatttttctatcctttctgttttgaagggcttggaagcagttccaaacggagggaaaaatgaatcatcacctttccgtacatgcattttggattgtcagattggatttgaaaatagcctcatattgtttcactccacaatagataaaacatgaatttctatcagcctcatgaccttcttgtttccccggtactcctgctttaatctaaggattctctgttcttgagcttgcatagttgagttagagcaaattaatgaaagacaatatgtcctactatgttccacagataaaataccaggatcatccataaaggtcaaaactgagtgagcccagaggagattttggacctaggattggccttaggcactttgtctgaaagagaagagcctgaaccttactcaaggctacaatatcttcctcctccgattgctatggaaacatttcttttattttttaaagcaaacatccatgccagacatatgacacagcagaaaagctgtggagaaggatgaagtcaggagtttggaatcatctttcaagatatatagcccagtggttaaattttcaggccctggagtgtgtccaacttcttgggttccaatctgttcacaaaccacacaaagcaggtttcttaatcacttcatgcaagcagtcacatcattagtaaagtaagaaagatgacgacatttccttcctgtggtgccgtgtggtttactgtatgtaaagtcttttagaacattgtctggtgcaaagcaccatcagtgttagctgtaattatcaagtttcagcttccaacaatgtcaagcaagatagatgagtgaataggccccatggaggcaattggggattgctggaacagcaggacactgggctgcatttgttaggatcaagggcaggcatgttttatttcaaaataaacaagcaagccagcaaatcctcactgagcctccaggtttaggtttatagagtgtaaccatgtcatctaccctgtgttttgagatttaacttataatttattatatcaaacctaagtatattgttgcaagagataagacaatgagtcatatttcatcatgcacttctttagtgattcagcaaaacacaatttcgaggaaatatttaaaattgttatagttactaagaaataaattacgtggacagcctctctctatcatttctttcatttttaagggaagaattgttttactcagaacgtggtgttctcctagccagagaaacagtcagtttgtcatatgcgttcatcttttgtcatatttgttaaagggctatgctgagtggaaatgcagctgcacaggtaacttaagctcacaggtggaagccagatgcatgaagacacaatgggttagggtgattataccttatcgggagcaatgccttggctgagcctgtacattcttttttttcttctttagaagctttacacttttttgtttttgtttttcatctttctaactttatttgaaatgccacagtggagcagaaagtgtgtaggctgtaaaatgaaagagaacaaggtcaaagtcaaatccaagatctggtactaacctgggaaaattacataatctccccaagcactggtgtcaaaatctgtaaaatggaggtgatatgtcatggttaaggactgctttaaggattaaattcataagatatatagtaaggcctatagcactatgtacacagaatgaagtgtcatcggaagcttcttcctcctctgtctttagagtctacaagacctgcaacctgggactgtgtccatccctgtttgagttgctcaacaggacttggttaggccctttcatgtcagcacttggatgtcgttataggaatgaacctattttagggttgttaatgatcccaggacccatgatcatttcagtttagggaataatatgcacacagtttttgaatgatatgtttttcagacagtgatagtctatgtgcactttttaatttattgaatattatttgcatgtaatttgataaagcatttacacatgttggaaaatatgactcatacacagtcagtggttgatggtaagtcaaaaacttttgtaaatttctatgggtgaaaaatctaaagctccacctcaaaatcccaagtctgaaagagatctttgagatttctaaagccactttttaaaatttgcacactatcaactgcagactctgagaggttggggggttaccaccagaggcacttgtaccacacaggctgcaagcatgatctatggaatagataaataatattttcaaaacaaatactatgctttttcaaatgtatatagatgtttatatgattaataagagcagaaacagacagatgagattgtttttaatgtagaaatcccgatcagtggtttctaaatacactcatatagtaaatattttcttcaggctagaaaccacacaccttatctaagtctctatttcctataaggaagctgaaacttagaaaggccaagtgatttttggagtggcacagctgaaagtggtagagcagaatttagaaaacataccttcaaacaatgtccaactttccacaactatcttgaatcttttaattaaagttttaactttgaggattgacatgcagttgtgaagttatatgcgatgatcctgagtacactttaaacaatttccctcaatagtttacattttcaaatgatggcacaataaagcaacgaggatactgacattgataaaataaactgatgtttttcagatccacaattttacttacatttgtgtgtgtgtgtgtgtgtgtgtgtgtgtatgtgtgtttagtgccatgcaattttatcacaggtaaaatgtcttaagtacatcacctgcatcaagatacaagcagtcatcgccacaagaattcctgctgttgtgctttaataacaataacctctctctcttaccctctccacctgacttccttaacccctagtaagcaataaattgttctccattttccaaactttgtcatttcaagaatgttgtataaattcaatcatacagtgtgcaggcatttgggattgccttttttcactcagtaatattccttcaagattcatccaagttgttgctcatatcaacagttcattcattttttatttctgagtagtattccatagtacccatgtgccagtttatttagccattcttccattgaaggacatttgggttgtttctactttttggcttttatgaataaagctgatataaacatgcatttcaattttttatataaaataagttttcatttcactgagataaatgttcatcattaagattgccagattgcatagcagttgcatgtttaacttaggtcaattttgttgttgttttaacagatttattgagctataattcacacagcttataactcactcgtttgaagcatacaatttaatggcttttagtatatctacagaggtgtacacccatcaacataatcaatattagaatattttcattacccttaaaagaaacactatacctctaaacattaccctcccatttatccaattcctcaagccttggtataccactaacctactttctgttcctatagatgtgcctattgtaaacaattcatataaatggaatcatgcaatatgcgacttttgtgattcacttctttcacttagcataatgtttcccaggttcatccatttcgtagtgtgtatcacctagattttcaaattgttgaataggatttcactatatgactatatcatattttacttatacatttatcagtgaatggacaattggattaactataccttttgggtatcatgaataatgcttttcttaatatttgtgtataattttttgtgtggacatagtgttgtcatttctcttaagtatatacctagaagtaaaattgctggaccatatggtaactctatctttaactacttgaagaactaccagcccgtttttcaaagcaggtgcattatttcattttacattcctacctgcagtagatgagtgttccagtttctcaccatgtttgccaacacttgctattttctgtcttgatacagatatcatagtgggtgtgaagtggtaacttacagtaaaggtggttttgattggcattttcctgatggctaatgatgggaagcatctttgtatgtgcttttttggtcatttgtatagattctttggagacatatctattcagatcatttgaccattttaaaaaattgggtcgtttgtctgcttatcaccaagtagtaattaactattctttatatattctagatacaagtgccttatcagataaagcaccatatcagatttgcatttttttctcattctatggcttgtctttcactcccttgatggtgtgttttgaagagcaaaagtttttaacttttgatgaagtccagcttttttgtcatttgttgcttatgcttcttgagtcacatctaagctttattccaaatcacaaacacttgtacctatgttttcttctagtatttttattacattacctcttacatttaggtcttaactaattctgaggttttttagatggtgtgatttatggggatttcttccctttttttttcttatccagaggcttaacttggaacttcttgcactatgttgaatcaaagcggtgacagcagacatctctccctgcctctgatcttagggtttctcactattaggcctttcacttgttaaaacacctacagctttttaaaatgctatttctctagttgaggtatttttccattattttcggcttgcctggagtctaccctacccctatggatatgttttgagatttgtttaatgctttttttatgtcagtttatctgatcatatttttcttctgtagcctgttgatatggtatattacattgatcgatttttgcatgtcaaaccagcaatccctggaataaatcccacttagtcagtgtaaatatctctttatatactgttggattcagttggctaatattttgttgagacttttaatgtttaagctcaagaggaagatttgaatatagtttatttgtttttgttctgtctttggtgttgctacctgggtactggccttaaaaatgagttggaaaatgatctcttctttaattttatgaaaggggctgtgtaaaattattgttaaaagccttattcaaatgttgtgtagaattcaaaagcaaaaccatttaagcctaaagactttactgggggaaagattttaaattatgacttcaatctatttaatgattatagaataatttagattaattatcctttttgattgagtttttacagtttgtagttttctgtcgaacttctgaacataaagttgtttatagtgttccacaattacctttttaatggtttcaggatttgtattaatacagcctcttttattcctaatattggtcattcgtgtcttctaatttttttgtcatttgtgctaacagtttaattttattgattcttttagaaaaccagtttctttcatttttaattgttttcctgcttttacttttacttatttcttctcctcttctgttttatttcttctacttgatttggtttccctccccactactttttaggtaggaatttagattattgatttgagattgttctgtttctaatgtaaacatttagtgttatacatttctgtcttattactgtttagctgcatcccacatgtttaatattctatatcttcatattaattgagttttatatatttttagatttcctttatcatcttgcattattttgcagtatatggcttaatttttaaggtttcagttattttcttattgtcttgttattgatatctagcttgatgcacttattgtcagagaatttcaattctttcaaatttgttgagatttatttcacggctgtggatgtggtcattcttggtgaatgcttcttgtctatttttttaaaatatgtattctgctactaatgggtaaaatatggttggttgattgtgttcttcacatcttccatatccttgctgattttctctttatcaattatatcagatattgaaagtaagatgatggaatttttgtgtttttttgtttttgagacagggtctcgttctgttacccagactggagtacagtggtgctatctcgcctcattgcaacctgcacttcctgggttcaagcgattctcctgcctcagcctcctgagtagctgggagtataggtgcatgtcaccactcctggctaatttttgtatttttttaaatagagacaaggtttcgccatgttggccaggctgatctctaactcctgacctcaggtgatatgcctgcctcggcctcccaaagtgctgggattacaagcatgagccatggcgccagaccagatgttggaatttctaactccaattatggatttgtctatttttttttcaactcttatcagtttttgcttctttagggttctgttgtttggtgaatacacatttaagattgttatgtctttctgctaaattgatgctttcatcattacacactgttgctttctgtttctagcaattttctttgttttgaaactattttttctatcactaatgctgccaattctgccatattttattaatgttcacaagctaaatattttttattttttttactcacaacctacttgtgtctttgaatagaaataagtttcttacagtcagcaaaatctgatttatctcagtagaatttactttttcttggtcagcattgaattttgagaactttgaaagataatttgcccacaaacaatggtttaatgtatacatttacatattgtaagactgagtgaattttccaaatattttaagcatttcatatattttgtattttatttccatacataatatgtgcatatttacccaaaattttatatccttgcattgtgaatctagtcaaattaaggaaagtgatgattaaatacatacagagacttgattgaccacagacatattaaagagctaatgactgcagacttagatttaatcctcctatcaaactagttaaatttacaagatgtttaagatatattcagacccataatgacacaagtgcatatttttgtttctttagggaaaggattgtcacattgccttgcaagaggcattaaggtgaaacaccactaatactgtgaatttattcaagtctggagttcttgcatcagatacgtaatctcagatatccaattttattagcaaaataaaagtggatacactttttagaagttggaacacaataacaaaacttcagagatgaattcatagaaacaggaattgaaaagactgagaatttccagagtatcaagaattctcacgtttgcatcaccatgcatttgtatatgtcacaatggcaatttactgtcatgtatcttctatcaaaagacacatgcttatgaggacaattatgaagagaataaaacacaaagaaatgagatgactcaagtgttaaatgtcatcaggccatgaaatgagaacagcattgccagtaggatcaggatactttggctatcttgtcactgaccactgaaatcaaagcattggcttatccccctgaggaagcactgacagttcattgtcatctcttcttttgtccctacatttatgaccaaaccacttctgatcaatgcattctttgtaaatagaaatagtttccatcaggtcatactattgttgtatcacccttttctcctggaaaccattgctttttttttttaaatataaaatgacttaatagcttttttttaaaaatataaaatgacttaatagcttaacactaactaaagcaatttaactttcacaaagtaaaggtaaacttaactgtagattcaaaatgctgaaaatatatgccaaagttgttatagatgtcagtgatgcccacatttacatatctcaagctctaatctcctgcagaacgtgtgttataggatgaggattcacaacacaaactctagccagactacttgagttcattttccatctatagcaacttactaattgcataactctgggaaatttagtaaccttgtcatgactctgtcttctcatatgtaaaatggtgacaatcgtggtaccagctaactctggggctattataagattaaatatggaaatacacataaagtaacctacacagtgcttggcaccaattaagaactcaatacatgttagctatttgtagaaattgtcagcatcatcacgtgtaagatgactaaaacagaagctttgattcccatattcatacttaaagatagttttgcctcatctttggaaatggcatcagctcagtttctcaggaccatgaatttgacattgatgtatctttctatacttcactcctcctttccagcagaaagctcttcattctctctctccagatcataactaaacccatctccttctgcttaccttgatggctcccaccatcactcctacatagatttgtacattcatctcctaatgaactttcccgtttgcactttttacctttgcacttccaccacaccacaatccttcatctgaaagttagaaaaagtcatctttttagacccaaatatttgctgtcaccctcaatgctgatcactgaaaacttccactgtggcctgtgtggtcatccacaatctggccctgcctacacctccaacctcatttctcctgaatatgggttcctgtggctcttgaacacatccagctctttcctatctcagggccactgcttgctctgttttttctgcctacgggctctgaccggacgtttacctcctggctccttcttataattctggttgcagctcccctgctagcttctcaaggagctgactctttacaaccatgtctgaaataccctgcaacccttgatgctcttgtccacatcaccatgttttattgtcttcagagcagttgtaaatttcatacagtatcttacatttattatttacttccctctcactggcatgttaaaatatggattcccttgtaatgttaagtgcttaggaccgtgattggcatacagtgattcctcagtaaatgtagaagaaaaaatttaagaaatataaagccataaagtgagtaattaaatatgattgagagaattccataagatttaggttttacatcaccagcttaaaatagttattcaaatatcatgagtcaataaaataatcaatttacttattggcaggtgattttcaaatgaatgaattggattatgttgcatagttaataaaatgtgatacattgaatttactgtaattaggaaatgtctttcactaatgcctggaaaaagataacgtaaagcatcatgttttttatcttatttttgtttagctgtttgcagaataaaaacaattttaattttacataacaaatatcctgaggcaagcaaatgaacaaataaaaagatgcataaataaatagaataaataaaatcgcattttaatttcaaatccaatttagtgatactgagttgctaggcatttctttggttataacctatcaaaaacattaaattctaattacatactacccttaagaaaaatatttgactctattatattttgcttttattgcatcttatagaatactataaaattcttattaaacaacttgtttcaggaaatattatagacgttttcaggatcatttcagaacatttaaccactgatccaacagaatgttatgcattttgttataagtactctggtagtttaataaaaatataggagcttaagttcttaaatatgctgtttaaccaatatggagggtatttgccaaggagggagtacatttgatgaagtatatacatacaacataaatccactaccttcctaatttactcaaggtgtagatatcttcctaggatgttttgtctagaagactaagtctatggcacctcctttcccgtgatagtttctcagcttaaaataaaccccacatcagctgggcactgtggctcacgcctgtaatcccaccactttgggaggccgaggcaggcggatcacaaggtcaggagttcgagaccagcctggccaacatggtgaaaccccgtctctactaaaaatacaaaaattagctggccatggtggcacacgcctttaatcccagctactcaggaggctgaggcaggagaatcgcttgaacctgggaggcggaggttgcggtgagctcagattgtgccattgtactccagcctgggtaacaaaagcaaaagctccatctcaaaaaaaaaaaattaagtaaaccccacatcataatagctttttcattttcttggctcttcctcccaactttactgcggtatacttgacaaataaaaattatatacatttaagatgtactgtgtggtattttgatatatatatatataaacaattaccatagtcaagctaattaacatactcatcatctcacatagtttttaaaatttgctttatttttgtagtgagaactggagtagcaactttctggaaatactgtcaatagtaatacttaggataacaacacgatgtcaagtttaaaaataattaattaaattcctttccttttctcccccctccatttttgtgcgtttgtatatctatgctatagcaatgaaaatgtttccaggcagaaatgaacgcagacattgaagtaaaaacatgtgagctcataattccttttccatgttccatgttgtaaatctgcagtgaagaataaatagaaactattttcacttcagtgtttaaaataatacaggatttaatgggaatattctaattgcatgatcttcatttatcttcacagacaattccctctgcacgttgactttgtaccgttatatctgtcgaactagctagtcaccagtggtttctaacacctactaaatgatttattgaaaaatcctcaaatggaaataaaaaacagtaaagaaaatattgtagtcttatgtggaaaactccactggaaaaaagaaggacgatgaatttgattatagcaataaatgcacaccatgaatatcattaaccatcacttattctttcgtcagttcttttcttttctttttttttgaaagacatataaagccattctgctgtcaccaacagtcatcttacatttgtcttaaatgtgccttctcttatgaaagacatcaaaggtctatgtgattttgcatttagtattgctgctgtctctctttcatttgtttgttacttttctgtgcaagcaattccaatgaacttttacaaacttgaaaacattcttatttcctacatatgtggctttttttttaccagtttatttcaaaatccaaactaataccattactttaaaaattgaactattaatttacacaccatttaactttcaattgcattctgaacctaatttaactttagatttacctttaagccattaagaagataagattagtcgaaatacaattgtaggccatatggttgtttcaggtctctccatttctgatgtgggattttattttgaatgggcttgtttacttagctcagtgtgaaattaatcggtttctcaaactacccttctagctcttacattttgttaaaccttttttagtcttccctttgacaatctgtaagttgctttcttttgaattcttttcaaaatatagttaggtagttatgactcatgtattatttttgttaggtacaaacccacagttgaccaactttctctttttgttggagtttgaggatccacaccctgattttggttgccttggctgatgtcttcagcatgagctcttgtagatgctgcttccagattcatggattgcttagggtcacccacagatgacctggaatgatgcagtgcacacagacccctgtgtctgcagtactcgggcacacagcctgctggggcctgttgcagggtctccatcaaccgttgctgcatgaatgattgcagatatctttcatgcaaattcagatttttttcttccctaaagattcctctacgtgtatttcatcatcttttcacgtccaggcacacccaaacattccagtaacaacaaaaatcagacaaaatacctaggaaagctttcaaaataaatctgagggtctcctatgaagaaaagtacaaatctttgttgaaggacataatagatgtaaaggaacagaacgcaatcagttttggtccttgatcaatgatctacatgagaatatttccatcttctcacattgcaggtttgatgcaatcctaattacaacctctgtgggattagcgggccggactgagagaggctctgggaatgttactgtcacattcatcaggcattatcctcaggcagattacccgtgcgtggtatccttgttaattgtagcttttcttgccaccggacttgtactttcttctcttcctcagtgaggagtcaaaccacagtagtcactttcctgagtgaaaaatcatttccaaggtgtttgacacaaagagatcctgaggacatttgctgtcgtctttgtttgagtactccagactcagggagctgggcttgcgctgcgggaggtaaagctggggccacacccccacccctgccagccaggacagttcctagacccttcccctgagctaggttttccagtcgcatggagcactttctcacatattccacgctactgatttatctcgcttattttctacctcttctacacaaatggatgcccaattgtggtaggattctttttctttctttctttcttttttttctgttgattcactacagtatctgtagtgcctgaaacaatccatgatatactctgtggctgctgttgaatgttgagtagatggctttgattttgcttttgctcagctgatgttaacagtccttttcccctgctgctgctgtcttgtcagtcagctccctgtgcgtcttcctaatctattcacagttacaattacttaaaacattatttttaaattgcaggttttataaagctatcatgtctgatctcttcattgcagtacattgttcttgacaaaattgaaaacaagcaaaaaatcatatcttatttatgatttacaatttatctgttttctccagacagttgataattgtcactaccacttataaacttgtatccagtaccttcctttcaaagctagatgctagggtgacagaaaaggtttataaaggaaaatgtatataaattaagtatccaagaacagaaaaagggaaatgaagtttgggctacttataggagtgaaaataaactctgtgatgtgccagcaccagcacaggctcttgtagtttcctcccaactttgggctcagtggtatcatgttggtggccagtttaggagtatttatatcacaaaatccacaagtgctgcaaatcaaggcttttctattctagaatgctggttgataaataatagcctcaacatttaccagaacactataaaacaattcagtgatcataaagttattatccacagaatatttactggcatggaaaaatgttcacaataaaaattggtgtttaaaattgtttattgcaaaaaattgtgtaatgaaatcatcttgaaaatacttgcattactaagatataaatggttctctctgggcagtgagattgggaggaatttttttttttttttttttttttttttttttttttttttgctttctctccagcagcttgacaatacagcttcacaagaagataccttttccttttaaaacccccactgtgttctccttcctcctgacttctccccagagtacccatgttgaatccctggtgtggatcccatgcttcattcctgccctgctacttgctctgctctcagcttgctgcacaatcccccacccttcctgctgggttcactaagggctctctaggcaaagcttgcccaagctgctctcctcctgcaggtctgtgctaaggccatcggactcccctggggctggttctgcatctgcagcctgtgggtgcttctgtgagcgcaagtcaggctgtgcagcaggtggtctgttcttgtcagtttcttgtcttctgaccgtttgtggggctgtattggcagtaaaacacccacgacacagagaacattcaatgtatgtttggtaaagtagtaaagaatggatgcatgtgatactaaaaatataatcattacaatagttaataaggtattttaatgcaaatcaatctttttataatattttgagaagaagaacatgttcactggggaatattaaaaacagatcttagctcagacgtgttattcaaatattgaggaaaaaataaacattatgtgagttctttccgtctttttgaaaatcgagattaaaaaaattgttcattattgtggctcccataatttaaaaaaatagcttttcttttgttattttaacttttaaaaaacgttttggaaaatgtagtgaaaacgtatcatccactaaaaactaaaagcattttgtttattcttgtgaacagatgcaatcataaattcaatctgattttttttcctcttagaaataaaaccattaaatcagatgacataaatacccatgcacctgtgaattactggtcaggccaaatgactagtttcagcatccaaattccataaaagcaagctgaatagggcttctgtgttagagatttgaaattgaaatgaaaaatcaaagcaaaaacaaaaacaaaaagaaatgatttcaattccattctgcaaagcaaaattgagtttcctggtcaggttctctattgctgcataacacagtacccacgaaagtgagtggtttaaaacagccatcattttattttatccaatcaatgtgtgggttaagaactcaggcaaggcattctcagtcaggtttctaccccatgggttgccattcttggtcaaaatgtgtccagttagtattctcacttgcaaggtgccctgttggggacggctggaggctgagcccttctcgtctccttcttcatggagggtcggacttgccacagtcatttagctgcatggttgttattcttacctggaaagttagggctccaaaggagagtgttccaggaggcagaaagtggaaactatccgtgttctaaggcctggacccataagcaggtacaatctatttactctgcactctgttggccaaggtggtcacagagattggtcagattcaagtggagatcccaactcctaagggaagaatacaaaagaatctgtggacctcattagtccatcacatatacatgaacttatttttcctgtttttgagacagagtcttgctctgtcacccaggtcggagttcagtggcatgatcatagctcactgctgccttgaaagcctaggctcaagctattctcttgcttcaacctcctaaagtagctaagactaagtctttttaattttgttcagagatggggtcttgttatttttcccagactcacaaacttgttctaagatataacaagattaaatatatatatgcatatatatgtgtgtgtgtgtattatatacgtatacatatacatatacatatttatttatttttgagtggaattttgctttttttgcccaggctggagtgcaatggcgcaatcttggctcactgaaacctccacttcccaggttcaagagattctcctgcctcggcctcacgagtagctgggattataggctcacaccaccatgcccagctaattttgtatttttagtagagacagggtttcaccatgttggccaggctgatctcaaattcctgacctcagatgatccgcctgcctcggcctcccaaagtgctggggttacaggcatgagccaccactcccagcttaaaatatgtatattttgatagagaacatactagtactaaaaaaaaaaaaacctaagattaattatgcaacaataaaaagtttcagttgatacatttttgccatccaatagagataagcatcaggaataaaatataaaaatgttaagagctgattcatattttgttcttttccattaaagaatactattttcttgctattatattgttcctagaaatttaaattatcaaaatacagcaaaatgaaccccccagtgtgattggtaccaactcattcttgaatgcatttttgaaagtcaaatatcagaaaattaaatagcagattacaatttagtattatggctaagaccttgagcttttaattcagacagacatggatctatttgccttggacaagtaatatgtttcttggacaagtaatatatgaagtatgatggttcactgtgatagctagaggaaaaatagtaactgctatagagagttgtttattattaaatgagaatacatatgaatgacttaacatagtgctgagacatataggtatccaataagtaatattatttttatgagtgatacagagtggttctattccattttacacgttataaaattgaatatgagttattctttaggaggaagacactaaataaacattaaaaaattctaaattatggcttatacagttaatacttgcctgagctcaggcgttttaaccagaaacataataatagaaatccaagcatcttccctttcatgagttaactgcctacattagttttgtagagctgctgtaacaaagtaaatataatactttattgttaataaagttaattcagtgagaaacatcatacttttatcttgaagtacttgaagatgatgtacactcttagaagagttatgtgggaggaaatctgatcatctctaaaactaaaatagcaaagctaacattaatacaggcatacctcagggatatcatgggttcagttctagaccacagcaataaggtgaatattgtaataaagtgaatcacacaaatattttagtttcctagtgcatattccggtttaactgcagtgtactaagtgtacaataaaattatgtctaaaaacaatgtacataatttaaaattatttataactaaaaaatgctcacagtcatttgagccttcagtgagttataacatttataccagtggagggtcaggcctccatattgatggctgctgactagtcaggatggtggttcctaaaggctggggtgggtggggcaattttctaaaatgagacaacactgaagcttgctgcatcagttgattgttcctttcatgaaagattactctgtagcatgcaattctgtttgatggcactttaccatcagcagaacttttaaagttggaaacaccctctcaaaccctgtcactaattatcaaacaagttgatacaatattctaaaccacttgttgtcattttaaccatgttctattcaccaggaatagattccatcttgagaaaccacacttttttgctcatccataagaagcaactcctcatacattcaagttttatcatgagctcaataattcagcaattcatacatcttcatgctctacttctaattctagttctcttgttatttccatcacatttacacttacttcctccattgaagtctttaacccctcaaagtcatcatgaggcttggaatctacttcttccaaactcctgacattgttgaaattttgacctcctctcatgagttctgaatgttattaatgacatttggaatgatgcatttttccaggttttcaatttactttgccaaaatccagcagaagaatcactatagccttagaaattgtattttggaaattataataccagcaactcaaaattactctttgatccatgagctgagaaatggatgttgtgttaacaggtatggaaaaaacattaatctccttgtatgtctgcctcacagctcttgggtattcacgtgcattatcaatagcagtctgcttttgaaagaaattttttgaaagagattttttaattttaatttttttctgagaagcaggtcttaacagtgggcttaaaatatttagtggaccatactgtcaactgatatggtgttgtccggctttgttgttccatttctagagcacaagcatactagatttcgcatccttcttaagggccctaggattttcagaatggtaagtgaacgttagcttcaacttaaagtcattagctgaatgagcccctaacaatagagtcagttagagactactcatctctagttatgaaagtcctagatgacttcttcttccaatataaggctgttttgtctacatcaaaaatctgttgtttagtgtaaccaccttcatcacttaccttagctagatcttctagataacttgttactttttctccatcagtacttttatgttatgatgatgacttcttttcttaaacctcatgaatcagcacctgctagcttcaaattttcttctgtagcttcctcacctcactcagccttcatagaattgagagttatggccttgctgtggattaggcattggtttaagaagagttgtggctggtttgatcttctaactatctagatcactaaaactttcttcatatcagcaactgtagagttactaacttacctaatttcaatattgttgtggctttggatcagggaggtccgagtagagtgagagagatagagaaacagctagttgttggaacagtcaaaacatacacatttatcaattaagtttgaagttgtatatggtcgtgatttgtgccaccccaaaataattattatagtaacattaaagataactggtaacagatcaccacaacataataataatgaaaaagttaatattgctagaattaccaaaatactgagaggtgaccgtgctggcagcccttgctcactctcagtgcctccttggcctaggtgcccactctggccgcacttgaggagcccttcagcccactgctgcactgtgggagccactctctgggctggccaaagccagagccaactccctctgcttgcgagggagtggggaaggacaggtacctgagggaaccggggctgtgccccggccgcactcgcggcgcacgcgagttcggggtgggcatcctctccacagaccccacacttggagcggcctgccggcgccactggccccaggcagtgaggggcttagcacctaggccagcagctgcagagggtacactgggtcccccagcactgccggccgcccacactgcccccatattttcaccaggcctcagccgcctccctgaaaagtaggactcagggcctgcagcctgccatgcccgagcctctccgcctcccccctgtgggctcctgggcagccggagcctccccaatgggagctgtcccctgctctgtggtgcccagtcccatcgaccgcccaggggctgagcagtgcaggcctgcccgtgggactgactgactggcggcccctgggtgggatccactaggcaaagccagcaaggctcctgagtcgggaggagacttggagaacttttatgtctggctggaggattgtatatgcaccaatcagcactctgtgtctagctctgggttcatgtatgcaccaatcagcactctgtgtctagctaatctggtggagacttggagaacttttgtgtctaactcagggattgtaaacgcattaatcagcaccccgtcaaaacggaccaatcagctttctgtaaaatggaccaatcagcaggatgtgggtggggccagataagggaataaaagcaggctgccagagccagcagtggcaacacgttggggcctgcttcctacgctgtggagctttgttctttcagtaaatcttgctgctgctcactctttgggtccgtactgcctttatgagctgtaacactcactgggaaggtctgcagcttttctcctgaggccagcaagaccacgaaccccctgggaggaatgaacaactccagacgcgccgccttaagagctataacactcaacacgaaggtctgcaacttcattcttgaagccagcgagaccaggaacccaccagaaggaagaaactccgaacacgtcagaacatcagaaggaacaaactccggacatgccacctttaagaactgtaacactcaccacaagggtctgcagcttcattcttgaagtcagtgagaccaagaaaccaccccttccagacacaacataacagatcatacaaggtgcaaattgaccacaaatcttcaatttgtaaaaaatccaatatctgtaaagtgcaatcaagcgaagtgtagtaaaatgaggtaaacctgtggaagcttgatggatagagccttagaaattttccattaagccaaaaggttggcattgatgtgagcttgagccagcaaattccacatgctaatttagttgaggtcaagccctttttctcagtcatacatctggcaaggattgttctttaggtaacatactgaaagaaacaaaaacaaaaaaaaacctgaattcttttgtgagttggtttatgagtattaatagtatgttagtatactattaatgtttaaggttggacaatgtaggttctataaaaatgtatgaattccaatgcaatgaattggtccagaataaaattgtttctttccaagaagaaccattttgagtggactataaaatatgaccacaaaattatattaccttgattactattaaaatgaaaaactgcttaggataaatacaaatcaagagatagaagctaatatatatttaggcctaaatattccgtcgtaaaaatatgaaaattctcaggtgtctaaataggtatttcagatctttctcttggtttttatcttatatatgtaggcaccttatttttctatgtaaattatagtaattaagctttcatatactcctaaggtacaaaatgttgagttccttggaaaaaaataactttgcaataatcattataaattataccactgcattatttataatgtataccgtatttagaagtttaaatgagtggtaactcaggagatatccagaactttattttagtgtgtttttaaaaaacatttaagtagatttaagttaaaattatgactagccaaagccaatctaaatgggtaaaatacaaaacaggaagtatagttgtcagtgacacaaacttttcaatttcagtacaatggatactatttttcaaagtgcaaagaaacatcaaaattaggtgactgtcttttctgcctctggcttaacgttctatatttactcctggatgtttggtttggtggcttttgtagattgacagactgcaaatgcacaacacaacatccaactgcatattttggctacaaagtagttagatacagaaatgatgaattcgatattcaatttggcagttttgtgtagaattattcttacattttttctttattccttccaaatctggttggcagatattttgactatcatgaagggcaggataactaaagaaacattttctggcacatatctggcatgtagatcattttaccccttcataattttctagtattattatacaggatattactaagagctaaatactttatcttcttcagagcaataattttttctgtttttctctttgaggataacactgaattcaaatcagtttagttttctgacacataatcactcatattatggttattaagcattatttaatagaacattctgagatatatatagtcaatatttgtctaatttgtgcattttaaaagctttaagctataatttgtgtaagataaaattcacccattgcaacagataagttgtaattttttagcaatttatactattgtccaaccatcatcaaccatcattagaactaaattttagatcacttccatcatcctaaagtgcttgcttgtacccctttggagacaattactgcttccaacaccagttattttggtgtgtgtccaagaatctttgcctaaatgaatatcataaagactttcttgtgtgtgtaagcacatgtatgcatgtgtgtctgtgtgtgtatgcatatgttttaaagttttatagttccaactcttacctttaggtctttgattaaattgagttggtatttttatggtgtgaaataatggcctaaatgtgtgatgtgtgtatttatgtatgtgtgtgtgtgcatttgtaattacatctatatgtacatatatggatatagatatagtatccaattaagggactttcccaatttaattgtcatgtcatgtttgttgaaaatcacctaaaaataaatgtgaaaccttactgctgaactaccagttcagttccattggtttatatgttgtctttagagaatacaacactatcttgatttctgtaagataataagtttcaacactgtataaggtacatcttccaccttttcttttcatttcaaaattattttggcaattctagttcctttgcatttacactttatgttcagtttgtcaatttctatgataaatgacagttaggcttttatagagattccattgaatctatatatacatttgcagagaattgccttcttcccggcattccatgaccatggaatatttctgtatttcttttgatcttctgtactccttcttagcaatgtttggtacatttcagtatataagtttgcatccattttgttaattttattcttagatacattataattttgtttgctgttgtgaatgagatttttttctttttttacatttatttttattttactttaagttctgggatacacctgctgagcatgcaggtttattacataggtaaacatgtgccatggtggtttgctgcacttatcaatctgtcatcttggttttaagccctgcgtgcattaggtatttgtcctaatgctctcctttctctagccccccaaccctcgacaggccccagcgtgtgatattcccttccctgtgtccatgtgttctcattgctcaactcccacttgggagtgagaaaatgcagtttttggttttctgttcctgtgttagtttgctaaggatgatggtttccagcttcttccatgtccctgcaaaggacatgaactcattttttatggctgcatagtattccatggtgtatatgtgccacatttctttatcccatctatcattgatgagcatttgggttggttccaagtctttgctattgtaaatagtgctgcaataaacatacatgtgcatgtgtctttatagtagattgatttataatcctttgggtatacacccagtaatgggattggtgggtctaatagtatttctggttttagaaccttgaggaatcgccacactatgttccacaatggttgaactaatttacactcccaccaacaatgtaaaagcattcctgttcctgcacagcctcaccagcatctgttgtttccagactttttaacgatcgccattctaactggtgtgagacagtatctcattgcggtcttgatttgcatttctctaatgaccagtgataatcagctttttttcaaatgtttgttggccacataaatatcttcttttgggaaatgtctgttcatatcctttgcccactttttgatggggttgtttgtttttttttttcttgtaaatttgtttaagttccttgtagattctggatattagacctttgtcagatgggtagattgcaaacattttctctccttctgtaggttgcctgttcactctgatgctagtttcttttgctgagcagaagctctttagtttaattagatcccatttgtcaattttggcttttgttccaattgcttttgagattttagtcctgaagtctttgctcatgcctatgtcctaagtggtattgcctaggttttcttctacagtttttatggttttaggttttgcatttcagtctttaatcaatcttgggttaatttttgtataagtataagaaaggggtccagtttctgttttctccatatggctagccagttttcccagcatgatttattaaatagggaatccttttcccattgcttgttgaagatcagatggttgtagatgtgtggtgttatttctgaggcttctgttctattccattggtctatatatctgttttggtattagtactatgctgttttggttactgtagccttgtagtatagtttgaagtcaggtagtgtgatacctccaactttgttctttttgcttaggattgtcttggccacatgggcttgtttttctaatttcattttctaatggcctttgctgtaatataaaaacacaatgtatatttatggtgatctttaacttgtgactttacaaaacttgtttatgaattataaaagttttattgtggttccatactattttctatgtttttatgatatacagacacatttatcattatgagatgtccttctcatcgctgtactatttcttgtcttaaaatctattttgtctgttattgataaaactaggcaaattctctgatggatacagttttagagtataccatatgctatccttttaatttcaatctttttatgtccttgagtataagatgtgttttttgttgatgatataaaattgtatcttacatttttatcaagactgatgatatatgccccattaatagaaggtttagcacattcacatttaaacttgttattattatgtgttgtctgtcatttgctactttttaaacagttgtgtcttttcagttcctgtttctcctttactggctccttttgtaccaaataagtattttcagtgtgccattttaatttctgtttatttttgctgtattattttgagttattttattagtgttggtttatgttaggggttggcaaacatttttgtaaagatagcaaatattttaaactttttgggttacatgatctttgctgcaactgatcaatttgttattgtagtatgaaagctgacacagccaatatgcaaatgaggaactaagtctgtttttcaataaaaatgtacctgcaatcagttagcagcccagttttatctatgagtgatagcttatccactcaagttctgggcattacattgggtatattaacttgttcaatttacttcagaattataattgcttattctaataaaatatatcaattttgctccaacttattttcttttcttcctacctcttttgtgctaatattgtcatatatatctatatgttataaactccaattacagtgtcatgattatctatgtataatatctatatttaataagttaataaaagatagagaaaacatttatagaatctttcatgtatgcccacatatttaccatttgtgacacttttaattttttctgtcaacttgaattcagggctgctagcaacagtttttttccaaaaatatttatattttgccttcatttttaagttttgctggttataaaattctttgttgacaaatattttctgccataatttttttgtctgttatttctaataagtcaagcaataatcatgttgtatatgattggtcatttatctctagcctttaccaagtttactcactttttggctttcagtagttagactactatgtgtagatgtgttatctctttgtctttattccgtttggcatttatcaggtctcttaaatctataggttaaaattttccataaaattgagacattttcaattattattttttcctgtactatttttctgtccctttcactttctcctcttcttcctgtggtgtcatttcatgtatgttgctatgcatcatatatggtgtcttcccacaggtgtctgaaggcctgttcacttcgttttttttgtttttgtttttgtttttgtttggtattttttagatggagtctctctctgtcacccaggctggagtgcagtggtgctatcttggctcactgcaacctctgcctcccgagttcaagtgattcttctgcctcagccttctgaatagctgggactacaggctcatgccaccacatccgactaattttgtatttttagtagagaggaggtttcaccatgttggccaggatggtctcaatctcttgacctcgagatccactcacctcagcctgccaaagtgctaggattacaggcgtgagccattgcacccagcctattcactttgatttaatcttctttctccctgtgcattagactggaaaattaattttgttatatcatcaagttcattgattctttcttctcctatctcaaatcttatgctaaactcctctaaataattcatttttgttattgtccattttaactccagaatttaaatttgatttattttttcttaataatgcctatgaatattgagttcctctatgtggtgagaaattttcattgtactttccattaattatttagctatgattttctttagttatttgaatatatttataatagctgccttgaagtctttgctgaattccacatttgttgacagagacaaaaatctatagactttaaaaatttttgctaaatattggttacactcttgtttctttttacttttatgcacaataatgagcattttgataatgtatgttgtaattctagattctgacttttccacagtatgtttttgttgtcttgtttggttgtttatataacttgcctggacaaagtttgtgaagtctttcttcctgaaatatgtgcctgtttatttatctgctcctattttttcttcttgtttttatttttaagtctggcttcctacgtaactggtcatcttaagagtgggttcatcttaagagcggtaaaagaatgtgctcaaagactttgagccagtaaacttcctattccctgatgatgaatttatgaatgtcctggagaaagtttttaaatctcaggccattttaaagcttccctggcttttacctccaataggccctttcatgcctcctccacacatgcatttaggcttcttttgccaagaatgtttggatgccttagcacccctctactctctgctggacacacacagtgactcccatcaatcagggatatgtggctagcttaagtcttcctttgactatctgacttctacagctccctattacatcccgtgctactcctacagttcattgtttgccccaactacgacctcaatctcaggctaatggagccactgacctcttttttcaattgccactgagatttccagtttaatgtataatactcccaatgaagtgagtcctttctgacaataggtgtaaagctgctggttttcatatccttccaatttgggttaaactactatgccaacagaactgagggagtcctgggactagtgtggatgaagcaatcacagactgttaggcaagatttttaactattcttagctgaaattcagtagtctcaataaattaatgtttcttagttggttttatgacttttgttaaatcccagagctctaaaactgctgatttgaccgtttgttcaattttgcagttgatttttgaggggaagatttgtcaagctcctcaagccaagagtcagaacaacatttttatataaatgcttatataaaaagctaaagagacttagataattctttacaaatacattgctcaataattgaagtcaattttgcacccataaattatcttgtgatggatacatttaatcaaatgcagaaaatataagcaaagccttttaattaaagaaagggcttctagtaaaacagaaagcaactggaaatctgtgaacttcattatttacatgcacattcagtttttaagcttgtgaattttatataaagcaaaatattttttcactaacagaattctgttaatcagaaatagtgtatgatacatataagctataagataatgcaagcaactacttcaagcattcatttttttggaatgttaatatcccttgtggtggtgtgctaacacagatatgtatctgtgttgtgatatagtcctgtttcctgagaaaatattaactgctaaagtggtgggattatgtttgcttatacttttcatttgttcatttcatcatgccttctgactatccagtcagtaattttgcaacatttgagtattattcaaaattatgaatcttcagttatacaaataatatcaaatggttttcttattctgcaatttctaggaaaaccagaaaagccttaatttgttgatgtaactttaatttagaacctctttcaattctgagttcttcattcttttagcattaaacacacaaattattttattgctatagccattctaaatgtaatagatactccaaaagccatctctaaaagacacctctcacactaagtggttcatgtcgggggaaatgttgtgctaaatagtgtatgctagaaaatatttaagtaaactgtaaaactggccaggcgcagtggctcacgcctgtaatcccagctccttgggaagccgaggcaggaagatcacgaggtcaagagatcaaggccttcctggccaacatggtgaaaccccatctctaaaaaaaaacacaaagattagcctggcatggtagtgggcacctgtagtcccagctactggggaagctgaggcagagaattgcttgaatcctgaaggcggaggttgcagtgagcctaggtcacaccactgcactccagcctggtgacagagtgagactccatctcaaaaaaaataaaataaaaaaaagtagactgtaaaactaattttttgactaaaatttagatgaccaaaatctatatgacctcagataagtcatttgcaggtccttggtttatttcatgacttagatgagagtaaactattgtgctataacatctaaaatcacaaactgtaaacatctctctcattgcaatatgttacatgtgctatggcttaaatgtctctgaaaaaactcatgttgaaatttaattgccattgtaacaccataaagaggtggggtctttaagatgtgattaggtcacaagggctctgcccacatgaatggattaatgctgttattgtgggagtgtgttagttattgcaggagttcagcctcttttttctatctctagggcttgcttgcccttctgacattttatgacacagcaagaaggccttcaccagatgtggccacttgatcttgggctttccagacttcagaacttctgtttttcataaattatccagtctatggtattctgttatagcagcagacaagaaacaaaaacaacatgtttgtaactacaattaatgatgaacatgtttgtagtttaagtgcactcttaagttagatgatgcaagagcaggaagctggtatgctttgtcttctccaggtaatcctatctgtccatgttagaaagtaattatggaagaatttagataaagcctcttttatttacttttattttaaattctaggatattaagaatatagagaaaatgtgtgcaagtcagaacaaacaatttagagcaccaagtctttatagaaaaattcatcagtaactgacaactccatagcagcatctacactctcctttttaaatgtcacaattcacaaaactgacttccttctttcttctcttccttctatactatatagttagtaccagaatgcctttataggcatgggtaggcagtcctggataatgcaaacaaaatatttttctcatgtactttacattcttctgagcaagtcaagagcttaaggatttgaagatcaaagataaggctctatgcacagtgtaaccagcatcctcatagtatcatcaagccctcaggttctttctgtctctactcctctagtgttaatttcattcttaggctggtctcctcattgtcacatttagtagacaatctgtgctgcagtctgcactgcatgcctgttcatattcagcaggatataaagtaatcctgacctggagcctagaatgtaaatcattatttttcatctgattagctcattaattcatccaccaaaccctggaacagtaaacatctttgggaactccacatgctctcacaatttctctcatccatggctgtactttagggtttggaaaactcttataacacacactgatgcccaagccttgtgttggaccactgaaatcggaatctctgacactggggccttgtcaatggtatcttttataggttccacattttctgccggcctgaggactgctggcgtagcacaatgaggatttacttttttgtcttatgatgagttcatacccagattaaactggaattctctgagagaaagaaaaaaaaaaggatcgatttggggtagcaaccaactatgtccatacaagctttcatgattttcttgagggttaaaacaaatgtggaacactgtgcagcagaagaaaaattcagagagacaattgggccacataggggactacagagagctgcatctgatgtttgagttatatcttaaggaattaacaggaattccctacatgactgttaggcatcatcacaattttagtgttgttttttctctctgatggaagtgtggagacaaccatgggtacagaggaagaagttggaggcagggagaccatttggaagctataattgagtaaacttcattaggaaggattatggactgaattaatttagaaaaatggaatctaggcacaaggccacagaagggatatgtagaaaaagggtcaatatgatgtaataatcaattagtgttgccctgcatgatgagggagataattttttaggctgatggccagttttctgcttgaaaggtcagatgaatgtctgtatcatttatagagataggaaataccaggggaaggacaggcttgggagataatgtcatgggttatgtttgaagggcctgaggcatgggaggctgtgcctaagatacaagagaatggcaattttgggaatcaactgaatgttcataactagagacatggatttctgtgttgtttgcaagaggtggttgaaaatatggtcttagtgaccatcagtggaaggaaacaaaccaaaaactcaccttattttaaaaagattataagcctattatatattgtgtaaagtactgaagggttagaatatctgcttaaaaagcaccaatagcaaacttgtaggcagctgcagcagtgaaataaaggttttttaaacattggaaacggacattgttttcagaacattctttttgaagatcagcatgtattgtggtattcacacttctaaggcaaggtcattgttcttttatttgtttcacacagaagtcagcttcaaggtcttgtcaggattaagagtaccttcagcttgaggtattacaccattatgttccagatagtttttgtgaaataagtgagagattatcatgtctattttttaacagccctctgtgattgatcttttctgaataagacatggtttagaaagactcaagaatctctggtttgttttcagcttcttcttttagagatataataaggtctctcagttgtaatgtcgtcgggatttgaacttcccctgaaagggtcaagtttgtcttcgattgtaacaagactagtgctcaattacccctcggctttggtatctcaaatagagagcttccacagttccagagcagctgaaactcttagtcatgtggtttactattttatgatgccatgtataaatatttgtttcaataatgtcaagcctctttacacagtgtcaaaatcatgctaaaatgttccaccttttcttgcatacctcttcctacatttctcttttgtttctaaaatattttaggtgctttcatgggaaaaatatccttacatagccaaaccatataatagtctataaatatattctacttagttctgtgtgtatgcttaatcaaagcataaacttaataactttccttatttcaaagtatatgaggataatagtgttattaacctttaaatgtaaacaattagacagacaactatgggcagtcctgttatacttttaaaagtatttagaatttattttatttattttttatttatttattttttattatactttaagttttagggtacatgtgcacattgtgcaggttagttacatatgtatacatgtgccatgctggtgcgctgcacccactaactcgtcatctagcattaggtatatctcccaatgttatccctcccccctccccccaccccaccacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacacgaactcatcattttttatggctgcatagtattccatggcgtatatgtgccacattttcttaatccagtgtatcattgttggacatttgggttggttccaagtctttgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgcacaaaaatcacaagcattcttatacaccaacaacagagaaacagagagccaaatcatgagtgaactcccattcacaattgcttcaaagagaataaaatacctaggaatccaacttacaagggatgtgaaggacctcttcaaggagaactacaaaccactgctcaaggaaataacagaggatacaaacaaatggaagaacattccatgctcatgggtaggaagaatcaatatcgtgaaaatggccatactgcccaaggtaatttacagattcaatgctatccccatcaggctaccaatgactttcttcacagaattggaaaaaactactttaaagttcatatggaaccaaaaaagagcccgcatggccaagtcaatcctaagccaaaagaacaaagctggaggcatcacactacctgacttcaaactatactacaaggctacagtaaccaaaacagcatggtactggtaccaaaacagagatgtagatcaatggaacagaacagagccctcagaaataacgccgcatatctacaactatctgatctttgacaaacctgacaaaaacaagcaatggggaaaggattccctatttaataaatggggctgggaaaactggctagccatatgtagaaagctgaaactggatcccttccttacaccttatacaagaattaattcaagatggattaaagatttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcatagcaaaagaaactaccatcagagtgaacaggcaacctacaaaatgggagaaaatttttgcaacctactcacctgacaaagggctaatatccagaatctacaatgaactcaaacaaatttacaagaaaaaaacaaacaaccccatcaaaaagtgggcgaaagacatgaacagacacttctcaaaagaagacatttatgcagccaaaaaacacatgaaaagatgctcatcatcactggccatcagagaaatacaaatcaaaaccacaatgagataccatctcacaccagttagaatggcaatcattaaaaagtcaggaaacaacaggtgctggagaggatgtggagaaataggaacacttttacactgtcggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgaatgtttattgcggcattattcacaatataatttattttagaagagaaaatttctataggatcactcccagggctagggccgtaagagtgtcgtcttcaagtaacacatagaaattaaacacagcatttcagagccaaataaattaagtaaacatcaattaattgtataccagtcctctgctttttcttcttaaatattataaaatctttgagcaaagtttcaaatttcattagttttctatattactcaggctgtttcacttgcaagtgacaaaatccagttgtaaattggcttaaataaaaggggaattggttggctcacgacttgtaaccgaagaggtaaggatagagctgggtctatgcccatcttaagtgggggactcagaagacatccctggatgcagtttctctcactttgtttctcttctctttctctggattggttttcatgcaagacaggctttcccttcatggtggtaagatagcttcagtcctgtgttctcacaaaatcaaagagcagcagatttagaaagattcatctgcagaaggttctctagaagtcttgatactcattctggaatcaccagctcaggtcaaggtctatataactctttaagttattagcttggccgggtgaagacaatgagctaattgggtcctgtacactaactttggaacccagtgctccccttctctcagattatactgaatgggaatcaaaaacgagtgtgtgatccaaaaatatcaagggctgctgacaaaagcagggaagatgggtacttgggcagacaatacaatcaggaagagccattatatctctgcacatgttgtactagttagaacctgagacacaaagaaacagacagcatatgaataaaatgcattgaaggtaggaaaagaaatagaagaatgaaaagatagcttttctgaaattaaggccacaatggggcccttgttaaaattatgcttttggaaaatttatatagaaaggactagtttactacttttaaaaatgctggaagatggtaaagagatgaggagtgctcacaagaatcttaatggaccaaaaatatgttttcaagatgaattcttactttcccatgaataggaataaacatagtggcatagataattaaaatatttggtaataaaaatatattttttcttaatttggagcaagagaaaatgagattatctatttttcttttttcttatttatatttaaggtgtaaagcatgatgttttgatatacttacacgtggtaaaatgattactacagtcaaggaaatttacataacggtctcgaatttctcttcctttttttttctttttaatgtttgtgcgtgtggtaagagcacctgaaatctactcttttagcaaacttccagtatataatacagtattactaatcatagtcaccattctgtacattaagtctctagattattcaccctacataacttcattgagaaacatcttctcatgatctgcaactcccaatccctggttatcatcattccactactctgtttttatgtcattaacttttttagttccatgcataagtgagatcatgcagcattgtctttctgtgcctggtttatttcagtaaataatgtcctccaggttcatctgtgttgtctaaaatggtaagattttcttatttttaaaatttgaataatatttcactgtgtgtgtgtgtatgtatcatgattctatatttcataagtatatttcacctaaggtgttgtttatgtttttcttgagaataacctgcctgatgatatccctgaagaatggtcaatgagaagttttgtgtaatccataagcaggataataaacagataaaaaactttttaaatttaatttttttttctcctatttgatggtctgtagaagtcccacataattttaattaaaatgtcagatttaatctgagtaaactacagtatgttaggacttctgctgagtgagatagcaatgacaaaatataaaatctgtcacctgggaacgcccagtctaaaaaaaacaaaaaccaaaaactcaaaccaataaaacccttcttttcccacttcgtattctaaggaaaatataatgcctttatttattgtatgccactgaatgagattataattaataattgacttgcatcaggtttgctgttttgtgtcctttagttttctgatggcagaagcctggcccatctggttaagctccccgttcctggaaggaggacatagcagggacttcatacgtggggatgaatcaatgtcaaatgaggaaaaatacaaagaccttaattagatggtcattgctatcagtggacatgttgtgaaaaacctaaatacatcagatttgggaggtttttgagagccactgaggcagctatcaaaatgctcttccagtctcttcctttaggaaggccgtgtttccgtactctgaagtctacagatgtgtttgctcaaaaaccacatttcccatgggccacacccaacctgactgaccggcaggaatgataacaggcagatccatttctggaaaacttgggtgggatttggcgcacacctgattttggcttcaggactccctgatatccttgctgaactttcttcagcttaaatagctacttaggacacttccaccccattttccctctcttcttcactcagagtcagccttgcatcatggattttctagacttcttaggcttcttcttcattttctttcacaggtatttccctaatataattcttgcacattgaatcacatcttagcatttgcttctcaggagactatgactatcacaaccatgttacactgacaaacagttttaatattattcgacagtctctgtggagtacaatgttgctgtgctagattctagtaatgcaaagataagaaagacaacactcccaataaaacatactgtattgggagagagtgtaattcaatacagtaaaagtattataatttacattctatggatttatcccaaaaggaaagcactgtggctggtggtaagacaccagtggatctcgttgaaggagaattctcaagagcaaataatattaacacccatctgtgtagagctagccatgagaagcattgattctagttgtggagcacatatacccaatgatgagattcatatgtgggtggacagtcattgttaatgattccacctaaggaagggtttgccaaaccctaccatactctaaagtaattctcaaacattaatatacatatccaaatgacctggaggtctcattaaaactcagtaagtttaatataaggcctgggaccatatattttctttcaattacaatcttactgagatataattgatatactgtaacaatcatccattaaagtgtacaattcagtggtttttagcatgttcacaatcacatagacatcatcattacctaatattataatatatttatcacacagaccacattttttatatcaaggtgcaaaagggctggcatactcaccagtaattagcaccaaataacactagccactcctgagtggtttctgtgaagccaagtgaaatagcaaccaaaattccatgtggatttcattttagggctggactagaacttcattcctgcctgaagttctttcctacagagtccctggagaaaacatcaggcacaaagatgttatgccatgaaagaatatggtcccttgtaagacctacgagatgctaagtattataaaatttagttataaagtataggggcagttggctaaggtaaagaagtagactgttaaaaaattgtgaaaagtccacatccatggaggagtttgggattttatctgaaggtagtgaaaagccatcaagcaagattaaaccataaagagacatgggataggaagatgaatacagtgttgtgaggtttcagaagaaagatgtgaaagaaatagcagattcaaataaaactgaagattctagtgtggttaacttgagaagataatgaggacattacttgagatagacagaacaaagaaaaaggaaaagccatctgtctatgtgtttggttttcatttatgtatatattttaggatgcagttggagtatgaggcagtatgcggcttgaagatactgatgtctgagtcttgtggaggtgtttgctgaaattatatgtgtgtttgggagtgtgcagggagggtaggaagaagtagataagtagcactgaggacacatcaacacttcaagagtgaacagaggtagaaaagtgtgtaaagaaatgagagattattgtgctaagggaaagaagatggaactgaactgtcaaaccaattcagggaaaaaagttaacaggaaggcttacttatttacaaataagcaaatttactgtttataaatttagtaatgtatgcaaagggcttctgtgcagcaaaagaaactatcaagagaggaaacacacagtcttcaaaatggaggaaaatacttgcaagttatatgtctgacaaaggtctaatatccaaaatctataaggaacctaaagaaatcaacaagcaaaaaacaaacaaccctattaaaaaatgagcaatggatatgaacagatacttctcaaaagaagacatacatgtggccaataagcatatgaaaaaaaatgctccacatcactaatcatagagaaatgcaaatcaaatcaacagtgagatgccttcacaccaaatcagaatggctatgaaagagtcaaaaaaataacagatacatgttgcagagacaagggaacacttataatgttggtaggagtagtggaaagcagtttggagatttctcaaaggatttaaaacagaactgctattggacccagcaatctcattactgggtatatacgcagaggaatataaatctttctaccaaaaaggacacatgcactcctatgttcattgcagcactattcatgatagcaaagacatggaatcagcctatctgcccatcaatggtaaactggataaagaaaatgtggcacatatacaccatagactattacatagccatagaaaagaagaaaatcttgtcctttgcaacatggttgcagctggaggacattatcctaagcaagctaatgcagaaacagaaaaccaaataccgcatattctcacttacaaatgacagttaaacgttgaatacacatagacaaaaagacgggagcaataaacgtcagggtctacttcagggtggaaagtgggaggacagtgagggttgaaaaactgcttgttgggtactatgctcactacctgggtgatgtgatcatttgcacaccaaaccccagcaatgcataatttacccacataacaaacctgcacacatacccccaaacctacaataaaagttgagaaagaagaaaaaagaaatctagtagtttaaggactgaaacctttctgtggatgtgatctctgcaagcatttagatatgtgaatgacagaaacagtctcagcgttgctcaaaatgaagaaagtcattctggacagtactgaggtcaggtggcctattgaggaaaaggtaaaagtctgccagttatacagtggattttatatacaatagatttttatacaagcacatttcataatgaaatccacataagatatgatcctgtttttttttctgtgtgcaaaaccagaaggcagaaagttgtagctatgcaggttactactgtgtacaattgtgacatgcccttaatattcagaaaagaatgtacagaaatgttgtactagaatatgtttgtttgctttgtttatttcttttaaagtgcctttaaatacaggtaaaaaaatgtggaaaaaaactgaagaaagatgtggattttgtttgtttttttagaatctctcctttgtggtcagtttttctttactggtgctttttttcaaattctccaaagtgagcacaagcctatttctaacatttttgttgataaacaaaatacctaaaatatgaaattattttgaaatgtgaaaattatcagaacattttaaattattatcttaattattattacctgaatctaaaaaaaaaattccatgaatgacaaacatttttaaggtcaatagagccccaatctagtaaatgctaaaacctggaaattgcactgtaatatattttaccattttaaatctttataatgatgtgcaatttggttttgtttcctctccaaggtcagatggctaaaaactggcaaatcccaagactaggattcaatttccatcaatgtcaatatccattccacacaaccacccttcttgacagtattgaatttgaggattaggtgaaaggggatagataaacaataacgtaatacaattgtggaagagttcagcactttttaaattacaatagttcaaatttgtttcattgatttttttggctaaggtgtaactctggaaatcttggagcttctgcaaaacataaagaaacttattggatagaagtggcgagtataattgtgaaggaggcgatggggaatttgtcagtgtaaacgatgacatccaaatgaatctacccttgaagtaaataaaggctttccttgagttcacaatacaattattgtaatcttgctgaaaactgaattgtggagtaatatgttttcaagtgaaggggcagtttatatatttctctgttcataatattacctactgtcaatgggaatcataaaatgtgcaccaaaaggtggcaagatataacatatttctgaactaaaataggagatacatattgcaaagtagggactttttccagaaagaatagcttcatgtaagtttgtctttgtttttagaacagctcacaaaaatttggtaagattatccacaaaagttatgaatgagctatcttaatgtttttatgccaaagtagtcattcaggatataagtgaattaatacattctgcaagtatttggatctgagtatgaaaaaaatagtagtagtgttactcaaaaagtagcataatcactgcaggaaaatacaaaacactgaattcttactaaaactttttattattattattattattttttgagatggagtctaaatctgtggcccaggctggggtgcagtggcgtgatctctgcttactgtaagctccacctcctgggttcacaccattctcctgcctcagcctcccaagtagctgggactacaggtgcccaccaccacacccggctaatttttttgtgtttttagtagagacgcagtttcgtcgtgttggccaggatggtctcaatctcctgacctcgtgatccgcttgccttggcctcccaaagactaaaactttttaaaattgctgacataatattcaattaataattatgtgtagatgcttagttgtgaatttgatatagtccatgttgaagaatttgtttttgctaggaactaatagttttaaacaaatgtagctttaaaaaaaattaaaatgaaattatttctttcttgtagtttttagagtagtgtcaaccacactcacaatcacaaaattccttatatgtcagagaaatattcttttctaacttagtcaattttgaaactaaggagagaggccgggcgcagtggcgggcgcctgtagtcccagctactcgggaggctgaggcaggagaatggtgtgaacccggaaggcggagcttgcagtgagcggagatcgcgccacagcactccagcctgggcgacaaaatgagactccgtctcaaaaaaaaaaacaaaaaacgaaactaaggagagttacaagtatagtgtatactttatgtactttaagattatgaagaaaatacagttttgttgactctgattgagagtgaaaaaacttaagagaacttcatcatgaaattcacccatcatgagtcttggcagtaccagatacaaaagaactttttatgtaagagaggtgttgcttgttaagtatgctgtatttcattcaaatttgtttatgcaacagcttttgtttcaatggttatacttggcatgcttagtttacatatgtctttttaaaatattaatatgtctaaagttgtaaatatttagttttggtgtgtgaaaagcaattgaattttttctacttcctacttctccaaaatcttataattgtcattattatttttcttacagggagtagaaatttcagattaattaaaacatagctcaactccaggaaaaacagagacataaaaatatttatcttcattctctcctgacattgtttttaattattttcatggtttcaaatctttccaggatattgctactgatttcatcttgctggtcaagaaaagaccatatgccaactaatttatcccaatttcatgaataaaatattcttccagtcagtatttcatttcaagatagggtaatatacagtgggccctttgtatcgctaggttactcatttgtagattgaaaatattgaaaaactaaattgcatctatactgaagatatactgactttttccttgtcattattccctaaataataccatctaacaactatttacataggattttcattgcatttggtatacgtaatctagagataagtatgcaggaggatgtgcataggttaaacacaaatagtaggccattttagatcaatggcttgaacatccgtggattttgttttctgtggagatcctggagccagttccccatggatattgagggatcactgtaatgattcttaatatagtggagaaagcatgggtttagaatttagacaagctcatttcataatgagatccatataagatgtgatcttgaacaagttatgtgtttgaatatcagtccttatttataagccatataattttgcaagtgatttaacatgaatatatacagtcatttattccttaggcaggcaatgttctaggttttgaagattttgtggaacataagtgcactttcattggagttcataacctagcaaagaagacaggtactcattacagctttacacaaaatagtgaacaaatcacactattgttcttctgtaggaggtaaacaatgttacatgtacacatagaacaacgggccacaatccatctagaggttacagaaggcattttgaaatttttgaggttttatactgaaatttaaaactatttaaaagcacctcacaaaaaataagtgagtcaaccattagggatatgtgtctaatggtaaaatttcagactctgtgttacttgaactggagagctatttgggaacaggtagaattccactctgagtccactgatgatgatattctctacataacaagtagattttctgctgctggtctttgagaatttagatagtattttaattgtttttaaacagaacccagatattctttatattttacatagtgtctgtggctaaaatgcatacagccacacatggatacacaaacaagacagaaaccaaatttgtgattattcaagaacattgattagaaaggaggatcttcaaaattgacatattcccattatcttagcaattttcaatagtgctgcagtaaacgtggggatgcaagtgtctctttgataaaatttcctttcttttggatagatatccagaggtaggattcctgtgccaaatggtagatctatatgcagcttcttgaggaaacttcatgctgctctccacagtaactgtactagtttgaattcccttcaacagtgtatgagttcccattctccacattctcactagcatttgctatcttttatctttgtgataataggcattctaatcgggatgagatgatatcctgtggttttgattgcatttccctgatgaatagtgatgttgaacattttctcataaatctgttggttatttgtagcttttttgagaaatggctaatcagagcatttgcacatttttaattgaattatttgcagtttttttgctattgtattgagttccttgtatattttggatattaattccttgttggatgaaagatttgcaaatattttctcccattttgtaggtggtcttttcactgtgttgttgattccttggctttttttagtttgacagaatcccatttgtctgtttttgcttttggtgcctaagtgttcatcaatagatgacggacaatgcaaatgtggtgtacatacacattggaatactattcagccacagaaaaaaatgaaatcctgtcattcgagacaacatggatgagctgggaagacattaaagtaagtgaaataagccaggaaaagaaaagttaataccacatgttctcactcatatgcagaagctaaaaaaagttgatttcatagaagtagagtaaaatagagtagaatagtggttactagaggttgtgaaggacagagggagggaaggaaaaggacagttttattaaaggatgcaaaattacaactaaatagaaagaacaagttctagtgttctatattactataggatgactatagttaacaataatttattatatactttcaaactgctaaaggagagggttttgaatattcgcaacacaaagaaactgtaagtgaggtgatggacatgctgattaccctgatttgatcactatgcactgtatgtatcaaaacatcactatgtatctgataaatttgtacagtttattacctgtcaattaaaaaaggacatattccttcaaatatattaacacaatattataattgaatatttacttgacaaacttttgaggtaaggctaagttactttctttgaagagaagcttgttaattagagttttatctagatttttcttcataaacagtacttggtatgcattttctatgtcatatttccattttcaggtttttaaaagtacaataatacttaacattcctttttttaaaaaattattttaggttcagggatccatgtgcaggtttgttttataggtaaattgtatgtcattggggtttggtgtatagattatttcatcacccaagtgagacgcatagtacccaatagtcagttttttcatcctcaccctcctcccactgtccaccttcaaatattccctggtgtctgttattttctttgtgtccacgtgtattcaatgtttatctccaacttataaacaagaacatatggtatttggttttctgttcctacgttactttgcttaggataatggcctccagttccatctatgttgctgtgaaaaacatgatctcactcttttttatggctgcatagtattccatggtatatatgtaccacattttccttacgcaatccatcattggtgggcatctaggtttatgctatgtctttgctaatgataatagggctgcaatgaacatacacatgcgtctgtttttatggtagaaaattaatattcctttgagtatatagtcagtaataggattgttgggtgaaatggtagtcctgttttaagttatttgagaaatctccaaactactttccacagaggctgaactaatttgcattcccaccagcagtgtataagcattcccttttcttcacaacttcttcagcatcgttattctttgagtttttaataataaccatctggctgatgtgagagaatatctcatggtggttttgatatgcatttcctaatgattagtgatggggagtatattttcttattttattttattttattattattatactttaagttttagggtacatgtgcacaatgtgcaggttagttacatatgtatacatgtgccatgctggtgtgctgcacacattaactcgtcatttagcattaggtatatctcctaatgctatccctcccccctcctcccaccccacaacagtccccagagtgtaatgttccccttcctgtgtccatgtgttctcattgttcaattcccacctatgagtgagaacatgcggtgtttggttttttgtccttgcgatagtttactgagaatgaagatttccaatttcatccatgtccctacaaaggacacgaactcatcattttttatggctgcatagtattccatggtgtatatgtgccacattttcttaatccagtctatcattgttggatatttgggttggttccaagtctttgctattgtgaatagtgccgcaataaacatacgtgtgcatgtgtctttatagcagcatgatttataatcctttgggtatataaccagtaatggaatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatgatgagcattttttcatgtgttttttggctgcacaaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggtttttttctagggtttttatggttttaggtctaacgtttaaatctttaatccatcttgaattaatttttgtataaggtgtaaggaagggatccagtttcagctttctacatatggctagccagttttcccagccccatttattaaatagggaatcctttccccattgcttgtttttgtcaggtttgtcaaagatcagatagttgtagatatgcggcgttatttctgagggctctgttctgttccattgatctatatctttgttttggtaccagtaccatgctgttttggttactgtagccttgtagtatagtttgaagtcaggtagtgtgatgcctccagctttgttcttttggcttaggattgacttggcgatgcgggctcttttttggttccatatgaacttgaaagtagttttttccaattctgtgaagaaagtcattggtagcttgatggggatggcattgaatctataaattaccttgggccgtatggccattttcacgatattgattcttcctacccatgagcatggaatgttcttccatttctttgtatcctcttttatttcattgagcagtggtttgtagttcttcttgaagaggtccttcacgtccttagtaagttggattcttaggtattttattctctttgaagcaattgtgaataggagttcactcatgatttggctctctgtttgtctgttgttggtgtataagaatgcttgtgatttttgtacattgattttgtatcctgagattttgctgaagttgcttatcagcttaaggagattttgggctgagatgatggggttttctagatatacaatcatgtcatctgcaaacagggacaatttgacttcctcttttcgtaatcgaataccctttatttccttctcctgcctaattgccctggccagaacttccaacactatgttgaataggagtggtgagagagggcatccctgtcttgtgccagttttcaaagggaatgcttccagtttttccccattcagaatgatattggctgtgggtttgtcatagatagctcttattattttgagatacgtcccatcaatacctaatttattgagagtttttagcatgaagagttgttgaattttgtcaaaggcttttcctgcatctattgagatagtcatgtggtttttgtctttggttctgtttatatgctggattacatttattgatttgcaaatattgaaccagccttgcatcccagggatgaagcccacttgatcatgctggataagctttttgatgtgctgctggatttggtttgccagtattttattgaggatttttgcatcaatgttcatcagggatatcagtctaaaattctcttttttggttgtgtctctgcccagctttggcatcaggatgatgctggcctcataaaatgagttagggaggagtccccctttttctattgattggaatagtttcagaaggaatggtaccagttcctccttgtacctctggtagaattcagctgtgaatccatctggtcttggactctttttggttggtaagctgttgattattgccacaatttcagagcctgttattagtctattcagagattcaacttcttcctggtttagtcttgggagggtgtatgtgtcgaggagtttatccatttcttctagattttctagtttatttgcatagaggtgtttgaagtattctctgatggtagtttgtatttctgtgggatcggtgctgatatcccctttatcattttttattgcgtctattttattcttctctcttttcttctttattagtcttgctagcggtctatcaattttgttgatcctttcaaaaaaccagctcctggattcattaattttttgaagcgtttttttgtgtctctatttccttcagttctgctctgattttagttatttttcgccgtctgctagcttttgaatgtgtttgctcttgcttttctaattcttttcattgtgatgttacggtgtcaattttggatctttcctgctttctgttgtgggcatttagtgctataaatttccctctacacactgctttgaatgtgtcccacagattctggtatgttgtgtctttgttcttgttggtttcaaagaacatctttatttctgccttcattttgcttctggccatgtgtatgtcttgttttgagaagtgtctgttcatgccctctgtccacttttcaatggggttgtttgtttttcacttgttgttgtgattagtttccttatagattatgcatattagactgttgtaggatgcagaatttgcaaatattttcttccattctgtaggttgtctatttactctgttgatggtttcttttgctctgcagaagccttttaatttaattaggtcatatttgtcaatttttgtttttgttgtagttacttttggcatctgcatcttgaaatctttgccatatcctacatccattcctaggttactttccagggcttttatagttttaagttttacattgaagtctttagtccctcttgagttgatttatgtatatggcgtaaggaaggagtccagctcctatcttctgcatatgggcagccagttatttcagcatcatttattgaataggaagttcttttcccattgcttgttttcttgactttgttgaaatcagatggttgtaggtgtgtagttttatttctgcactctccattctattccattggtttgtgtttctattttgtaccagtaccatgctcttttggttattgtagccttgaagtatagtttgaatttgagtaacatgatgtcttcagcttttttgttttgttttgttttgttttttttgcttattattgttttggctctttgggctcttttttgtcttcaaataatttttttctaattctgtgaagaaagttattggaattttagtaggaatagtatttaatctgtaaattgctttgtgcagtatggccattttgacagcatcaattcttcctattcatgagcatgggatatttttctagttgtgatgtctctgatttctttcagcagtgttttgtaaatctcattgtagagaaatttcgctttcctggttagctgtattcctaggtattttattatttttgtgactattgtgagtgagatcgcattctgaatttggctttcagcttggacattactggcatatagaaatcctactgatttttatacattgattttgtatcctgaaactttgacaaagttgtttatcagatctggaagcttttgggtaattactgtggggttttctaggtatagaatcatatcatctgcaaacaaaaatagtttgacttactctcttcctatttggatgccttttatttctttctcttgcctgattgctttagctaggacttccagtatgtattagtctattcgtacactgctataaataactacctgggactggttaatctatgaagaaaagaatttaattgactaacagttctgcaggcttaacaggaagcatgaatgggaggcctaaggaaacttacaatcatggtggaaggagaaggggaagtaagaatcttcttcacatagagggaggagagcaaggagaggaattgtcacacagttttaaataatcagatctcatgagaactcactcactatcatgagaataacatggggggaatccacctccatgatccaatcacttcccaccaagtccctctcccaaaattgggaattataattcaacatgagatttgggtggggacacagaactaaccatttcacagtactatgttgaataggaatagtgagggttggccatcctcatcttgttccagttctcaagagcagtgactccagcttttgctcattcaatgatgttgactgcagatttgtcagagatggctcttctcattttgaggtactttccttcaatgcctagtttgttgaggatttttaacatgaaggatgttgaattctatcaaaagtattttctgcatctcttgagatgatcgtgtgtttctgtttttagttttctttatgtgatatgaatgcagaatccttcttgcattctcatgagttttgcaaacttttctgattgacttactttaactttgataacattgtgtttgacaactcacctttattatgtccacccaaatattcacagattgtatagactcaattctatattttagcaaggaatttcaataatatgtatatctgaaaatcattatataatcacaatagcaattcatactgccataaacaggtttggagacaaacagagctgattaactcttgttcctaaattaaagttttatgattggcaagagcagaacacataggaaatatgttgcctgctggtaatgagcaactgaagctccagggtgcccagcaagacaattaagagactttccagtctaaattaaaagaattacagaatgtaaaattttattctcaaggaagggaatgcagttaatgtccactaaagtaagttttcttgaatgcccttttatattttcatcttctaaatatctttaccttttataaattctcaagactatcctaagttgccaaaacaaagtgtaacttgggcaacatgaaagaataaggtatggaccttttccccatcctttattagcattctggaaggaatattggcaacatagacagatagatatgtagatagatagataaaagaaaatagattgaaagattctcacacatgtatgatatttaaaggtcaattttataaagtaaggtgtctttaaatacttctttaattatgttatatttaataactagaattaattgctttcactttttttaaaagtttaggagtaacttatctcaaacattattttaaaggttaaaataacataaatgcggaatcaaggttttttgtttttttgttttttttgttttgttttgttggctgggctggagtggagtggcatgatcttggctcactgaaacctctgcttcctaggttcaagcaattctcctgccttagcctcctaagtagctgggattacaggcacctgcaaacatgcccagctaattttcatatttttagtagagacggggttttaccatgttggccaggttggtctcgaactcctgacctcaagtgatctgcccacctaagccgcccaaagtgctgggattacaggcatgaaccaccatgcctggctagaaatcaagatttttaacaagagcgaatcactaagtgttgtaagaatgaaatgagaaaatgtgtaaaatattttgtgttaacatcacataattttttggtaagcgttagtttccttgcctttgccgtgagcatttccccaagctatattttgaatgatgagtcagtgtccatttcattgatcacattctacctgtgtaggtcttttgctggcaacaagagatattccaagttttgatgaggtagccaccaacgtgggtcacacaaattctaccttgcatagttttctctctttaaataattaggccagcatcatttactaactaaatagaactctgttcaagaggcattgaagaaagatagagcaattattttattttgaaaataacagcaacaaatgaacagaatactgttatttattagacttgacatgctgagtaaaatcaagttgctgttaggggaatgaagagatattacaaagtacaagacagtttatgttctggtatttcagaaggcaggtcaaaggttgatgttgtaagaataatttatatttgccattctttgcaataatttcacatggaactgggattgaatttgatgttgtgtaaaaaacaatattgagagtgaagaaggtggtaaacgtattttcaatgctataaagatgatactgtacaaaaagcaagatttattttgtaacaaaacattcatgaagggaaaaacccccacaaaactttcggtaaaatttacaactgaataaaacaataacaacaaaaatgatttagtatcttctttctttgtgattttcttgaacctaaaatattttatatgcttttgttccatttatagaagctttgttaaaatcctactatgtccagctcctttgctgagttatttgtggggggattttagtcatacagtggcctgaacaaatttgcttgattttgagtatatccaatacattgctcaaggaaccttacactaaaacaactgtggtttacttttggagtctgaaggaaactttgaagaggccagagacccaggaatttgcagatgtgagatgaccctgtctggagcaatcttagcatcacttctgtgtatgtatatagtctaggtggaaaaggcgggtaggcagggagtaggaagcataattgacttaaggaaattccattattgaatataaagggactctactctgatttctgggtccagccctgtggggcaccaccatttccattgacaacagagacactttccactcctgggtatggagcatcccacattccttttctggaagttcataggaagccaattcatggcataccacaggaatcaaaagaaagatctctcccttgaactttgactatctttcttaccaaaagacaggacagcctgactctcttgtccactgacataaataggcaaatatttaaatgtacaaggatacaattaatacctaattcatgagaattttttagcagatgcaattcatattcactttcaagtttcttcaatcttaagttctgtcatcctgcagaaaatcacattaccaaaaacatgccaggagtctaagtccagcacctcaatggagagtataaaacatggaggaatcatagtggggaaaattggtaaaactgcaccaattttctagttagatcaagagttctcaaattatgttctgcagcatttagcaaatgttcatatgatattagttagaattgttctcaaacttaatgaatagaataccctactataattccttaaataactgagccattgagtggtctcattcaacaggaagtccaggtgttatcaggaagggggagatcctcggttcttggtcttacttgggagacagatttctactaagtgacaattcaaagatatcagtgagccctattgaagggaaattgagaacagagagtttacatagagagacaggatactctgaaaggtgaggcagagtgggctactgaaagccagtgtgccggcaacagccctgagagtctgcatgggctttttataatgttggattgttctggaagttcccacctttgtcttaagtcaccacctttttctttctctagttttcccacttctgtcttaagtacccacctttccccatctagtttctgcccaggcttgtggaattctctcttactctctgttgatacgcatgtgcaaaccaggaattggatatgaattctatctaatggctgtgtttttcactccaggaaggttgtgtagtggttaaacctgtacttactgctcctgcgtatctcttagggatttctcctctgccctcttcccttatcatcatgcatctagtgacattctggcaggttaactgcagagtgagggattactgcaagtcataagggacattgctttccatctaggtgttttccctcctctctcctcatatctagcatggatgctttgagtggtctctggggtgtgagattttccagccctcccttttctcaggggcttccccttctgctcatgtctggctatcagcctactctaacacaggtgcaggcaggactctcatcagtgaccatcatcagccttcctggaaggctcaggcatccttggtgagcaacacttgtgatttcatttgcaactgtagtagttagtctttctgagctcagacaagccatttgtctttcagcttttggtctctataaccctgaaccctcttagcactcctgcagatgcacaaagcctggaagagcaaggggctaaagctttaggaaccaacaccaactgctcgagatgaagctttttgtcctttaaatccaggtaaacatatttagtatattttttggtaaatatatttagtacacattgtaacattttctggtcacactgtcttgcagttactactcattaatactactgtagtgcaaaaacagccatagacaatacaaaagtgaatgaatgtggtcatgttccaattaaaattttatgtacaaaaattggcccctggctaaattgggccaatggggagggttgccatatttagcatataaaaatataggatgcttacattggaatttcaaataacaattaacttctttaatctaggtatgtcctaaacaattatttgttatttctatgaaattcaaacttaaccaggtatcatttatttaactttcaactctacctgcaagttgtaatgtgatgacttctggtttagacagattttctgaggaggaattcattatgattatccagatcccaggaagatttacaactctactcattgcaacatcaatgcctatgagtgttagtgtatttttgttgtcatcgccttactctcctagctccctcacacttgcttcctgaggtcacctactgtactttcctgctatggactaaattgtctctccccaaaactcatatgttgaagctctacccccccaatataatggtatttggagatggaggactctaaggaggtagtttacgttgaaggacgtcataaggtgggggtcttaattgaatatgaatagtgtccttatacgaagaggcaccagaaagtatatcctctctctgtctctttctctctctctctctttccctcttcttctcattcttcttgcacctacagaagaaaaccatgtgaggtcacagtgagaagggaggaagagagccctcaccagaaatccaactgctagaaacgaggttaggcttccagcctccagaaatatgagaaaataagtttctgttgtttaagccaccaagtctatgatattttattatggcagcgcaagaagagcaatatacccctccattaaaactcttattaaagagagaaaatgattactacaagtggaactgcatcagtatttaccaaggcccagtggagggcatatatctcagctccaagcaaaatcctaggaaactgaaattatgagtgacaaatgggacatggagaataactctgtggccaaataacaggagttgaaatggaaagtaaggaaaagaaagtatcagaagaaaaaagggactatggaaaaaagaaagtttccactttcagagttaaaaaactcacaaaggaagatataacaaaaataatactttaggccaaaaaaatagccacaatataagtaactttatggcataaatctgaaaaggtgaatgaattattttaagaaaattatattttatcaaacttgaaaatttagtagtactggaaaaatggtctgatagaaaagacaagtgttaatcttcagaaaacacatgatttttttcatcatccaaagaatttgagatgacagaaaagatagttggcatatattttatttcagaatattattaagatatgactaaaactaaatttgcattaagaacatagatgtaatcaccctaattataattttagttaattaaatctaaagtcataccaaaagaataatgtaggaaaccaggtaggtatgatttcaggcatacgtggatgactttacactaaacatattaaaatagagaaaaaagaataaagataaccttctgatttgaaggttcatatggtagcataaactgaagcaatacagcaattggatctaagaatgcaggtgtaaaaaccttaattaaaaaactagttaataaaatcaagaggtatatcaaaacagttatgcagcatacacaagtatttagttctttctttttttttttttttttttttttttgagacagattcttgctctgtcacccaggctggagtgcagtggcacaatctcagctcactgcaacctctatctcccaggttcaagagagtcttctgcctcaggcttccgagtagctgggattacaggcccctgccaccacacttggctaatttttgtatttttagtagagatggggtttcgccatgttggccaggctggtctcaagtgatccacctgcttcggcctcctaaagtgctgggattacaggcatgagccactgcatctggcccaaatatttaattctaaatatgcatggatgttaaatagggaatcctttccccatttcttgtttttgtcaggtttgtcaaaaatcagatagttgtaaatgtggggtattatttctgagggctctattctgttccattggtctatatctctgtttcggtaccagtaccatgctgttttggttactgtagccctgtagtatagtttgaagtcaggtagcatgatgcctccagctttgttcttttggcttaggattgattttgacttggcaatgtgggctcttttttggttccatatgaattttaaagtagtttttttccaattctgtgaagaaagtcattgctagcttgatggggatggcattgaatctataaattaccttgggcagtatggccattttcaggatattgattcttcctatccatgagcatggaaaattcttccatttgtttgtgtctgcttttattttgttgagcagtggtctgtagttctccttgaagaggtccttcacatcccttgtaagttggattcctaggtattttattctctttgaagcaattgtgaatgggagttcactcatgtcttttattggtttataagaatgcttgtgatttttgcacattgattttgtatcctgagactttgctgaagttgcttatcagcttaaggagattttgggctgagacgatggggttttctagatatacaatcatgtcatctgcaaacagggacaatttgacttccttttttcctaattgaataccctttatttctttctcctgcctgattgccctggccagaacttccaacactatgttgaataggagtggtgagagagggcatccctgtcttgtgccagttttcaaagggaatgcttccagtttttgcccattcagtatgcaattggctgtgggtttgtcataaatagcttttattattttgagatatgttccatcaatacctaatttatttagagtttttagcctgaaggactgttgaattttaaatgattagttaatgggtgcagcacaccaacatggcacatgtatatacatatgtaacaaacctgcacgttgtgcacatgtaccctagaacttaaagtataataaaaatatacaaataaataaataaataaataaataaataaatatgcatggatgtctcaacttcacataaattatcatagaaaaaatctaatcacaaaacgacgtttgacaagattatgtgatctttactgcttttaaagactaataatctaggaatagattgagaatattcgacataataactaacaattcacccacaaataatgtgaataatactatatcacataagagacactcatttactttgatttatattattgcatgcctagaaaatcaaaggtgcaactaaaaagcagttggaattattttagacaatttgatatggtaattatctaaaaaataaatacttaaaaccagtagattttctttatattagtaataagcagtaaaagaatgtatctcattgctaatagtgacaaacatgcaataacttcttaaaaagaaggaaatcctgctatctgtgacaatatggatgaacctggaggacattgtgctaaatgaaataaacctgattgagaaaaacaaatgctgtacaatatcacttatttgagaaattttaaaaagtcaaacccatagaagcagcatgtcagaaggtagttggcctgagactgagggaaaggaaactggggaaatgttggccaaagggtataaagtttcagttttaagatgaacaaagccgggcgcagtggctcacacctgtaatcctagcactttgggaggcccaggcaggtggatcacgaggtcaagagactgagaccatcctggccagcatggtgaaaccccgtctctactaaaaatataaaaattagctgggcgtagatgtgcacgcctgtagtcccagctactctggaggctgaggcaggagaatcacttgaacccaggaggcagaggttgcaatgagccgagatcgtgccaatgcactacagcctggtgacagagtgagactccatctctaaaaaagaaaaaaaatatatgaacaagttctgggggatataatgtacagcaggagtggtgtagcaattagtttgattgtgattattataacacaatgtttgcatatatcaaatcatcatgttggacaccttgaatatatatgacatgtacttgtcaattaaatatgttaaaattcaagaatagatttgccatgaaaaatgaaaacatgaaaaaataaatactttagaaagtgaatttaattggaaatatattgggtttataatgaaagtccatgtctgaggtcatggatttaaagtgcaaccagtcagcttactttctgatattgtcttgcaaaattcaggtgttaagactggagagaatggtgattaaattctactaaggatgtggttttacagtgtgagtgagagggttaagatgcttggccgggtgccatggctcatgcctgtaatcccagcactttgggaggccgaggtgggtggatcacctgaggtcaggagttcaagatcagcctggctaacatggtgaaaccccgtctctacaaaaatacaaaaattagccgagcatcatgtctggtgcctgtaatctcagctactggggtggctaggtgggagaattgctggaggaaccctggaggcagagtttgcaatgagccaagatcttgccattgcactccagcctgggtgacagagcgagactctgtctcaaaaaaaaaaaaaaaaaaaacgagatggttgaaggcctttgtaggaaagttgctatgatactctgcagttaaggagacaagtgatgacaaatgagtgctgagaggtggaaggaaattgtcgtgctctgtgtgtgtgtctagaactttattgtttacattgcattttattgtttacattacattaagtcaatgacccatttagagatcatttttttgcaaggtatgacgtttagcttaagacttattttattttgcttataaatgtccaactactccttcatcattcattgaaaagtaccacccaccgccccccaacccccagtggagagaattttgttttaaagtaaataaaatgtcagtcatacactacagcagtcccaaggtcatgtcaggtttgccactgtgcagctgaagcagccctccccagcatcatacacacagtcacagcaccatgagcgtaacttgagtgtttgttatgctcaaggcactttttgaagatctttcatatgtctttctttttatttaattctttataaaatgtgcaccatttttatttccaggttacataaaagaaaatacgctataggcagacatcagtgacttccaacagttaaattgttattaagtggtcaaatttagggtgtcggattccagaccccatgccctgaaacataactaacaccatctaacattaaacactttccaaatgcctttttttctacttaatgtaatacttacaatgattctgtgaagtaggattttactccaaaatcaatttcagcataaaatttgtctttcttgatttttctcagcactggcttttccccaactccactcttaggtcttttatttctatgatttttacccaccctttgatttacgttgcttataatttttaggaatccttgactctgtgttggaatggactttaaaaccacataagataaaattctcacccacttctccatcctcagtcattgcgtacctaattcgtattcgttcatttataagaattttgaatatacaccttcttcatatgcacaaagcatgcccattggatgcaggcctacgtgaagttttataattttaaaacctggcctatttctttctcttgttagtcaggttaggttgttggtgtgccagaaatgtctattttagactcattttccatgagcattttgcttgaggagtgcaggggctgctgctcctatttgcctgttgatgcagaagccatattccaataacttctgagctctatgctattcactctgcaaatttacttatgactctacctgaccatggcatcagcagaatgaccttcagaactgcaaaggagtcaaaaaacatcctggcattttaagttaagtggaaaactttatatttaacttacagaataccaaagcttctgagtacttagattttttaatgctaggactcattttctcagtggagaatgaggcatgaaacaacatgacgaagattatatttgataattttaacatcacggtttacattttaagacaattttaataatactggaactaacatattccgttctttctgcttgaaaaagttctaatcactcagctgaatgtgaatcatcatttgtctttgttttacatatgcctgaaaatattcaaatgccttttagacatcttttccagagtgtgtgcacacaatttggacttgtcatgctgtaaaaaagcacttaagaacagatgtaatttactataattttagagtccagcatatcaaaaaataaacaggctatgcttgtttatccggtatgatcaaaatgcgtgtgattcttcacattctggaaaaataaacaagaaagaattgtccttatctaagattgattcctgacatcagtatacaatatgtttttctttttcttataaagaacataaaatgtttagggtctaattcacacacagggaaatgccaatatttcagataaagctgatcaataatcatggaggaggaaggtagggcatggcaccagtcctcatgcctctcagcaaaattgttttcgctccattgctgtctgagtcttacaatttagttatttttaagtgattttttaatcacagaattagctctcactatatttcagtgagtagcgaagtctctctcctggtcactgagtttacttattctctctgttaccactagactgtagataagcatgtactagcaactgaaaagtcccaggaactaggaggaagccaacatttcctctattcatttatattttcttctttaatattaatattaggtctgaagttaggttatgtttggttttgcttcacaatctaattagtgtggtgagatttgtgactagcagagctgaagtgtgctgagttccctgtaacctggtaaaagctatgtgaagttggccctggggaagggaaagatgctgaccactgcagaagactgagcaccctcctgttcttaggttgcattttacagaaagcacctacttgcttctctattttccaaatgtatgatttatgaacaatctatttgataataaaaaataaggctgcataccagccacttgggaatatgatttgtttattaaccttaaatttcctagttgttaaggcattggaagtgtttgacccactaagagtccattctcaacaggcttcaacccaaagagtagaaaccatgcttcatgactggagaagacactacaactccaagaagcaacagttcatttttccccttcaggttttaaaaaaaaattacatgtaccatgattttcaatattttatttcaaataaatatgttggaaatgataagaaaatgaactaagatttattaactgctaagtgttgttctcagtgctttacacattttacatatgtagattactcacacaatctttgagtgtccctatgaggtagataatatcatcagctctactttacatataaggaaatagaagcaaagaggatgttagttattgactctggacacatagctaacacgtggccaagccaatcatgtgaggagttcaccgaaaggctcagctcttctctccattccctgtggaccccaaagaatcctgagaattttgaaagaaaaatcaagagcctatgagttgaaaacaaagtattattttcttttatttttcctttatagtttataaaattaaagtgtattcttaaattccacattgtttttcaaataacaaaattaccagctttttatcattctaaagaattatatatagattaatattaaaaccatgctcagtcagaatccaaaaattaatttctttaaattaaaagacttggaggtagagtaatgggatctagaacttctttgtattagacttagcagagacagatgcctgttttctgcttgagtgatgaaattctacttctaactacctcaagaaaatacggcaggatgcactggctcacagaaactaatgaagctttggccctccaaactgctgtggtggaggcacacagctggtgctcagaaactacatggaagcaaaacaaacaaacaaacaaacaaaacacctctggaagtaattttatgttaactatttctgattttcttttttcagtgtgccctcttctttctctcactgcctttctctatatggtaaaaaattatatagccagcgaagtgcccacttttatattttatcactgatcactgccaccacagagagaaggctaattctcttttcagtggccatttaaacaatttcaggaacacactctggttgacatggccgggaaatggcctccttggattaatcaagtaccttcagaggcaacttgtgctcagaggagtcctatggctgaggcttgttcccaggattcctataggggagtgaggctggcatgcagctgaacacacttgacccaagaaaagttatgttgcaattcaccaagaaacaaaatgatgtgatggcaaggacatggaatttaagtgttaaagaaatagtaattcaacaaatcctggttcaactaattacaactaattaattaatttatataaattgtgataatttttacattattatgaaaattagatgagataataggtaaacagataatagctagcattgagctagctagctattattttttatcaaaacccttgtattgattcagtttgtaattttacaatgtaaggacaattactatacccctatcagatgagaaactgaggcatagggaaattaaagaagttgttcaaaaactcatatctagtaaatttaggagccagaattaatacgctagaataatacaagcatgcttgctgttacaggaaagtgcaatactcaggatatgcattacatacttctttgaattggattcagaattgctaagattataaaaatatccctcattctttattaacaattacttatcatcagttttgttcatgataatttagtttcttgccttgagaagcacagtagaagatgaagatgaaaccagtcttcctgagttaaaaatgtagctttgccatttaccttggacacattgcataacatctgtcttgttatttttgttttctccccctctagcaaaaatgttaatagtagtagtaactacctttttgggttattgtaaggaaacaattaatgaattaatacttgtaagcactctgaataatgcctgacccttagaaaacacttaagaaaaagttagatcttagtatactagctattactagctattactgtcactactatcatcactaccaccaccactactgaaactaccagtgttactacgatcacgactactgccactaatactaccaatattactaccatcaccaccaccaccactaccataactactactatccctactagtactactactaccaccaccaccctactgaaactattaactattactaccattactactgccactaacactatccaacattactgcaatcaccaatactgccatcaccaatactgctaccatgataactactactactaccactactagtaccactactaccaccacaaactactactcattattactgccatctttatactaccatcacctctgtcactaccaacctcaccaccactattaccgctgttatcaccaccaacgctactaatagtattgcaatgaggtttcttctcctgaacccacaatttttaggtgatcacattttaatgtccacattctgtttttatttttgggcctcatatttcacttaatcaaaaattatgtaccaagttcttaatttgtaagaaactggtagagaaattatatggtagatattaaatgaacaagtcatgtagccgtggaatgagtgcagttttgcaggacaactgatcctctctacatgtctggttgccataacttcgcataaacgtatcgtaggacaatctgacttataggaaacactgagctgcttttgctccccatatttcattatcatatcaagacactgaaaggaaaatatttatttattagatttatttttatttaagaatattaaaatgtcttcattagtattgaaaataaatgcacacttgccatacacaaaaaactagtctctcaagaccattattttttatacgtaagtgcctctgaatataacaacagcattgtcagagttaaaatttattgaactggatgcttgaagactaattttggcctctgacttggctatttctgtgaacttagacaagttaaaatttctgagttttggtttccatatctgtaaaacaaagcacttttaactagatgggctcaaaggcctcttggagttctggtgttcctacctagttctatgtgcactgctcagaaaccctgtacattctggaatgtttaacctcagatatttatcagtgcatacaaaattttatgtacaaaaataaaaataatgttacaggtacctgctagaaaaaaaatgttgatgtgctttggaagattatagagtctgttaggtgagaagtaacatgattcactcaaataagtattaatacaaactaactttagtggtattgtgccagtattttagaataattagaaactgaaactagtgacagagaaggagaatttgttgaggatttaaaccaatgtgttacaactgtaccaaaaaaatagaatgaattttaaatcatgaaaataagccaaacttggtggctcacacctgcagtcccagttactcgggaggctaaggttggaggattgttggagcccaggacttcaaggcctcattgagttatgatagcaccactgcactccagcctgggtgaaataacgcaatgtttaagcttgaaactaaattggagaagagaataaatgcaataaggcaataatatacactttaaatacaaatcttaagttttctggataggaaaatttttagtaatagtgcattttggtggtaaaaattctgggactgggaaaaaacccaagtgaaattgtttttaggctggcttgcctgtgctggcctctcacctgctcctcagcaccatgtccaaccctcgatgccccctgccttggtttagggacccccagtgtcctctgccatacagatacacacacaccttgtaagttgtgcccatggttgtgtgggatagtgtttctcagcctctgtaggccacgctgcctttgaataaatgtaaaaatattcaaggcatccttggtaacttgtgccttacctcgttttgcaaagcaaatagtaaaatgggtaaataactactcccttattcccagcagaagacttcacttttcttatgcacttggagaggggatgcagctgggagaagtagtgaaagtgagggagtgaggtccctttcaggagttacagtagatttgcgaggcctggaatgcaggaagagggcaggctgagcactgcacaagaagtaggtcaaaaaaaagctgtgactgcactcagccctttggacctcatcttcaaggctattagagcctgaagaatgttgaggaggaggatgacattgaggctcgtagctcatattttagaaagagcatttgggctgcaatgtcaataactaattaaaggaggtgaggcggtagctcaggagcagtgggaagatggttggcagcataaggaggcactgtgacttcaatagaggcaggaggatagtaatggggacaagaggatgcatttaaaataactgatgatgagttgaaggaggataggagtagcacagagaagaaattcaagagatataccagctaaaataccctaacagtagttctcctcatagaaaaccaaattgtatgagctctcacaggaagaatgcaccaaaccaatagagagaaaaacctgattgctttgcatataaaatgggaatggaaatacatttatttaacaaatatttacatagaggcttttatgtgctaaacacaaacactctgtggattcagggggctcataacttctagcatactgtgacagattcagaaactaagcggaagcccgtggcagaccaggtcatcaatactgcaggtgagagtaggtcaccagagtacaaaatcttagatgcatttgagacatctaagatttcatactccacatgcctttgcaaagtcctaagactcacttcaaacctgatttgtcagtttttattgaagcattgcagaatgtacataaatacagactagtggctgatggtaattattgtaccgctcagtgctccaacacacaattacatcggtgcataaaagcatagatatttaaactgccagacagttaatttgagaaaatgaatgcttttgctggtttcagtgttcctgaaaggagaatggagaatactgcacaggtcttatgtgaattcctaatgatcggtagataaaccagttgcacaagagcaagcaaatgattcagttacactcagctaaaattatagttttattcactgctgccaaaaatataaagagatcaggcatttagaacatctttacattaagaaagcaagagtatggtttttttcttatatgcattataaaagatgaaatatcaatttgctaagagatgcctattatatgtcattaattctcataatttccaaacaaaaaccctctttcagaataaaatctggtcttcatgtatatgcaaagcacagattcttttattttgtttttcctactgggaaagggtgacattgtagaggccaaaagaagggacatcttcaagcaaaccagtcctgtgtgacaaatagctgtgtaacctacaggtagcagctaaaaatgcacacaagccaacacatctttgctttcttaagtgatgtgcccaagtccatacaggtagtaagtagcagggcttggagtcaaacgtagacatcccatttcccaaggtgactttgcttttaacaaaattgaatataaataatatagggttttcagtgtctttttcttattattagaacaacaactaaaacaacaaaatccttcagtcaggatctgaactgtgtctccctcagattaatatgttaaattcttaacttccggtacctcagaatctgtacttggagatggtgtcttggaagagctaactaaattaaaacgaggccattaggatggtccctaatccaatatgccttgtgtccttattaaaagaggaggttaggacagagacagattcacagagaagaccatgtgaagacacagggagaaaatggccatttgcaagcccgtgagaaaggctttgggagaaaccaacccgctgacacatcagcctcagagttccagcctctagaatgtcgagaaaacaaatttcagttgtttaagtcacccagtatctgctactgttttatggcaggcctagcaaactaaaacaccttcttagcatgtgaatagtattgctgctaaaggatagatgtaatgaatcattgttcagaaattttttaatagactgtgtaaaatagtatttgtctgatacttctaaattataaatgttatctttcaaaagattaacgttgcatattaataaagctgacctctaaatataagatgctgaatagcaatacggtcctaattgcatgattgaaatggactttgaagctttacttttaatcctctgcttataaattattgatatagcttcaaattattggtgaataagacagaaaatgatcctgttcccatgccaaattacctccaagggctttccctgcttctgcttgtgctaggcagtgaggaagaaaattgttgccaaattcctaaagaaattggccctagtaattgaagcttgttgctaaaattcgagtgttaagcaaaagacagtatgagagtgggattaaatactccatagaatttttgaaatatttgttgtgttaaagggtttgtaactggattacaaattcttgtgggcaggcagttacttgcactgaacatatgttatcttattttcatggcataccctctcataaatgttactataagatagttacttatctatggataaagccatacctgaaagcactgagatttctgccatcactatacaagagtccagctgctgattattgaaaggcacatttggctttagtccagagttctgtaaaaagattatgtgaatacaaagcaattacagaggttggtttgggtagcaggtggactaggaaagtgagcatatgcatttttaacatcaggaactcagtaatcaatggctcctctaaatgtgaaattaaatcccagctaagaatataagccattatttaaagcaattacaggtgaaattctaaatataactataatcaacacttgtttttctttcctataaacagtatcaagataatgtagtagttattatttttaaaatgcattagctaaattgaagaagatggttaattttgtccaataccatttttgtttgtttctttaaatagacattaggttttctttatttatgagtgtgtcacatggaaatctctcaaatatatgtttaagtaatgcctagtaagtttaaatatgtagtattagaacatgatttttttaataagcacataaaatgtaatttttatatactaaggcaaccattgtaataaatactctactactgaattcacactatgtcctaagaacggtgcgagctctgtggatagaaggaaaagatgcacacttgctttcctggggctcaggtctgctgtgatacaaaggtgtcattgtacagtgacttgtttcctaagtgcttagtatatggtgtgttacgttgctgtattaagatgtgctgggtggcaatcatatgctgtgctaaagaaaatgctgatcgtatggcatgctatgtgcccatcatacagtgtgctcagtgctcctcagagggcatgctaagtgcctgcatatggaatgctatgtgtagagtctgtgcaaggtcagaggcatattactgttggtggaattctggaatatttcatagagaaagcaacataagaagagctgtctctggttgtgtaggtgaacttttcctgccatgctttgaactttatgcatgagtacacaatggctggttctgcggcacccttcttgggtcatcacacctgaggacaagtggccgcacactgagaaaggtgaagtgaaaaagagtcatagaggccagggaaattcagggactccatttatctgcatgactcagtaatgaaaacagtgatgttaagttttgaaagggccacgtgactaaatttctaagaatctcaaaccaggcctttggactcagactggctatttttaattggttgtgccaggctgtgtaggttgtgccaggctgtatagttttatgagactattcacatccataactgatacaggagaagaaataggtttgaatgcaaggaaaagaagctttttcagaatgttttattgtaatgtacataaaattgattaaaataacttagtaaataatggaacaattgtaagaaattagtgtgcatttttttcaaaagtttagtattgatgaaaaaaagatatgcataaacttgagaagatagagatttacaatcaccaacattgggacatgtgttttatatataaagcatatatacatttacatatgtgttttaaatataaattcatatatgtttatatgtttcatatattatatattatatataacacagatcccaatgttggtgatttgtcaagatcatattgtagaggaaggtgtgtgagtcagcattaccagtggagaaacttctggaacaggtgacaatagtatccaggttagacagaaaggcagacaaaacaaaagaaagcccatgagctatatgggccagtaaaggtccaagtctgtattgaaggtgagtaccaggctccacaaagtggtagtgaaggtgagtaccaggttccacaaagtggagaggtacgagctttttcctcaggagcatacaatcttggaggcagcatgcttttacatacatcacagttatatctggggtcatggaagttaaaatggttaagaacctccccagtcagggataaaaatataaagtctcctggtaaataaggacaatggaacggtgaagacagaaaaatgttaggtataatatcagaaattgtgatgtgtcctactgattctttaaaacagaaagtaaaggattcctgagtgaagggggaggagaaatttgctgacgcagagctaggagctgaggctgaggtccactcttcagaccgacacatgaggcctatatgatagaggcactttggaagccatttactgtgacttttagtagtaattaagtggtaccaacattgcattaaaatacatcttaggaatactagagggaatatgaggtcataatgaaggtatggacttacttagcaatagtaaaaacagtgcatcagatttaatcatcttgaatgacttaagcattgggttcagttacaacaggtgctctttttcggtccttttcatcaaaatggttattctggcccaccgcccagtgggtagagggactggaacagaagtctcaagggctttcttggagctggaatccttttagagccaactgcctcaaggcctggcaattttcctgtaataactgcagggaagcctcctggtctagaccgggtttgcacagatagaaacattcaagacatttagtcagttttctgccactcttgttgctagaataatttttaataatgcttcatttcagaatttccaaacaggatatatttccaaagttatctcaacctacaaactctctgaccaaaagtaaacaattaggacatatttccttcagtaaaataaatgttatcttcatttattttcattggtttacaattcagtctgctttgcaagtccaattgttttgtttttctgactgtgtctgcctctgagcagccacacaccactgcattaaacatgccttttaatatcacttctgtattcaataggtggcttttaaatgtatgtatatcgttatcatgcaaaactggttattagattggggagagagtctaaaaaatgtcttttactgcaaacaaatgggaagaatcaaactttaaatcactgaaacttagtagcactgcatattaagtttctaatgtagcactctaattactctccactgaggaatcacaattcacaaatatattggaaaaagaaagattctgtacagagaaactacttgcttatcccaagatcggtacttatgttttaattctatctccctccattactgatggtgaacaggaatgaaaatagagacatagtccaagcataaactaaataaaatgatggttgtgattaagagataagcagagaaatattttgctctttttgagtgtctcacttgtaacaatggttcttgtctttagctagacagagcgtatagaaagagcctgtagaaatttaaaagcaatattactttatacggtaaaagcaatttaaaaagcattcatgcccatagcaaagatgctaaaatttgtaggttctaaaagcagtaataagtacttacattctttcaaaaattcctacacacatgtccagataaataaaccatatattgttcccaatacttcatcctaggttcaaattccaataccgtgacttaaaagtgggatgactttgaacaagttgagctttttgttggttattgtttctcccactttagaataaaaaaaaataattgaaccagcttcatggagtgttgaaaagtaagttaacttaagttcttaccccaattctcagcttgcagttagtttcataaatgttagttctaattataattacaaaaatgtttgaatagaaaattatctatatgctcaccccattatttaaataacacacaatttgaactttatatcaatatatactcataatttggacatacaaattgcatttaagtgtcattttagtgattttgggctatacattcatggctatgtcagtcagaaatgaaatttcagatcatgaaattactttgaaatccagcatgacttagaattgacatgaccagtagcgagagtcagaacatcatttgatgaagataaaattgatgacagacaactgtattctctaaaattgcatatatcttaactgatagcattaaactgatttatttaggcaacaaatatttactgagtgcctactatgtgccaagcactacactagatactaaagacataagaatgaataaattatattaaaggtcttttgtattattgtttatactttaaaagttagtttagcacacacgctgcccgatcattcagagcatcgcatatggcatagaagagaaaagagtggttgagggttttgtttcaaggcttcatagcatccagaaggaaaccttagtgtctactgtccaggtggaatgcagaaggagaggccctcaataaatgggaactgaaactttttggtttaaagccagcaccctcagaggaccccaaatataattcataaaaaacatcagtcttcctacaaaagttgaaaacttgattctcactgtcttggcctgagttgtcagcaaagcacaagctactatgggtaacaattttacctacagagttgccctcacaggatctgtgggtttggattcataccgtcttggtggagaaatggctcagacttgaaacttctcccaattgtgttatggagaaaccatcctcatatcacacattataggttcctcaagattaagaacaaccaaacatgacttcaatctcatagtcaacaattgcaaatacagcaggaaaaagccttctgttttcaaagctcataataaaactaaatacagagtaatttcattttattattttgttgttgttgttgttgaggatcttgctgtgcttcccagactagtctccaacccctgatctcaagcaatcctcttgcctccacctcccaaagtactggatccacaggcgtgagccactgcaccttgagcaaagtaattttaggtgaccagaaattcatataaagagttaatatacttaaggacataaaattcaagtggaaattctgtacaatatcactatggaaaaaatgttcatgtgaatgtgaaaaagaaacaagtggaatgctttgtaaatagcctctaagttaaaactataagtttaaaactctgaggagaattattagattgtcatagcccaaaaaagacatatctttagttacagctataaaatataacaaaataagttatcctgaatgtagaactgaaaagacagaaattgaaaccaagataagttaagggtcaaagaaagcaaaatgggaggttctcacacaaagctaattggagtttcagaaagagaatagtgagagtgagagacaactattttacagatttttcataagtgaggaaacacaaaaatcttcaaatctaggaggcacaaatatcaagaaagagaaatacgaagaaatgtaatatatagctgattttgtagtggattccaaaatgccaaagggaaattgaaaagtgtttaagtagtcagagagaaaaggttatatattttactatcatgataatggaaaccaggagcaaaatataacactttcacaatgctaaaagaatgcaaataccagcttgcctttcctgcgttcacacttttacttataaaaattagaaagaatttttgttttacaaaacctttgaaatttgcgttaaaagatgctcaataaatgcatttctgaaagaggtacttgaggaagaagataaaggatcttgcaagggaagtctgagaatcaaaaattaatactgagcaaaaaattattaaacatttgggtaaacataaataaacactgactacataaaacagaagcaaatttgaagagtaaaaaagtatgggagctccacattattggacaacagtatcatttaggatgggaaataatggtttcaagtaacatttgagctctttgttctgtttagaaagattacaaagatattcattgactgtaaacttgaaattttagaatgtcttcttaatttaacaacagcaaggtataaaaataatatagaccataggaaggagcaaattagaataaaaacagcatgtttaatttcaaaaagagagcatgaaaaacacagagaaaaagcagaacatataaaataagcttccagtggatatagacagtgaaagtttcaaataatgtaaaatatgtgtattataaatcaacacatttatgacagtgtttgctttcagtgtgaaggctagcaaatgcaatcaggaaagcattcacaaagaactgtttcagtaagcattatattttgacctggaataatcaaagtgggcactcgattatttcttgaatttttttgcagcttttttggaggtataattgaaaaataaaaattgtatatattcaaggtgtacaacattaagttttgttatatgtatgcattccacacatatgtgaaatcatgcagtattttttttctgtgtctggtttatttcactcagcagaatgtccttcaggttcatggatgttgctgcaagtgacaggatttacttgtgtattaaggctgaataatattccattgtacatatgtgtacacacacacacagacattttctttgtctatttatttgttgttagatgtctaggttgttttcatatcttggctattgtgaataatgcctcaatgaacatgggagtatgattatctcctcaaaatagtgatttcattttattttgtggatatatactcagaagtgggattgctggatcatatggtagttccatatttaattttttgaggaacctccattctgtttaatttaaatgattgtaccaatttacgtttcccaccaacaaggatgtccctctcttcacatccttcccaacacttgttacctttatatatatacaatatatataaaatagccattcaaacatatgagatgatatcttactgtggttttgatttgcatttctctgataattagtgatgttgagcaccttgttatatacctgttggagattagttgaccacatatgcatgtgcttatttctgggttttctatttcattccatcagtctatttttctgtttctatgctggtactatactgttttgattactgcagctttgtaatataatttgaaatcaaaatgtgatgcctctagctttgttattcttgctcaaaattgcttttgctatttatgggtctattgtcattccatgaaagtcttagaattactttctctatttctgtgaaaaagtcatataattttttaatcatcattaaaatatattcaccatatcccaacatccctcaagtaaccattgcagcatcaactctaagtctgaaatcttatctatatatcatcaaattgaaacatcctaaattttatcatttaaattatttatgggtgagattcagggtacagtagatcctgtgacaaaacctctccacctgtggacctgtgaaaacaccaaacaagttatctgcttccaagttacaataattagactgagacaggcagaatatagacattctcattccaaagggagaaactggaagaaaaaaagaattacaggtcccaggcaagtctgaaatccaacagggaaaattctattaggtttcaaggactactaataattctttgtatcttgaaaatctgtcctctgggccttctgtggcaaaagtcctcactctcttggcccaagtaggtcccattggacagtgactctgcacccatttttataccctagaatttttcctttattttgtcccatctctgtctctttcagtctaaactgacagtgtctctgctggtataaaattctcaaaagccttatcagtttcctgtataattcacagggatccaagccataagacaagaattgtcccccacagatcattcctggataactgtgtctctatccctggcttctgctgagaggtttgtggactggatccatgagttacacataaaatctcattaaaaacacctgtccagtttcatccttgacaccgtctccaggacatagtatcttagtaccctagagattttccatatcaacaagtactgattcctttttgcttcactgttaattcctcactttatctctttttctcacattttactataagaagcaaggacgagccagtctgcaccttctgtgctttgcttggaaataacctcagctaaatgttcacatttatgacttacaagttctacttttcactcaattctagaacacgattcacccacattctctgacactttataccaagtattgcctttccttcctttcctccactgaccaataatatgcttgtcatttctccataaggcctcaacaggagcactgttaatgtccatatttctaacatcagtcttgtcaagacaatctaggtttttctattaagcatctaaaaattctctcagcttctgtctcttacccaattccaaagccacttccacatttttagctatctgtatgtcagctcccttcctttggtactaacatctgtattggctccctagggctgccataaactgagtggcttaagagacatttattttctcaaagttcttaaggctagaaatctaacatcagggagtcaacatagccatgccccctctgacattctgggtagaagctgcctcctggccccttcccagcttcctctggtggccatccatctttgacaggtctaagcttacagctgtgtcaccccagtctctgcctccactggcacatggcatcctcattgtgtgtctcttctcttctttaaagaatataagtcatgttggattcagggcccaccctactccagtatgactttattttaaccatttatacctgcaatggctcccttttccaaatgagtttacattctgtggtactatgggttaaaacttcaatatgtctttttgaaagacacagtctaattcataataagaaacttcaatgtaattaacaaaagaagtcatggaagcagagaaaaggacagctagtccagcctgggatgcttagcaagacagcccttaggaggctgtgcttaaattttctatattgttgagtatattagttaaggccaatacataaaaagggctattggggcaggggctgccaagattcagtacataatatgccattcatggaactcaatctatggtggtgggttagtatcagtgttggtggtggtgggttaatatcagtgttgctgtcagaaaggaagagatccttgaattgatgagaacatgtgaggcaattccagccattatcatggcataggttatagcaagagcactgaaagtgaaaaagtcacccaggtgaacaaatctgcgtggttaataagtgtaaaggagaatgaaagctggagatcgccaatgcctatgaaaagagcacagggagaggagctttccaaatgaggcttacaatcaatgtaagataaaataaaaagagagggaatgtaattgctgaaccaagttgtcacagagctgttaggcaagggaagcactgacataagtacactggatttggcaagcaggcttttcctggcttatgggaaagcttttttttaaatagaatatggtagaaatgtaatcagcaagtataaacaacaattttaagaatcttttctgtgatgacagggaaagatagaatagtaattagagggaatgtatggttagtagggtacattcctttttcttaacttttaaaaatgagagacgctgaggtgtgagtatgtactttaggagaaaaaatagttgagcggttatagatagaagaaggggcatacttgaatcactcatggaatgtgatctcaggaagaattgagattcagagcacagatggaagtgttcactttgaacaggagactagaatgatcccaacttactatcaaaaacgatccagctttgatgatattcttccagtggttataaagtaattttcagtcctcttttatgtatttacaatgaaaaaaagggtcaaataaatagaaactgtagcatagaactgatcctggattgggttgttttctgtgatcccagtaggaaatagctccacaggttcaattatgtcaacccggtagttggcctggaaatgaacatctctgtgagactcagattcccttttctgcacagctgcgtgctgcagtctgaggagagccaagctctttcaaagccctaccccctgtcaacaagaaaaggcatgaaaagtcaattgatcttcacggctattcatccccttaccaatactgttctcaaagctttctgaatgaagttcggctttgttttatcctatgtgaatacttgaatcggactctaaatcaaaatcctgaacattcttaacattccatcatgtggtaataaatacaaagacaaatcaaaaagtaaaatattacataaggaatgaaactgaagaattgtagtcttctttcatacttaggtttattctggtaagcatttgtcattatttgaattgttattatttctatttgtgtgtttagcagcagataatattgttgatagctaccattaatatgtagtggatattaaagtgatcagtaggaagcaagaactatttaattcttgtttatatcagcttgtggatacatgataatttctccttaacctttacaaggtctttcatgattttgggggactttcgtttttaaaaaaaaaattcaatgaattttatttctctgcttttaaaaactttatttttcagtagtagtggaatatttatgctgcatctcttctgtccttgttatctctcagtttatctgaaatttttgtttgtatgtttaattttttaaatttagtttttagtttagtttactacatttaggtaaactgcatgttgcaggggtttggtgtgccgattgttttgtctcccaggtaacgaacatagtagctgatagatagttttttgatcctcaccctccttccaacctcctccctcaagtaggtcccactgtctgttgttctcttctttgtgtccatgtgtactcaatgtttagctcccagttataagtgaaaacatgttgtatttggtttcctgcccctgtgttagtttgattaggataatggcctccagcttcacccatgttgctgcaaaggacatgatcttgttccttttttatggctgcattgtatttcatggtctatatgtaccacattttctttaacaagaccaactattcatggatatttaggttgatttcatggcttttctattgtaaatagtactgcgatgaacttatgtgtgcatgtgtctctatggtagagtaatttatattttgggggggaatatgcccagtattggaatgctgggccaaatggtagttctgctttgagttcttcgagaaattgccaaactgctttccatggtggatgaattagtttcccacaacaatgaaagcatataagctttctcttttgtcttcagccacaccagcatctgttatgttttgacctttcagtaatagccattctgactggtgtgagatggtatccctttgtggttttgatttgtatttctctagtgatcagtgatgttgagcatttagtggtcttgcttttgtgtgaattcagctaaagggcacagactccttttgtcctgagaaacacctgaatagcagggcacgtgaccccacccacacctgctactgatagccaggtgggcaatgcctgctataacttccagcccagccttcctgaagcatcaatttaatacctggtgaatgttattttatgcctgagctgcagggggcacagagatgactatgacttaccttgtgtaaaaggacatcatgtgaaacagacctacaggcctattagccccatggcaactcacagggactctgacagagtacatacaggggtcagggttgggacccatggtaacttgtggtccatgctaccaaaatgaggaagaggtcaggagactctttaaaaccaacacattttaactctctgttgaaaaacagtaggttttcatcaagcagaagagagcctaaagcatttgtggccctgtggtactctctggaaaagatatacagagagcatcccaaaacaccacaacacatttaggggaaaaatacctgcttcagaatgacttcattttcagcagagtagttgccacaaagacactctaagaaatacaaacattatctcatgtccggtgttaacatactgtatttaaacatcctcccatgcagtgtgaaagatggagtgtatttggtgagatttgaaagtgagaagatgagctagaaggctcctgaattagtatagtgagaaatttaaaagggtgcataacacagaacagtgcttttaatctgcccattcatcttcatcgtcctgctgatgggacgctctgagtcccccatctcattggaccaatctcatctcctgaccacagctctcactgcctgtagtcaactttccatctttcatttagcaatggtttatatggtgcttgctgtgtttcagtaggtgtgggaacctggcagcaaacaaaaccaagactttgcttgaagagtttatctttcagtggaggaggacagtcactcattaagtaaatgcgtacgtagatagtatgttagaaggcaataagtattcccgagaataaataagcaaagcagcaagaaggcgacagaatgacagtgtgctatttcacctagagtggatggggaggcttccattctaaggtcagacctggcaagggcatgaggaagtgacatggagtaaaccaccagatctgtggggaagattccaggagacgtccaggcaggaggcagcttcctgttctgaggcagcatcaacacagagattgcactggacactgaggatggacgagctgagcttggaggcgactgtccagagatgcagcagctggggccacagtgagtgaccaatggtgactcctcttggagtgactcctcaagacaggattcccatgttagcatgtcagccatgcctcatctcctgggctagtctctgtgtcctgagtccaattcttcagcctttccattaattatgggatcaagccaatatctttcttatcaataaattttctgcttgaattccattctgttgtctaaagctaagaaacctatctagtggaggaataagttttttttacagatgctggtaattgtgacttcataataaccttaaaaatgacattagtgtgaggactttaacagtctggaataacgacgtcacggcaagacactgcctcccaacccctgaaattcacacatatgttttccacggatgacgaaagcactgaaaatgtctgttcagaaaaaaaaacagcaattgaaataattcagcatgatgccactggaaatataccaaccttaataataagagttctggctggacgtggtggctcacacctataatcccagcacttttgggaggccgaggtgggtgggtcaaccgaggtcaggagttcaataccagcctggccaatatggtgaaactccatctctactaataaaaaaaaaataaaaaattagccaggcatggtggcacacccctgtaatcccagctactcaggaggctgaggcaggagaattgcttgaacctgggaggtggaggttgcactgagctgagatggttccattgcactccagcctgggcaacaagagtgaaactctgtctcaacaataataataataataataataataataataataataataattccttgaaagactcatgcaccttcaaagcactgaaggacatgcagttcatactggctggtgagtgccatttgcaggcagttgtgttttttcccaataaaatagttatctattttaaacagaaaaatccttgggtaagatattgaaattcataaaagtgggtaggattattgcatattttcctaagcaaataaaaactataagttatgtttatatgatatacagtgtatcatactgactttataaaatttaaattttatgtttatttgacaataaaattactgaactaaagtctaaaagtttagaaataacagaaaaacagtgggaaataaaagccacctgtgatcctgctacacacaaatgctgttaccattttgatgtatgaatccatttgtaatgtgtatatttgcttacatttgtgtagatttttgtgtacatatatttgcatatatttatgtacatttgtgtatatctgtgggtatttatgttcctatagttcagattacaatgaattctgacttttggcatatagcaggggaaattatgttatcaacattttaaaaaacatttttaattgcagcaaaatattgtactgaatgtacacatcacaatttatgtaaccaatcatttatatttgaacatgcaattttttactctaaaattgctgtggatatttgtatgcataatttctaaatatgacttatttgcctaggtaaaccctaaatatggatgtagtctaagagtgtaagcttttaggctttaacccatgttgactagcactcccagaagagctgcaatatgtaagacggtgtcattaacctagaaaacagaatgcctgtgtcatgtctgccaacattcaacttagttaaaatccccaaatatatgctaaaataactccaactattttattaaaagtccatcagtgaaaacttaaaagactagaaagacacatcatttgatgtgttatagtatgccctactctgggagattgagcaaggaaaagaagaaagagccctctacatttatgggactctagaattatcttaatgcactccacggttgggccatttgaagaaacagctaattatctttcatgtgcccactgtgcacattccccagatacctggcaagattgcaaagcaccagagccaagagtgagtcactggaatttaaaggagatgagaacatttgcagaaagattcacagtgactcttagtgatgagtaaactcagatagctcagtaatgtagttcagtttagaatagtcttgccaaattcagttgatgtctgaagcttttcacatgtcactagcgagctttgtgtttctgttttatattgcaaagaaaacaatgcaaaaattaaaataagtgctggagtaaatggccgcgaaacttgcaatgtcatgaagataatatattgttctgtaaggtcccagtttatttgataaaaaataatcaatcaaccaataagcactgatgaggcaaatctttgttctgtgtgatgctggaaatcaagaagtgtgagacagaaatctaacatttaaagaggggtcaactgattccactattgttattgtagttgagaagggtttctggaaggatcccacattgtcacacatggcattgcatctttccagttgtatccatgttcagtcttcttctgagcctaatgaactgctaaaggtgatgcttcctttctcagccagatttcccattctggttcatcttgaacatgtgtgtgtctgaaagagagtgtgtatgtacggtgtgtatatgccttatgtatgtgtatgtgggtgtaagagtgtgtgtgtttgcgagaatgtgtgtgtattttatgtggtgtggtcagtgtgggtatgagtgttagaaactgtgtatgagaatgttcatgttagtgtgtatgtgtgaatgtttatagtatgtggatgtaagtctgaatgtggatgggtgggtgtgagtgtgtttttgagtgtgtgtgcacatacataatacaaactcccccttggcctgcagagaccaagtgccaacctcacttgtctttcattttaaatgcttaaagcattaagttcatattttgacatatctatcttcattccttctttatgggaggatctttctggatcatctttaaaacatggtcattttggaaacagggagattgttttcatctcacctcacacatcattgtacaaatacttgtatacattggttccattataaagaagtaggttgagggagcaaccatctaagctctttactaattatattctaaatcagtgtgctcattgtctggtttccaaagcaacggctttaacatcccctggaaacttgatagaaattcaaattatttggcccacaccagacccactggaacagaaactctgtaagaatgcatgaaaatgtgtttcttcagtgatcacttgaaagatacatggagtctccaggtttcgctgattatgaattagcctgctgttcacgttttaggcaggtcttcctatgaatgtctcttttcaactttcttacttaaatatatgggaataggattgccagatcagatagtaagtgcaggattgctacatcagatggtaagtgcatgttgaacttcataagatacctctgaatgcccaccagcaacctgtaagagcttcagctcttcatccttgccaacccttagtctgcattttttcatttgtttcacttttgtttttaatttccagaattctagtaggtgtgcaattgttccacatcttgggtttaattagcattttcctaatgattaataaacaaaaattgtgactactaatggttcaaacctacctaaacgcttgcaatgagagatatgaatatgtgcaaaaatggacatgtgctaggaaggttagctaattaagcttccatataattatttatccatttaaaatggaacattttgagtatctgaaacacattagttactatgtgatcattaagatacacagcaatgacaacaacaaaatgacatgaaatccaccttagagaattcttaatttagtggagggtgaaaatgtaagtttaatgccttacaacatgttgtataaatgttctactagatagatctacagagaaagaattagaggaccacaaggaaccaataacatatctcatgataaagattcagttaaggtttcataatgcataattatgtatatttataatttaataatattgaaaataaaagaaaataaaagctgggcatatatatgtgtgtttcattatttgtcatcctttacaatggcatataactattacacacacactcacacatagatacaaattatttatattgacacctattattgcaaaatcagctcacactctatttttctataacttactttttatctttaaatgttatgacatttctttctgggtcactataattgtgtatgtttgtaggtttacctaattgtttcttatggcttcatgatattttatagtatagctgtaatattgttatctaaacatttttaaagttatttagccagaaaacatacatttcttaaacacttcccacgacaggcattttacaagatctgggaacacaagaatgaattcctctgtgtgttttctacagaaacccagactacagttaagatgaaggatataatatgatttataatacaaggacataaagtttataacagaggagctataaacaaagaaaagtgaggaagagagtaggagcttgaagaagaattcacaaggaatttcatagcaaacataaaaattttgctttttactttttaacacaaacctgcaattaaaaagattatatatatatatatatatatttgggttgaatgaatcaagcagttggttaagtgagagaatttatttattttttaagaaaaggtaaccagaagtaaaatgaatgttgataacattgtagttaggtttattcaggaagagataaggttttgttaaagaagctgatggtaaatgaagtaaaattttctaatggcttgcatttttactttatacaagtgttacaagcatatgaatacaggttgatggatgtatttcatcatgttaaaacctctcactgaaattttgcaaaagcaagacaaattaaaaataaagtccatgaccagtgtggtggcttacacctgtaatcccaacactttgggaggccaaggcgggtggatcacctgaggtcaggagtttgaaaccagcctggccaacatagtgaaaccccatctttactaaaaatacaaaaaaattagctgggtctggtggcgggcacctgtagacccagctactcgggaggctgagacatgagaatcgcctgaacccaggagatggatgttgcaataagtcgagatcactccactgcactccagcctgggggccagagcaagactccatctcaaaataaataaataaataaataaataaaaataaaaaataaataaagtccatagtgtctcccattacccagaacaattacattatatggccatgctgtgtcgacctgacagaatgttccatgtgggaaatgttctagtgggacatttgtttacatgtttctgatttccaatactcacaataatatcactttctgtctgaggtgaaatttcctgtctagttttcaagttttgccttgctatattttgtactactaaatttttattgagaaaaacgttgtgtttgttccttatcctcccttggcattaaaatactgaatggaaatggggaatacaattatattttagcagtggaagggatgactctagaaaatatttcctaactagggtgacaaatagtaactggtgtagcagaaattgcttctgtgtattaaagacttattcatattagaaacatcacttttcaagtgtctatggatactcttttccaccaaactgtgccagatagtctcgtacttttaaacatacatatgcataacatttgctcagatgcaagtttgataagaatcacttagcaagcagtctgtaaaagcaatttagaaagaaccaatatgttactgtttgggcgcataactctgttggtctggtttaattttagagtgtattttagtataatggatatgtcacatattcctgagtacaacctccattgaaaatgccttgtatttagttgataatggggagtaacatattaagactgacttcctaggtcaaaacttggaatacagctacactctgctgcttattaaaagttacatcatataccttaatcagtattaaaaattagaattccttttaacatgaggtagctgagaagcataacaagaacatgtcaccagaagccttccatcaacctcggtatggatttgagtccatgaatcctggagagcaggaccagagtgatgacacatttcatcagaagcactgacacacagatgcagtcacacacattcacttccaacatcctggctagaatctttagcctagaaaatttcatccgattgaatgaaatgcctacttaaaaaaataactttgaaaaacactacttcaagatatgctatacgaaaccatcttaatgattaaatgacctactttttagacaaattacttagaatgcattgtatgttcgggccacagatggaaggcagatggagaaatcaatcaggaaggaaacataaaaatggagacaatagttccagatagtgttgattttgataggacagaataacctaagggtgaaatgatagtggtgagtatgaggtccagcatacctaggtgaggtcatcaaggatgggctcctctgagcaggagatattacaatgaggaggagccagctgcatacagattttcaggaagaatttccatgggttatacagggacctagtcctttaaggtgctgtaagtgaagggtgagaattttatatgtttcatgcctttagcactgtagggtgaattggagggctcaaaaataggactggggatcatttaggaagcttcttcaggaatggggatggagtgaatcatatgcttccatttgcactgcagggaccagcaggtaagaatgagtggcaggcgactgagtgggcaggaggagcggctgtagattgggagttgagcagtgggtggataaacgttctactcacatatataggtacacagagcattttttatataaaggaaagggatcaatagttgtaaaagaaagggatcaatagttgtatttttattctgggtttgagacacttatgaaaacttctagtagcattgtcaggtcagcagtcttggtaatcttgaataaagatcaggaaagagagcaggacttgagctgcctgcagtgctctgggctttgggggtcaggatgacagaaaacaatgacaaaaggagatgagaaggaacaccaaatgaggtaggaacaccagtcacatgtggtgccctccacgccgagaggactcagtgcttcaggaatgatggcaatgccaaccatagggaggatgccaggagtgacagtggcagagccctggccacctggaggacagcagtgttaggagaaaagggggagcctcattggaatggattgagggattgaggagactcttcatcgagtgctagtggagacaatgactatagacacattttaaaataagtcttgaaacagataaatatgaaaaatctatatacaaatatatatagctagatggaattatagactcagttttatttgcttgcttctttgcagaggaaatagctctgtatttttgatattttaatatttacttttagactaattcatacataactatttattattcaaaaaaaattgatgtgaaactaatgaagtaactcctggttgcagatcatagtcaaagaagaagcctactaatgtgaattttgggcccttttgtagacttactcaagatgaaactctagggatgaagcctgactgcatttactgtcttacagaaaaagtcatggcagttggggcggtgttgagaaactcatgctgacatactctgcttcagggattaataacacaaactgaaatatttttctcacccgacaaagtttagggaaagcagaactgattgttccaaaataacaaatttccttattgtcaaaagcactttttatttttatgttcatctattttagaaagtagcagtttacatatttaaataatttaaaattagatatatatttttgaataattagatatctatgaataataaaattcaaatacatttaaaggggaaataatatagcatattcaaattctaataaaaatatatagatgacttgaactatctttgtatcatgtaccctagaacttaaagtataataataataaaaaaaaaaagaatgttaggtggaaacttgtagaaatatagctaaatatagataaatgattttgttaaacttattaaggcactttggaaagaaaattagaaaaataaaatgcctatacttaatgttattttgtatgaggataaggaaatatttcaactaaagagtatccaatttgtgtgtgtgtgtgtgttttgtgtgtgtttgtatgtgtgtgaacatgctttcaagttacttggataaatgcttaaaagtgggaatgcttggccaggtgtggtggctcatgcctgtaatcccagcactttgggaggccgaggcgggtggatcacctgaggtcaggagttcgcgaccagcctgactaacatggtgaaaccccgtctgtactaaatacaaaaaaattagccaggcgtggtggcgcatgcctttaatccaagctacttgggaggctgagacaggagaatcgctggtacctgggagggggaggttgcagtgagccaagatcacgccattgcactccagcctgggcaacaaaagtgaaactcagtctaaaaacaaaaacaaaaacacaaaaacaaacaaacaaacaaacaaaacaaagtgggaattctaggttgaaaggtaaggcaggcttacttatctaaaaaactgccaaactgtcatccagagtggctatgtcgtattgcaaccaattgtcaatgtgtgaggattcctgtgcctgccgatcctcaccagccattgatattgtaagagttttgtttaattttagatattctaaaaattatgtagtggcctttcaatgtagtttaaatttagatttatttatattattatttgccattaatatgtcttctatggttaagtgtctgttaaaagtcttgtgatgattttttgttctttttttttcttgttgagttttaagatttttttatacattctggatataaattctttatcacatatatgatttgcaaatattttctctcactatatggctgtcttcttattctcttaacaatgtgtttcacagagcaaaagtttacattttaattaagtccaatttttaattttttttttaccatatatcctgttgatgttgtatttaaaaccaaaggcaggagtgtttgaatgtgacaaggatacagggaactttgaaagtgataaaattcttctgcatgatacttgggtggtagatacatgactctacgcatttgtcaagagtcatctagtaaatttgaaaacaggtcatttaagaaaaatcaaccaggacatcagggaatgtcagaatggaacgcagactgtgaaaaatgaatcaaactatattataaatgtataacaaacttcactgaaggtggtaagggaaaaattggagctgacttgagaaacatcagaaaaataactgttttgactggtaactgtaaagtaagctaaagacaaaagaattatagaattaaagaattaatcactgtaccttatttggaaaacttgttttttacagaaatggaggttagaaattttgaaaccactttacaaatacactagggtttgacaaataagtaataaaatataagtaatgggttactctaaagagtgactttggagtagataaaccttgcagatgccaccttgaccaaattgattcagcattttttctgtcagaggaataagccaggagggatggtggggattgactttgaagctcatagttctggattacatctggaggtattatgaatttatttaattcaataacagatacagacagatacataaattatatgagatgcaggttaggatacatgcatgtattgcctagctgtgcacatgcatgggatctagaagcactgtaattccagtaaccataaacacactgcatgtgccatgcctcagtttctaaatattactctctaatgaaatgaaccaggatttcctggaaaaatggctgattctctacttgagacagggaaaatagaggataagcataatgcatattataatgctagaaagtagaatactggcaaaaatagaagttaaataaagatcaggttatatcagaaggacatgggacccaatctgaaagaactcacaacagccaaagtttgtacaatttgagcaaaaatatgcgtaacatagcgtgtgtgtgtatacatagatatatatcctatataaggtatatgtatatatctatagacactatattaaatataaaataaacatacatgaatatgaattcatactggtataaaaatgattatgaatataaatatatggcacagggggatcttccttgcagaggaattcagaataatatatgttgatatacctcctttcaagaagtggagcttaatatcactacttttgagtgtaggttggacttagagactcactttcaaagaataaagtacataaagtgagaaatagtaactttattttttatttgtttattaatttttttattactttaacttctagggtacatgtgcacaacgtgcaggtttgttacatatgtatacatatgccatgttggtgtgctgcacccattaactcatcatttacattacatatatctcctaatgatttccctccccccaacccagaacaggccccagtgtgtgatgttccccttcctgtgtccaagtgttctcattgttcaattcccacctatgagtgagaacatgcggtgtttggttttttgttcttgtgatagttggctgagaatgatggtttgcagcttcatccatgtccatacaaaggacatgaactcatcatttttatggatgcatagtattccatggtctatatgtgccacattttcttaatccagtctatcattgatgcacatttgggttggttccaatctttgctattgtgaatagtgctgcaataaacatacgtgtgcatgtgccttgatagcagcatgatttataatcctttgggtatatacccagtaatgggatggctgggtgaaatggtatttctagttctagatccctgaggaatcgccacaccaacttccacaatggttgaattagtttacagtcccaccaacagtgtaaaagcgtccctatttctccacatcctctccagcacctgtagtttcctgactctttatgatcaccattctaactggtgtgagatggtatctcattggagatttgatttctctgatgccagtgatgatgagcattttttcatgtgtctgttggctgcataaatgtcttcttttgagaagtgtctgttcatatccttcacccactttttgatggggttgtttgtttttttctcgtaaatttgtttgagttctttgtagattctggatattagcactttgcaagatgagtagattgcaaaaattttctcccattctgtaggttgcctgttcaccctgatggcagtttcttttgctgtgcagaagctctttagtttgattagatcccatttgtcaattttggcttttgttgccattgcttttgttgttttagacatgaagtccttgcccatgcctatgtcctgaatagtattggctaggttttcttctagggtttttatggtttcaggtctaacatttaagtcttcaatccatcttgaattaatttttgtataaggtgtaaggaagggatccagtttcagctttcttcatatggctagccagttttcccagcaccatttgttaaatagggaatcctttccccatttcttgtttttgtcagggttgtcaaagatcagatggttgtagatgtgtggcattatttctgagggctctgttctgttccattggtctatatctctgttttggtaccagtaccattgctgttttggtcactgtagccttgcagtatagtttgaagtcaggtatcgtgatgcttccagctttgttcttttggcttaggattgtcttggcaatgcgggttcttttttggttccatatgaactttaaagtagtttttttccaattctgtgaagaaagtcattggtagcttgatggggatggcattgaatctataaattaccttgggcagtatggccattttcacgatattgatttttcctatccatgaccatggaatgttcttccgtttgtttgtatcctctttttttcattaagcagtggtttgtagttctccttgaagaggtccttcacatcccttgtaagttggattcctaggtattttattctctttgaagcaattgtgaaggggtgttcactcaggatttggttctctgtttgtctgttattggtgtataagaatgcttgttatttttgcacattgattttgtatcctgagactttgctgaatttgcttatcagcttaaggagattttgggctgagacggtggggttttctaaatatacaatcatgtcatctgcaaacagggacaatttgactacctcttttcctaattgaataccctttatttctttctccttcctgattgccctggccagaacttccaacactatgttgaataggagtggtgagagagggcatccctgtcttgtgccagttttcaaagggaatgcttccagtttttgccctttcagtatgatattggctgtgggtttgtcataaatagctcttattattttgagatacgtcccattaatacctaatttattgagagtttttagcatgaagggttgttgaattttgtcaaaggccttttctgcatctgttaagataatcatgtggtttttgtctttggttctgtttatatgatggattacatttattgatttgtgtatgttgaaccagcctgtatgttgaaccagacttgcatcccagggatgaagcccacttgatcatggtggataacctttttgatgtgctgctggattcggtttgtcagtattttattgaggatttttgcatcgatgttcatcagggatgttggtctaaaattctcttttttgttgtgtctctgccaggctttggtatcaggatgatgctggcctcataaaatgagttagggaggattccctctttttctattgattgggatagtttcagaaggaatggtaccagctcctccttgttatctctggtagaattcggctgtgaatctgcctggtcctggactttttatggttggtagactattaattatttcctcaatttcagagcctgttattggtctattcagggattcaacttcttcctggcttagtcttgggatggtgtatgtgtccaggaatttatccatttcttctagattttctagtttatttgtgtagaggtgtttatagtgttctctgatggtagtttgtatttctgtggaattggtggtgatatcccctttatcattttttattgggtttattttattcttctttcatttattctttattagtcttgctagtggtctatcaattttgttgatcttttcaaaaaaccagctcccggtttcactgatttttttaaaggcttttttgtgtctctatcttcttcagttctctgatcttagtcattccttgccttctgctagcttttgaatgtgtttcctcttgcttctctagttcttttaattgtgatgttagggtgtcaattttagatctttcctgctttctcctgtgggcatttagtgctgtaaatttccctctacatactggtttaaatgtgtcccagagattctggtatgttttgtctttgttctcattggtttcaaagaacatctttatttctgccttcatttcattgtgtacccagtagtcattcatgagcaggttgttcagtttccatgtagttgattggttttgagtgagtttcttaatcctgagttctagtttgattgcactgtggtctgagggagagcttgttgtaatttctgttcttttacatttgctaaggagtgctttacttccaactatgttgtcaattttggaataagtgcgatgcagtgctgagaagaatgtatattctgttgatttggggtggagagttccatagatatctattaggtcagcttggtgccgagctgagttcaattcctggatatccttgttaactttctgtctcattgatctgtctaatgttgacagtggggtgttaaagtctcccattattattgtgtgggagtctaagtctctttgtaggtctctaaggacttgctttatgaaactgggtgctcctgtattgggtgcatatatatttaagataactcttcttgtcgaatttctccctttaccattatgtaatggccttctttgtctcttttgatctttgttggtttaaagtctgttttatcagagactgggattgcaaacccctgccattttttgttttccatttgcttggtagatcttcctccatctctttattttgagcctatgtgtgtctctgcacatgagatgggtctcctgaatacagcacactgatgggtcttgactctttatccaatttgccagtctgtgtcttttaattgtagcatttagcccatttacatttaaggttaatattgttatgtgtgaatttgatcctgtcattatatgttatctggttattttgcttgttaattgatgcagtttcttcctagcatcaatggtctttacaatttggaatggttttgcagtggctggtaccggttgttcctttctatgtttagtgcttccttcaggagctcttttagggcaggcctggtggtgagaaaatctctcagcatttgcttgtctgtaaaggattttatttctccttcacttatgaaacttaatttgactggatatgaaattctgggttgaaaattattttctttaagaatgttgaatattggcccccactctcttctggcttgtagtttctgccgagagatcagctgttagtctgatgggtttccctttgtgagtaaccagacttttctctctggctgcccttaacattttttcctccatttcaactttggtgaatctgccaattatgtgtcttggagttgctcttctcgaggagtatctttgtggtgttctctgtatttcctgaatttgaatgttggcctgccttgctaggttggggaagttctcctggataatatcatgaggagtgttttccaacttggttctattctccccgtcactttcaggtacaccaatcagacgtagatttggtcttttcacatagtaccatatttcttggaggccttgttcgtttctttttactcttttttctctaaacttctcttctcacttcattttattcattcgatcttcaatcactgataccctttcttccacttgatcgaattggctactgaagcttgtgcatgcatcaaatagttcttgtgccacggttttcagctccatcaggtcatttaaggacttctctacactggttattctagttagccatttgtctattcttttttcaaggtttttagcttctttgcattgggttcaaacttcctccgttagctcagagaagtttgattgtctgaagtattctctcaactcgtcagcatcattctctctccagttttgttccactgctggcgaggagctgtgttcctttggagggggagaggtactctgatttttagaattttcagcttttctgctctgttttttccccatctttgtggttttatttacctttggtctttgatgatggtgatgtacagatgggggttttggtgcggatgtcctttctgtttgttagttttccttctaccagtcaggaccctcagctgcaggtctgctggagtttgctggaggtccactccagaccctgtttgcctgggtatcagcagcggaggctgcagaacagcgaatattgctgaacagcaaatgttgctgccagatcgttcctctggaagcttcgtctcagatgggtacccagctgtatgaggtgtcagtctgccccctactggggggtgcctcccagttaggctactcgggagtcagggacccacttgaggaggcagtctgtctgttctcagatatcgaactcctgctgggagaaccactactctctttgaagctgtcagacatgaacatttaagtctgcagaggtttttgctgccttttgttaggctatgccctgcctccagaggtggagtctacagaggcatgcaggcctccttgagctgaggtgggctccacccagtttgagcttccaggctgctttatttacctactcaagcctcagcaatggtgggcacccctcccccagcctcgctgctgccttgcactttgatgtcagactgctgtgctaccagtaggggcagactgacacctcatacagcccggtacccctctgtgggtgtgggaccccccaagccaggcatgggatataatctcctggtgtgccgtttgctaagacccttggaaaagtgcagtattagggtgggagtgacccaattttccaggtactgtctgtcaccgcttcccttggctaggaaagggaattccctgaccccttgcacttcctgggtaaggcgatgcctcaccctgcttcggctcacactcggtgggctacatccactgtcctacccccactgtccaacgtgccccagtgagatgaaccgggtacctcagttggaagtgcagaaatcacctgtcttagtaactttagaatagagaaacccagcagacgccactgtaaccaagagggcaaggtatatgttaccagaaataagtcctgtcgttcctcaaataatgaaataagaaagatgctcatctctgtgatattcttcacaaaaatctttaaacctagtctaaccatggggaagcattgaactaaccaaaattgcaaccatctataaatcacctggcctatactgatcacaactatcaaggtcatagaaaacaaaacacctgaacaaaatgccatcgattggaagtgaccaagaaaacatgatgactaaatgaaatgtggcgtgttggatgaaatcttgcagtgaaagaagacattagtggaaaaaaggtaaagtctgaatataaagcctatagttcagttcatggcaatgtggcaatgttaacctgttaatggttatgtaatttgttacacttagaataaaatgggtgtaggttatagagtaattctgtgtactatacttacaacttttttctatgaaattatttcaaagtaaaaattcaattgaaataattttaaaatagcttgtgaaagaattagatttttcttttacttgagatcaattaatagagaccaaatttgccaccatgcttgaaacaaagttgtagtgctgctgcatttgaaagctcaaaataaaactaccttgattacaggcagtatggtcctgttgtaaaaatacacagagagatcataagaaaaggatagagagtacaaaattagacccaggttcacatgatcagttggttttcatctaagttgcaaaggcaattcattaagaaaaggattatctaaaaacaactggtagtagaacaatttgatatccacagtaaacaaaaataatctcaatcaacaattcaaaaattagctaaaagtgtattagagaactaatgtaaaagttaaaaccacaacagttatagaaaaaaaaatggaagaaaatatttgtgacctttggctaggcaaaaaattttaagttatgacactacagaattaaataagagataaaatattctataatgtttagaaattcccaaatatttgtaaattaagctatgcacaggaaaccacaaaataaatgagaaattatagataatttaaagataataaacatttgtaagatgaagcttagagggaaatgtatagccttaattttttatattagaaagaataaaaggtttatgataaaaacatcacctttcactctatagggccatctgaagaaagatttaatgtaattcaaggtaagttgaagaaaacaaataataaaggtaacagaaaacaaacataagatagaaataataaagacaaaagttgtttgaaatgatgaataaaacaaatacatctctagttagaattgtaaaagaaaataaacagaaaaatcacaatttgtcagagcaacaccatgaatactacatatatagaagtgtaaaaaggaaaaaaaataaacactattcagtaaagaaaaaaagggcaaatgaaatgaaatgaaaacttttattgaaaaatagaatctgctaagactaatacaaaaagaggaaatctgaatagccttattttgtttaaataaatgaaattgagacttaagacttcatcctttgcccctatacacaaaacacccccaggtacagttggcttcattagtcaactctactaaaactcaggaaacaattatacaaaacttacacaaactctttcaaaaaatacaaggagaggaaacattcccaatttgttgtacgaaatcagtatggccctgaatccagtattgtcaagtgctatagcagaatgaaaatgtattaaaattacggatctataacgcttatgatcacggatgctaaaatcttttatgaaatattgtcagatctcattgagcaatacataaaaggataacacatgttggccacatagatttagtctagaaatctaagattacttcaaaatacaaaaatcaatatatgcactgatcaatatatggctgatatatataatgtgaatctgtatgtatatatagttatatatgtattactgtatacagtttaatatataacctaaaatataggttgggatatgtgcatgtatttcctagttgtgcccatggacaaaatgtatcaagaataataaaaatcattgctaaaaagacaaatcagcccattaaaaatgggcaagtgttctgatcaaggacccaggcatgccactaaagaagatgtacaaattgtgaataagtacatgaaaaggcgctgacatcattattaatcaagtaagtggaaattaaaccatcttgggctaccacgtcacacccactagaataactaaaaggagaaagactggcaataccaagtgttgttaaggatgttgagcaactgaactcacaagcactgtgtgaaatgtaaaatggtacagtgcttccatttccaagaggaataaaatcaagtgttcatagcagtttttcatatctaaattgaaactgcacaaaattctcatgatcaaatgaatagataagcaaatggttttatatttatgcaatgattgctactcagcaatacaaagaatggaatactgatagatgcaaaaacagagctgaatctcaaacaaggaagactagacaaaaatagatatcaatatctatagatgtatggacacttccatatgtctgaatatagatatttagatgcatagctgtggtagtatttcatttgtttgctttctaggtaaattaatctatgatgatgaaaatcagaagagtgactgtgcctgagtgctatagaaatgttctgtatcttgatcagaggagtagttacaaagctatataggtttgctaaaactcatcaaactgtgtctttcatatatgagtattttattttgtttaaattgtccccccaataaacacttatatttaatgattacttgataattctttaaggtaaatctgattataaaaatacatattagtatacacaaaatacatattattcaacacacaattaaaaacttattcttcgcataattattattgtcttatcaaaaaaggaaggttaaatagagcagcaaaagcctttaagaaaattttaaattatggaatttccccgagcttgcagataaggtattattggatgacaaaataaaatgtgatatttaggacttttcattataaatcattaaaacggaggtaaaattcaagaattcagccaaggaaacaaaacaatgtgcagcttcttgagattgctactggtgctttgtttacagcactgagacctttcctgtcttgcacattcatagaaatgaaaataaagaaatccatagaatcgagaatgttataaaagtagttaccaaacctagatggaagttaactttttcaaaaatttctaaagaaatgttcattgacagataaaagcaataagtggttgttagttttggataagttaaatgtatattttcttttcccagggcattcctggcttatgtcaactgtcctggcaaattgtaaatacctcttcctatcactctcccaagtgacattgtttgggtggcaaattccatgatcatcttagtttgggagacctggtccatttagacatcaagataggcacttttggttcatttcttctactaagcagtaaagggttctcttcccattatcaggttcagattatggtagatccatgatatccaaagctttcttgatattttaatgtcacatggctggaattttagaaaattcttgaatttatatgaaatctattcatctttcacatatgtagtcttatttttagcctgtctcttaggaaataaaaaacaattgtacccatgtgcaaagtagcttcttgggtgggttctcaaaactttttaagtataggaagatgaccatcagagagcactgggcagagtccccagggattgacaatactcagtgaatgctatgcctatgatcatggagcacacacaggacttctatttagaataacagggtaatagtattagcttcaatttaataaaaacaattttaaatgcaaaataggaagtcaaagtttgttaattttcaactatgcaattattgaatacctacagacattttcctatttttccacgttgatttatgtagctggagttcattgtttttttctgttgtaatcaaccttccattgcagtaatactgcataatttgtttctctattccttattacattaacataacttttaattgattcaattttttgctatgataaagatgctttggtgaacagacattctggtaggccttgatgcacatgtgtaagaggatttttgttttttaagggtatatatctggtgatagaatcgctgagaccttggatatggacacctttaactttaataaataatactagactattttccacaattattttacaaatttatgttcttactagagtttacaaaccagttgctcctcttagtctcaagcatttattgtctgtgtttgcttctaatttgatggttgaataacgtgttgtgaacggaatgtgcctttgcctgataactagtgggcgttgagtgctttttgatgaccggccgtttgggttttttctcttctaaaatgcttgttcctgtcttggctccatgtttatattggattatttgacttttttctttattgacttttagaagatttttgactattttaaatattccttttttttcacttgcaatttgttgcagttatgttctatgagtttgttactaaactctttaggtatgctataaaccagtcttattttctgtccacttgaggcaatactttcaaacatctagattttacgtttcctggttataccaaatttctgcagtataaattatcttattcctattatttgcctactgttggcttaggacaggtttaggcattaggcttctaagcaagttactcatcatccatctggttttaaacttccaaaacattgttgtgtcctccgctgttctttgtaattattaatttgtgtttttctagtctctttactataatctcaatgagattttggtcaaaggaaaaagcaaaatgtgagtctttactattttatcatgtttatatagagaatattttcactatttgacatgtatatcaaaaaaggaaataaaatagtagtcattgttttgcagcttcaatgaaactaaaagccatacgtgtgtacttgagtatttgactctctcagcaattttattcagtacctgagcctagtgtttctatggagtgttcacaggcatcctctcattctacccttattcatttggtcccattggtcttacaggttccattatatatgacaaggaatcacagttcaaaaaccttaattatcttgttctggagtaccaccagcagcagttgaagaaattaaaccaagttcttcagaatccacctgcagctccctctcctactgaaaaatatacccaattacctaagttgggcccttacctggtagacttaaactgggagaaattttaattcagaacaataaaacagtagcaaactctgcatgtttgatatttatgcaggacaacatattgagtaatgtgtttgttggtttttctaataaaaggaggacatgctcttgggcattgcacttaattttctatgcagtttgtgtctcatcttctgagaaaaatttactaatctttagggttggaagaactatttctagataatactcacctggagccttatggaattgaattcaatttctgacacataaacgttgttacagcaaattgactttcaataatatctgaaatttttgtgttaaagggatgatataaacaatatctcttctaatggtaactggtaaccttttgttgacttttgagatgaatttgaaagggaaaatgctattgctttgaaacagttacctctttccaagaagaaaacctctcagttttcttaaagggtcatatggattgcttaagattagtcctcatcacttagaagcatggacattcttttgcttttctgtgctttcattttatatcacaactaggatagtttctaggatttacatttcattgtgaatgaaatgtaaataaaataacatagtgtattagtaaatatccctgaataacaaggcatgtgatttgtgatctgagtcataatatatttctgaaatctcccttagaaatactatgcatagctaattattgccttataatgtatcctatggattttgaacctgaagtcatactcatacttgtatcagcttatttgatactcatagggatcttgcagaagcacggaatagctgtagtacttttttgggagcacagaacttgggcatagaacatagactgtagagaatattttttgaaggagttttgaaaacaactggacacaagcctggaagaaggataggagtctgagaagtgtggggaaaggggagttcaggcagacacagccaccaatgagagggaccactgctgcaaagagaggatttcatatttagagaatggcaatgactttggaatagtaaaatagagaagatgatattttaatgtcaagacttatagatagatcattaaggacagtgaatattattctaaatgatactgattgtgtcctgaagatgatgatgatccatgaaagaacttattgttgaagaatcacatgatcacataagttgaaattttatgtttcaaaaagatgacttcagcagcagcgcatagaacaaatcagggattttatatggaacactatatgatcagtttttcatgattatggaaatctaagcaaggaaaagtaacaggataagctaaatgaggtagaaagacttaaggaaagtacacagttgggaaattatctggagattttagtagaacttgacccattgattgtatagggccaaagtgaaggaagaaatcaaatacgaagttcagtttcatggcttggggcataagagttgtgatgacactattaatagattacatggaaagacaggcatgttttcgtagggaaaggctaactttcagtgtccatgtgctgattctagggactttccaagaggacctgatagtgtgtggtgcatgtgttgtgtgtggtgtatctgttgtgtgttctgtatgtgtatctggagttcagagaaatctctggcctagagatagaatcagtgattggcccttgagtgcatgaggtaagtatagatttgaaagcccttgtctagtgagggaagcattcccacaaaaaaggtatggaagaaacagaaaagaaaaagaaaaagaaaaaaaaagtcacccaatcaaaacatcctggatagcagcaatatttaaggggcaaaaggaaagaccacaaattaggttaagagataattgtctttaaaaaaacacaattcattccctattttgcattaataaagcatataatcttagacaagcattcaaaatccttcacaacctggccgaaactgcttttagaagaatgaaagagaggggaatgatatttagggaaggagaaagagaagaggaaggaggaagagcaagagggagaagaaatgctgtgtgatttgtggttgaattgaattgtacagcgtcagggaaggtggagagcttgacttgactgccacttgcttggcaggacaaaataaggaattgagatagaattagtcaccctggttcttgtcagagcagctctgtgaataacctgagagcaggaaaatagtgtcacaaagccaatgggaagtgaggctgcccagagtgaaccctgcggcctgctggctataagaaagcaccggccgtgcgcggtggctcatgcctgtaatcccagcactttgggaggtcgaggcgggcgtatcacgaggtcaggagatggagaccaccctggctaacacggtgaaaccccgtctctactaaaaatacaaaaaattagccggacgtggaggcgggtgcctgtagtcccggctacttgggaggctgaggcaggagaacggcatgaacccgggaggtggagcttgcagtgagccgagttcacgccactgcactccagcctgggcgacagcaagactctgtctcaaaaaaaaaaaaaaaaaagaaaaaaaaagaaagaaaacaccagtccctagcagaacttcatcctccatcatgcttcccttcgttagcccgctggatctccagttgaggtgctatctaatctaggacatcaggataggaaggggtatttacgtcacatgtgtgaagctgagtcctctgtcctgattgacatcagcctggccattcctcatgattatgcagtgacgtgttctgctcctgccatctgctcccactgctgttcctggaggtaaacatgccccggctatcccagcttcagagcatgatcctcttactgcctcatgggagcctggacccagaaactttctcgcatattctatagcaaggcacagccgagatcaccatgaaatccttaggaagcctttctaatggctcagggcaaacagaaggggatggcatctggtgccatgtggctgcttccaggattcatggttccagtcttttcccatagagttgctaactacctgcttccataagcaactggctaggtcccagttcactcttcagaagagaggcctctcccttcaccctccagggaggccctttctggtctctctgtagattctatcaactgggaagaaagcaactctcctcaactcagccagttattccaccgccctttagtgagacagactcgtttcacccacagaaactaaatcccatattctctagttttaaattttgaaaactgtcttctcaaccataacctatataacctattgattagaagacgacttttctgtgtcgcttttactgttgcttccgagtattccaaaatataatttttccaaaatttatgtcttccagttataattccaagtttttttttttttaataaacaaactaagtattacaaatttctcttcaggaattttcttcttttttctttttttttttttttagacggagtcttgctctggcgccaggtgggagtgcagtggcgagatctcgggtcactgcaacctccacctcctgggttcaagtgattctcctgccacagcctcccaagtagctgggactatgggactacaggcgcccgccaccacgcccggccaatttgtgtattttaatacacaacaggatttcgccatgttggccaggattgtctcgatctcctgacctcagggtctgccgcctccacctcccaaagtgctgggattacaggcgtgagccaccacactcggcccatgaatttttttagtaaaattgatttgcttttataatagaagattatttagactgtagtttaagattctaaatggaacatgacaagtttaagaattcaaaaatcttcatcaatatcacttgttggatcctaccttttcaagataatgactacatctttacaattgctgcctttagcactgcaaattattgaactgacagactgaaatctatgggtttgatctacctcttgtatttgctttttcctcttatctctcttccattttaatgttcccattgatctcagagactttgatagaaagacacaatttctttttttttttttttttttttttttgctatctatcatcatgggcttgctgaatatgcttaaactatggtcagaagtaaaaatgaacagaaagctaatttttcacaatgcttgtctgaattggtcaaggagaatagaacattactctgctgctattcagatgctttgccatggctggtacagcgtgatgcacagttacaaagaactttgcgtatgaacatgttctgttccagtatcaaattctgaaaggggactgcttttttccagagaactggcaattctccattgacaagcatgaacagtggataacaaagcaaaccttgtttactggtacttattcatttaaagctctatcaggcaatctgactgaaatgatagttttgttctgcaaaatcaaaagatatttaaaattagataggttgttaagtagataatttttagtgaacacattttaaattactaggggatatttggttgcaactctttttgtgcatacaacatattacatgtcataatataaatttcacttatttatttgtcccttgttttctttccctgctacattcacagaccctagaagagcgcaaggtccctaatatgcactcaaatatgtagtgaatgtgtaaatagaagtaactcttcaaaatatgcaactcttatgttaacagttgggaaactctttggaaaaaatattatctccaactatgaattctactgttaaatacttattatgctccttggctttattaaatggtatggctatacaacatcagaagataaagttcattcttctgaatattactctaacattttggtcaaagaatgagtcatcccttatttataggtttttaaatttgctttcagcttattttatgtatgtcataaattaagacaatagtgactctaactcatagaaactatgcttccccctccccagcaggaaaaataatctttcatctcccacacacacacacaaaaaatgttgaattaggtgtcaggtgtttatactattttggatagaacagtgttgagttctgctttgatgagcttcacaggcatagctttgcttactgaaaagagagcaattagcttcatattgctcgatttaattaagtgaggtcaatttaacttaacatttagtctccatccccagccagagattcccattcaccttgctccagcaagttgtcagagtgagaaaagattaattttctatatcacagtgcagtcagtgacagagatgaggctttagcaaactgatgtttggatgtacagaaatcatttttgcaggtagtgatttattcaagcaagaatcaggaaaatgtcaaaacgtatccaaaaattattttgtgtcctgtatactgatgtttgctgtagagtttgttcatccttgtactcatctccagatagagcttttgtatctggaaagagtacaattgacttaatattgcttaatttaagtgaagcaattaaatttacgtcatcttcagccacggacactcatcgaccatgttctgcatattatctgcttgaaaattgctgccactatggccatgccatttttattttccttcttcagtgatttgcaactataattttcagatagtaacagaaaccctggattggaaaaccttagtggttcctaaaaagatcgagatatatgttgatacatacatttgtcatataaccaatgggcattactagttgaacctaaagtcgcattgtaacttaaatgtcatccaattatgctggaggcatcacactacctgacttcaaactatactacaaggctacagtaaccaaaacagcatggtactggtaccaaaacagagatatagatcaatggaacagaccagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcagcgacttggaaccaacccaaatgtccaacattgatagactggattaagaaaatgtggcaaatatacaccatggaatactatgcagccataaaaaatgatgagttcatgtcctttgtagggacatggataaaattggaaaccatcattctcagtaaactatcgcaagaacaaaaaaccaaacactgcatattctcactcataggtgggaattgaacaatgcgatcacatggacacaggaaggggaatatcacactctggggactgtggtggggtcgggggaggggggagggatagcattgggagatatacctaatgctagatgacacgttagtgggtgcagcacaccagcatggcacatgtatacatatgtaactaacctgcacaatgtgcacatgtaccctaaaacttaaagtataataataataataaaaaaagaaaaaaaaaagattaaaaataaaaaaaataaaataaaataaaataaaaaaaaaaatctttgaaattaggaaagcaaaagagtctgtttctaaaccaacttttcctatatgtcactcaggtattgaatcttgtgtatgtaaaacctttcatatcacattccttcaaatcacattgacctctctggaccgtgattatatgtaatggtcctgataagaaaatatatttggccaagtgcggtagctcatgcctataatcccagcactttgtgaggccttggcaggcagattgcttgagcccacgagtttgaggccagcctgagcaacagaacaaaacctcatcgctacgaaaaaaaaaaaaaatacaaaatacaaaaattggccagacatggtggcatgcgcctgtagtcccagctattcaggaagctgagatgggaggatcctgtcagcctggcaattcgaggttgcagtgagtcatgatcacaccagtggaccccaggctgggcaagtttgcaagattctatctcaaaaaaaaaaaaaaaaggtaaagaaaaaaagaaagaataaagtaaatttgtttcactcaagtattattttgagagagatttagaaagccattaattagtttgcatatcattatgattttttctaataatttaaaaattaccttagataagtattattttaaaatacatgattacttaatgaaggaatctaaattttaacttataatttgatgttatgtggctacttcttgtgctttatttctcttattgaaatgtaaaaatataatttaattacaattcctttaatttgtatgataacacttaagcaagttaaatcattaataatctttttctaaaatgtttaatatttcccaacttcctgaaaaaaatctacacatctttaggaaggaccatatttgtgaaaaattataattcctgactattaattttattgctacatacttcatacaaacacaaaccagtttacattgttaacataaagacaatcaaatgtaaataaggccacaaattgtagatttactattaagaccaagtcattccattccttatattactgccattaagtaacaatttgtttttttctctaatagtaaaggaaagaaaatatgtacctctcatctgaagatatgcacacacaaacacataaacagagtatacattataagatgcatttttcttgttttactttagtgtgatagttgacaaagacaaaaccttaacacatccgtgtgtgtatacatgtatatgcatgtgtatatatatatgtatatatgtatgttataaagcatattaataccaaaagaatctgtgaatctattacccaatataagaagtggagcatgacaactgtagtacacatggtttttactatatttgtattttattctattttcctttaagagataatacgagttggagttatattcaatatttcctttactttttaagaaacttttaagattttaattagtcataatttctaggaagttgcaaagaaatctacagagagatccagtgtacacttcacccaacttctcccaaatttaacatcttgcataactgcagtacctgattatgaaaagcaggaaactgaccttggtacaacccacagagttattcggttacacgtgcactcgtttttatgtataagtcattttatcatatgtatatttctgtgaaacttccatcacaactaagatatttaacttattaaataatacgccaggcagagtgattgtttcacatttttatatagatgaggagtattttaaaacacttattttctttctgtaacttttccatctttgtcatttgtggttgatttcttttcctcagtgatatttgtgtttcagggttttcaatgaacaataatttcaatgaataatttcagtgaataataatttatttcacaaaaagacatcatagggcacacagatggtatggttgtatctatattaaaagactttgaataactgacatcaatagtgtatttttaaaactcacatgtatactcatatttcacacttaaattttccagttaaattcctaagtcaaaaatgaagttcgacttctgcttctgagaaaactggagtaggagcaattctgcttcttcctcccacttaaatgcaacttaatatcttggacatcacatagagaaaaatgtataaagacctagaaagggagggagaagacagcccactcttagggagctcagaactgggaaggacatggtggcaagagccctggtatttcttatttgcctcacatattccagttggatagaaacttaaaatccctccgttattctagttccttgttaagtaatacattgattaacctaccatttttagatttttatttacttcattagctgtagtgaactcttctttggactgtctgtgttttggtttgtagtttttatttgatttcttcatttccctcacagtgttaagttaaagcctttgcagaggtcccaactaggagctgagtgtagtggcttgcacttgtaatcccagctacttgggtggttaaggcaggaggatcactggagccgaggagttagaggctgcagtgagttatgcactgagtgttcacccactgcactctagtcttgatgacagagtgggaccccatgtgtaaaataataataatgaagtaaaaataaataggtaatcgtggaaatgagggtggtaaatatgtaaacagaagactcatctagccattgaacttcctttccctttttgctcttcatatttgcacctggggctgtgagagtggtactttggacattgtgttctagttctaatgtctgctcacctctgtggctatagagaccaggagcggaccagcctcagtgacgacagcatgttgttctttaagtaatgttcctactttcacacctcaacattggtcctttggaacaaggttacattttttttaattcaagaggcttaatgtatatttattatttcataaataaaacccacaaatacatctatataaaataaataaatggagaaaatcagattagtctaaaattatttcacataaaataactaaggaaacaacctatgaaaaaacttaaaagatatgataatgattctagtgcaattaacattattttgacacaacatctaattctgaactccttatcatgtaaattaaaaaaaaatctggaatcacatgtatgacatatgtggggatacagtaataatagagtgaggcataagatttatctcgtgtattggttatctattgctgcataaaaacatgtagcaaacttagtcatttaaaatagtactcttttgtttcctcatagtttccatagccagaagtgcaggcatgacatatccagattgattctatgcagtctcacaatgctacaattgtagtgtcatccaggctgtgtttgcatctggaacttgggggttctaccaagcttgtgtaggtttgtggcaaaatccagttctttgcatttctaggactgaggtccccacattcttgccgcttgctggccaagggctgctctgggttcctaatgggcacctcctggaggacttgggcatgcaaccatctccacagggcagcctccctcttccaaaggcacaggaggatctgtcccagcttgatcctctgaccctttgtaggagctcccacctgatcgatcaagtatggccacccagttaatctccttcaaactgattaattcaaaattgactgatttgggagatgacagctacaaaatccttccacctttgtcatctgatggaatcttagaacaggagtgaaatccacaactgccacaagtccagtccacagccaagaggcatttcaggggcaagaatctgggggccatctgtattagtcagggttctctagagggacaggactaataggaaatatacatacatatatatatatttccttttacatatatataatgggagtttattaagtattattaactcacacaatcacagtgtcccacaataggctgcctgtcaactgaggagcaaagaaaccagtttgagtcccaaagctgaagaacttggagtctgatgttcaagcgcaggaagcatccagcacaggagaaatatgtaggctgggccgctaagccagtctagtcttttcatggttttctgcctgctttatatcctggcaaagctggcagctgattagattgtgcccatccagattaagggtgggtctgccttccccagcccactgactcaaatgttaatctactttggcaacactctcacagacacacccaggttcaatactttgcatccttcaatccaattaagttgacactgagtgttaaccatcacaccatccaagaattattcctagcacatctcacaagctttattctggttaagggttctcgacttagctgtgcttcagattttgagggagcttcttaaaaatgcatatttataggcctctatatgaatctgattcagattcagaattgaactctatctcctcagttataaatattattttcaataagctacagaagcaatgcttatggagccagcttcatccccttgagacttctgataaccactgctctattaaatataggcatctcacctgcctatcattgattaaagtatggtattttcaaaactacagttgagttcatgaggggccaagtaacataaacgggatctttaaaaactaaatgacaaaggcagaagcaccactctagcctctaaaattagcaatctgttgctcaagtcttcaattacagtatgttttaagaggtcagcctgccccccaccaccataaaactgagttaacagctaagtctcataaaaaagtaatcacttcttggcattaaatcaatagaccattcctcacaatgaatgcttttaaatattatcactaatttaaacttggagtctgattctaaatttagatccaagtgctacctactggcaaatgaaatatcctctggtactccttttgaagtcaatttccccaaagtgtgttctacagaacttaatcttgtggcattagtcatttggaaaatattacctcatttggtctctagataatttacagggatttgagctattcctagaaattgacaagaaagtgtggaaaattgtgtatgatttgagtgtaaatagcagtcttgtcttcctcatgggtaaagtagatacatttcggtgtgtagatttcatcacttctatttttgaatgctcataggacttatttttttttatttctgcatctagactgctctccagaatgttgagattgcccgagaagtgaccccagcaaaagaaaaatattgctgtacctaaattcaagtaagaccattactttgcaataacgtatcatgtgtaaattagtggaaaaaatcaactgtattagtctacacttctaagagacaattgttttctttgatattaatctttttgaagcttctttctctgttcttgaaaaatgacaaaaaaaaaaaacaaaacctcttgttatggaagcagtagaaatattcagaacgtatctccatgtttagttgtagttacacagcattttgatgtgtctttccacaatgtttatttaaacagctatgttgaatttgtgttgtttctttaataagcactatttataggaatgagaaaaatcatttagtttttcaaaaacaccctttattaggtgagggatctgtgtctcttcatgaagatggtaactggagttacacatttcagtgagctgcgattttctgagaagggcagacactcaacaatggggagtgggttgcgatgcttggcagggtgactataaactgtcacgttctcttttgtttgttcagaggaaggagtgaatgaggtgaaattagtacaatgaatcaaattccttcaggaagggagtgtgagtcagcatgggtgatgcaggtggatcaatgaccttgtagtagaataagtgttactttaggaaggaatcatacactatttgttggaaggaggtgaacgtggctagaaaaggttaggattgaagtcactaaatctatttttataataagctgtcacagtatttttgatagcttatgtccttacagtccaaggacttgtagtatggctttagtaagattcatcaaactcactgatatatgttgggtttcaatgagtgccagtactgaaaagtatactgtgtgcatatttatgtactcaattatacttaaatgtagtgtagaagtggcaagaatctttgagtgtatcatgtgttataaaaaccatgaaactttataactttatgtagccatgcagattgcctattaaagagatttctaggctgggttttcaaggactatggcaagttctgaggcactgaggattaagcaattaggcctcaaagttgtcctgtttgctacctattctgttagacatggaagccacattgtgctgtttcttgtcatggatgggttgctaatagattgatttccctcacccaatctgatccttaaattattcaggtagattttttaaacaattatctttttaaaaaattttactttaagttctgggatacatgtgcagaacatgcaggtttgttacataggtatacatgtgccatggtggtttgttgcacctatcaacccatcatctaggttttaagccctgcatgcagtaggtatttgtcctaatgctctccgtccccttggccccaactcccaaaaggccctggtgtgtgatgttcccctccctgtgtccatgtgttcttgttattgagctcccacttacacatgagaacatgcggtgtttggttttctgttcttgtgttagagtgttgcgaatgatggcttccagcttcatccacgtccctgcaaaggacatgaactcattcttttttatgcctgcatagtattccatgatgtacatgtaccacattttctttatgcagtctaccactgatggatatttgggttggttccaagtctttgctattgtgaatagtgctgcagtagacatacgtgggcatgtgtctttatagcagaatgattcctaatcctttgggtatatacccagtaatgggattgctgggtcaaatggtatttctggttctagatccttgaggaatcaccacactgttttccacaatggttgaactaatttacacttccaccaacagtgtaaaagcgttaaacagttacctttaaattaaacagtgtattttcatcattcatgtaaactcagaaatttccaaagcacattttccccaaagcaaaaataaccctttctaacgcattataaatgccattatatacccaatgttttcaagttatttttcattgctagaccttttttcatagttaaatatgtacttcaaataaaatctcataggggagtccaacagataaaagaggaaaaaagaagcattttttaaatttttttatttttatactttaagttttagggtacatgtgcacaacgtgcaggtttgttacatatgtatacatgtgccatgttggtgtgctgcacccattaactcatcatttagcattaggtatatctcgtaatgctatccctcccccctccccccaccccacaacagtccccggtgtgtgatgttccccttcctgtgtccatgtgttctcattgttcagtttccacctatgagtgagaacatgcggtgtttggtttttttgtccttgcgatagtttgctgagaatgatggtttccatcttcatccatgtccctacaaaggacatgaactcatcattttttatggctgcatagtattccatggtgtatatttgccacattttcttaatccagtctatcattgttggacatttgggttggttccaagtcgttgctatcgtgaatagtgccgcaataaacatacgtgtgcatgtgtctttatagcagcatgatttatagtcctttgggtatatacccagtaatgggatggctgggtcaaatggtatttctagttctagatccctgaggaatcgccacaccgaagcagcagcgagtgatctagaacttggctgctctgtcactgccttcatttcttctaaatccattcccattccccaaacctccagactaaatggatattcatatttctcctgtgattccttggtttctcaatccttaatttggaagcacttgtggaagaatcaattgaaggggacagagagcaaaggatggaagctgaaacttccagaattattctgggctagccatcagtggccaagctgttgctgtgtaagagggggtcatttattcccttcttagaatttcccagtgtcaggggctgctctgcatgctttcacactaccattgtgcaaaggtttcaaagtatcatgcacagtaaatcctgactaaagcccaataagagtacaggttatacatgaagaaatggagaaaggcagttgtaaggaaaataatggaaattcacttgagggcggctattctcatcctcaagccaccttcttctgacaatcctgaaaagtagttaatattttgttattttttaaaaaatatggctggatgcatttcaagccgtcctctttcttaaatatatctctttgcctcttcatgtttaattcatgctcatatttgcccacatttaaagctaggctggcttcacattggaattgaaaatagccctaggagcatgaggaaccctgagagcctgggtgtcctcagctgtcacaactgggtacctgcccctttgtgtttgctgccctctctgcctggctagaggcggccccaggcttcctgggcatttttaaattactgaaacaagagtattataataaaacacttaacattttaatacatagtttttttttgctattgttgcttttgtgtgttttggggatgtctgaggcctctgcccttgactgcaattggtccttctgctgtggcctgcccctctctgtgtcacaagttgcagctgctgacaggacgcaacttctattgccccatgtgccaccagaatcattgttcaagctcccagtactctcagacagatttgtgattgaagaatcattgacttcacttggaaatcatctctatttctagtgttgtctgtcacagataaaatgacaaattgatcaaatgcaagcaagcttagcattcagcccagtactgacttcatatcctgggcaactttctgaattcattctgactgggacccactgcctatttctcttgtttcctggatctgactgcaaaagcttcatgtagggaaggcaggtaaagtcctcagctagggcactaatagcagtgaggttcccctagactggaaaaaaaagagtgacttgcatttgtttgcttgttttatgtttccaggaaagttatatgacagggaagaaacggtagtttctccttgtgatctcaggattaactggtgtaccacaatgtataaggtccaaatgaacatttcagaaaaattgatcaactgaagggaacatttctgtagctccattttgttcatttcaaagactctcttagttgagaaaagtctagctacacttaaaaatagtcccttttattgttcgtattgtctaccctagtaggtatgaagggacttctggaagttctcaagttcttggtattgctttccctcatgggcagattaatctaggctgcttcagtcttggtgattccatctccccctgttcagtcaagagaaggtgggactgtgccgtgcaggtaaaggccattggcagcctctcaggactaaaagtgtgggcctgtatttgtgtttgtctgtgaagtagagtcacaagaaaatctttaggtcaccatcagacaactttggtaatacagggaaaagcaaaaaagtctcaaaaattattctcataaatcttgttgtgttaaatgctgcttatagtatcaaagctgcagaacagaattacagaaactctggagcatggcagctgaaatggtggagagaggtagtgtctccctgagagtgtggggccctcttgttcatatgactttccacatctgctcagtcctgccttctttccaaatttcaggtgtcttccttgccttcaggctggattactcctagtgatggctctcactaccccatggttatcttgtgtcagctgcagtcagtgcctcattcccgaacatccctgcttgcctccctctgtcctggatgcaaaagccaatcttcacttcaacctcaactattcccacggaggaggagttacagctgtacagtgtctgctccaacccgtgggacacacagagaccctggtttgctcagagaggctggttacagccagcaaaaagcacagaggcaaatgttaagaggcaaacgttgacaagtgaaacaggagtgggctggcttcatggaaacaaagacttacttagccttataaggcccctgcatacacagccccacacttaattgaacgctttgacctctttaacacttgtttaatttgcctacattcaaatgagtgctttgtgttgcagtgttctatgggtctgacaaatgcatatcatggaaccatcattacagtgtcatgcagaggagtttcaccacccaaaaatatcccctacgcttctcttatttaactctcctcattcctgaacccctggaaaccaatgatcttttcactgtctctaccgttttgcattttctcaattgtcacataattggaatcctacagtagatagcctttcagaatggcttccttcacttaacaaaatgcattttagattcatctatgtctcttggaggtttgatagctgatttttttcctaaaaatatggcattctgtggtatactccgatttatttattcattcgtcttctgaaggcagttacaaatacagctgcaataaaaatattcagaccttacataagctttcaaatccattggtaatgcttagtagcataactgctgcatcaagtggtaagctctgtagggaattgcaaagctgttttccaatgtggcaaaaccatttggcattctcttttttgccactgctgtcttctccttcctctacctctccctctttccattcctctttttcttcttctggtctcttcctcctctcttttttttttttctgtcactttctgtctctctcttcacacacgtgcgcgcgcacacacacacacacacagggatagtttaggaaattgttggaggttatctaacatgttagttttgaaattaacaagttgggaaaggccattatagacaatactaattaatacaaatgaattataaagagaagatacaatatgaagcctcttcctcaggtcccagtattagtcaatatcttcctctatttatctgcaaaatcaaacctatagttgtccatttctttcttcttgaacttccaggtgtccatgaattctataaccatcagctctatcagccttcttatgcatgttctgttcattatttttgttctttatcatatcgagatatatatttgcctcatcctataatctcacctttctccctgatgttatctctgtgtgacactctgccaaaaagacacactttcccttactaaaacgtttcctattttgatgtagtcatgcttgcttatttttacttttgctgcctgagctttcaatgtcatattcaaaataattattgctaagaccaatatcaagaaggttttccccatgttttcttctacaaattttactgcttcagatctcatattgaaatcatcaatttattttgagttgatttttgtgtgttgtataagagtccagtttcactcttttgagtactgattcccagttatcctaatgtcattgtgtcttctttgtggccttcccaaaattagttgaccatgtatgcttgggttgatttttgggctctctactctgttccattggtctatgtatctgtttttatgccagtaccatattgttcttactactgtagctttgtcatgtaatttgaagtcaggaaatatgataccccaaactctgttttcagctttcaagatctcattggttatttgagtctttcagggtcccatataactttagaatgtttttctgttcctgtgaaaatgccattgaaattttgactgagattgcattcaatctgtatatggctttaggcagtatttgacattttaaaaatattaaaactttcaagccataaacattagttattaaactaaaaaacatttgcatggaaaaggaaataatcaacacaataaaaaggtaatctatggactgggagagaatatttgcaagctatacatctgataagaaattaatactcaaaatacataagcagttcccacaacttgaaaggaaaaaagtaatctaattaaaaaagggcaaaatatatgaatagacgtttttcgaagaaagacatacaaatagccaaacatatgcaaaggcattcaacatcactaattatcaggaaaatgcaaatcaaaatcacagtaagatatcactttacatctgttaagatggctataataaaaatgacaagagataagaggtgtcagcaagggtgtggagggaaggaaacccttgtgcactgctgctgagaatgtaaattggaacagctattgtgaaaaactgcatggagttttctcaaaaaattaaaaacagaactactgtatgatccagctatcctactgctggttatatacccaaagaaggtgaaatcagcatctggtagaaatatctgcatttgtcttttctttgtagcattattcacaatagccaagatattaaaacaaccctaactgttcatagatggatgaatggataaataaattatggtatatgtacataatataatactattcagtcttaaaaaaggacatgctgacatttgcaacaacattgttgagcctggaggatattacactaagtgaaataagccataaacagtaagacagatactgtattatttcacttatatgtggaatcttaagtcaaatacacacaaacacagagtgcaatggtagttacttgggaggagagggtgtggaaataaagagatgggaatcaaagagtacaaacttgaagttatataggatgaattagtctagagatctatggtacagcatgaggactctagttcataatactgttctgtatactggaaatttctgaagagagtagactttaggtgtgcttaccatacatacaaaaaagaaagtaataaaacgtcttgaaactagatagaagtaatatttgcacaatgttgtgaatttactaaatgccactgagctatatactttaatcaattttattctatgtgaattttacctcaatgaaaagaaatgcaagagaaaatgggagaaaacagacttcctattatacaaaacccaaacataaatcccaccaccttcaacacattttttttaggtggcccatcctaattattccttttctatctttctatataatagcattttagattaattttgcttgcgtttcccaccagattgtgaagcctttttttttttttttttttttttttttttaacaaagttttgctcttgttgcccaagctggagtgcaatggcacaagctcggctcactgcaacctccacctcccaggttcaagcgactctccggcctcagcctcccgagtagctgggctaacagatgcacgccaccatgcctggctaaatttttttgtatttttagtagagatggggtttcaccatgttggccagtctggtctcgaactcctggcctcaggtgatctgcctgtttcagcctccctaagtgctaggattacaggcgtgagccactgcacccggcctgtgaactcttgaagagaagtcttgcattactccattgccaagagtacttctccctcctagtcacttcacacagccctgtctgaactgtgctctccaggccagcattgttggtggtgattgctctggacctcacttttagttaacttaatctgactcatgtcctatgcttttacacatgccccatccttaaaactcatttctttgtaccttgtgtgtctcagatcctgcatctggatatttggacttgatctttgtttttattttcctaatggagtttatcataaacttgactgtagttttattaattgctttaatataatttcagccttcttgcctttccaaaaacttattctccaaaaacaaccatttggttagcacgtgcatcagtcctacctccatgaataggtggggaagggcagtcagcagagtttttcaggtgctatttctgggctatacattctcattttataaatttaattgggtttaactggtacttacaatatttatgttttcaacaagttattttgagtatttaaggaagaaaataacactagtataatgtatactgtgataatatttaagggatttcatttttatttttaactgtgtaattgctagtatgcatagaaaaatgatgagaaaatgaagcaaaatttaatctgttaacatttctcagtgatggatagtaacatgtacaaagttatatgcttttgaaatgtgatattatcttttattctttaaaaagttcaatttgggctttgctgcatattatttcttaatatgtagaaaaaataagaaggaaagctattgattttcctccagtatgaaagaaaatcaatagtgcaagaagggccaattgaccaagcaaagaaacagttcccttgaaataaatgttgtgacagaatacaataattattctgctatttaaaaaccaagccagattttcaaaattattctacacttctttgttacagtatataatgtatgaactcaatggagcaagtggtgatatcatattaagaatataatattattttctaaagcaagatcaatacgaagatctattttagaagagtgtcatttgcagcatgagcaccccagtctaaatgcctaagggttgaagaggcaaagaataacacatatataataataacaccagtcaagtttatgcctttttaaaaatgagaatgcaccattcagctttgatatagatatggtgggttcttttattgccgattgcccttctccaaagttaggtggtgagataatggcagatcaacaactgtctcttcaggtttttgtcaactaatccaaatatttttatgacatgacattaaaccatttttatattgcagggtataaacactataagaaataaatctttagttgagtaacatgtaattagtaagctgaaagagataaataggtacaagatgcatgttactaaataaaatatattttatgtttatgagtacagatatcctaatatattagttataaaagtagccctatttgcaacaggaagcattttttcaagaaaaaaatgtgatttggcacgtgcgtgtctgtgtgtgtgcgtgtgtgtgtacaccagacatctcttaaaagctacttcagattctcttaatttcatcttttttggtcacttcttccagcttcagccactactgcagtggtcaagtttctggagtttgaaaaaaatttatgcaagcacaagtgaccagctcttcatcttaaacctgcatcccatatcactcctcttttttcttctgcctggaaattttctattgagatgaggcacaaacaaatgctatggaattaattgtccatgaggcaaatctctgacaacctggagactagagccaataaatatattattctcccctttatcctcagagacaccatcccaagatgatgtcactgatgccgcataccaagtggtggccaactttacattacatcctctcacggtttgccccaactgactgtaacgcctaatctgacccattctgttaccttgctcctccttgcttttcctgatctccactctcttataaaccactactcctttgctaggcatttcatcagaatgcattgcttattttcatactgatgacatcaacctggtcactcctgctcatttactcaaggttttagtgtttgactaacagtgtttctctgcgctatttctgtaagtcttacgcttccgcattcacacagaagattaattccacaccctggctttcagtgctatgctgcttccctctcagctatttgtgcatttgtctgcaggtgcccattccctaaactgtatgattgcctgtgactgtaccgtctccagagtctccgttttataactctatatcccattttttcagcccacttaccttagttatcctattccagactaagctgaagacttccagtcctcaaccctttaccttcaagtgcccatagcacgttatggcttcattccatccttatacaacttatattccataatacatcagtataatcaccatttacataccttcccagcgtttttgcctttctctccttcccacagcacatctggaaaaatcttaaccataattaaactaaatttctatctgcttccccaagtagcaaaatatgactcaaagaaaacatacaactatgctgatgagttcgccttcaacttgtgacccccaaacctcagcccagtcatgactcttacttatgagtcatcatttgtctgaatttgctatttatatctattttctctccaaactttcagcaaatgtcttttatcgctgtatttaataaccttgccttaactttactactatagcagcattaataaaaaaattacttatctattaagaaaatctaccaaactagctgcatttattcccgtatcccttcttactatgaaggaaatgtatatgctcccatcttagccaaaaatccttcacttttacattggattccattttttttccacccgcttaaggactctgcttctgaaattgtatcttacttattcaagtatcaacagtttgtctctctctgcttcatttgtctatttccattagaatacaaatatggttacatcttttttattattattattattttttgagatggagtcttgctctgtcgcccaggctggacttcagtggtgtgatctcggctcactgcaacctccgctgcccagattcaagcaattctcctgcctcagcctcctgaatagctgggattacaggtgcccaccaccacacctggctagtttttgtatttttagtagagacagggtttcaccatgttggtcaggctggtctccaactcctgacctcatgatctgcctcccttggcctcccaaagtgctgggattacaggtgtgagccaccgtgcccggcctacatcttaaaattaaaaataaaattcctcctttaactccacttattttggtagcttcagcctgaaatgtctgtttcctgcaatctcaatctcttttaaatggttgtaattatggtatgttttcaaatcttcacattttagtcacctttgaaactattacaaataggtcttaactcagcattccactgaaaccattcttatcaaacgagccaagggaaatttaatatgtgtcccagtgagtttacccctgacttgaaatatctccgtcattcagattcctttttaatggttaaacaatagatattagtgccccaaatgtaaaaacataaggattggtatatttttgaggaaaaaaaattaaaatgttcctagttcagtattaaatatcctttttgtggtatttaagtattattgactttgtaaatgacagttatttattactgtgaagattctcaatatttttataatataaaattatgattgttcttttttaacaaaacaaagaaaaatttgagattcttcttattcaaggttatactttctgacattgattcctctgaagatgacaaatgtcttcacaaggtaacagtgttttataatatgcttagaaaatagaatcaggttcatatggtttgcatctatgtccccacccaaatctcacattgaattgtagtaatccccacatgtcaagggcaggaccaggtgaagataattgaatcaaaggggcagtttccccattctgctctcatgataatgactgagtctcttgagatctgatggttttataagcatatcacataacccctgctggcactcattctctttcctgttgccctgtgaagaggtgccttctgccatgactgtaagtttcctgaggcttccgcagccatatggaactgtgagtcgattaaacctttttctttataaggtatccagtctcaggcagttatttacagcagtgagtgtgataatggactaatatacatgttgtgttaaaagttgtccaaagaaatactgcttaggtcaaaacctgatgctgccatttactagttgtgactcatttgacagtttcttaaactctctgagtaagttcccacatagaccatactgctatgataaatataaatgtatatgtgaaaactgcttaaggtcatatttatcagacaatataagcaaataatatatgttaattggttaagagaaatcacacctttttttactttaaagttcactaataattgtggaaaatattcttttttctttttcctcatcaaacttttatctattaatgtacatttctatgaattcatttttttctatattatacaatggaagataatataacactattgttttttattttatttatttttttttaattttactttaacttccaagatacatgtgcagaaagtgcaggtttgttacataggtatacatgtgccatggtggtttgtttgctgcacctatcaacacgtcatctaggttttaagccctgcattcattaagtatttgccctaatgctctccataccctagactcccacccccgacaggtctgtgtgtgttgttcctctccctgtgtgcatgtgttctcattgttgaactcccacttaggagtgagaacatgcagtgtttggttttctgttcctgtgttagtttgctgaggatgatggctgccagcttcttgaaccatgtccctgcaaaggacatgatctcattcttttttatggctgcatagtattccatggtgtatatgtgccacattttctttattcaatatatcattgatgtgcatttaggtaggctccatgtctttgctattgtaaatagtgctgcagtaaatatatgtgtgcatgtatctttatagtagaatgatttatattcctttgggtatatactcaataatgggatttcctatggtcaaagggtatttcttattctagaaatcaccttaattcaaatcaatcaaagtccttgaggaacactgtcttccacaatgtttgaactaatttacattcacaccaacagtgtaaaaacattcctatttctccacagcctcgacagcaaatattgtttcttgactttttaataattgttattctgactggtgtgagatggtatctcattatggttttgatttacatgtctctaatgatcagtgataatgagctttttttcatatgtttgttggcggcataaatgtctttttttttgagaagtgtctgttcatatccttttaacactttttgatggggttgttttgtttttgttttgttttgctttgtttgtaaatttaagttccttgtagattgtggatattagacctttgtcagatgggtagattgcaaagattttctcccattctgtaggttgcctgttcactctgatgctggtttcttttgctgtgcagaagctctttaattatatcccatttgtcaattttggcttttgttgcaattacttttggcatttttgtcatgaagtctttgcccacgcctatttcctgaatggtattgcctgcattttcttccaggttttttatggtttggggttttacatttaagtctttaatccatcttgagttaatttttgtataaggtgtaaggaaggggtccagtttcagcccaaagtaatttataggttcaatgctatttccgtcaaactgccactgactttcttcacagaattagaaaaaaactattttaaatttcatatggaaccaaaaaagagatcatatagccaagacaatcccatgtcaaaagaacaaagctggaggcaccctgctacctgacttcaaagtctgctacaaggctacagcaatgaaaacagcaaggtactggtaccaaaacagacatatagaccaatggaacagaacagagacctcagaaataacaccacacatctacaacgatctggtctttgacaaacctgacaaaaacgagctatggggaaaggattccctatttaagaaatggttctgggtaaactgactagccatacgcagaaagctgaaacaagaaaatgttatacttacatttttgtttaacttttacagtatctttgttaaatagattatgtgcttgggcccattttatagcttatagaattaaaaaaataagcaatatcaaactgcacaaacccatacatatataaactcaggatgctattgttttagagttttcatgagcataaaccaatggtcacatttcttttgctctgagatgaggtccatggtcagaaacaatactacgtacaatgccatgatatttgaaagggcattttattagttcatggatggtaattttgcaaaagcactgtaatcagggaaagcaaatcaatacctgtagtaagtattccactatgaacaaagctctgcccttccatgatggaagtggcccagtgaaaacaaccaggcagctggctgatcacccaggaagtggttccatgttagcagggactatatccaaatcagcccaggtgagtggaagacagtgtttttcagcacatacatattatccatcactgccaccttagccactttgtcaccagccaatacttggatatgatagtaatggctggtgaaagagcctggctgacatcaacagaacaggccattctattttcattattaaaatattggtctactgaatccacttattgacaatcattctcaaagaacacgaatatctttatggtgttccattcagtgaccattcagtgaggtctacccacatgctccttccctagacttccttgccaccaatattccaatcacgtttcttcaaatagtgaaccatacaggcaagccattggcttcagctcatgaatcattgtagtcccccatctttagccctctctgcttccaggcaaaatgaacaaccaggtgcactcatccacgttctgcccactgggaggattttcctttgcgattgtcttcaggaagaccctgtaggtgtggggctgcagtattgcagctgcccatctcagacagtacgtgcacatcattcagatccatttgtaaactacacaagagttttttcaccctcagatagtcatagggtactctcatgtgggttcaggtacaagctgagagagaaaaagcagtgtagcaagagtaagagccatgcacatttgggacacctcttcatgtaactttcctattccttcaaggtgtgcctgagtccactctggtaaacaccacttccatttgataatggagtactgcagtgcacacccaactgtgacttttgggggcaaacaatacacagttcacaatggactatctattaagtccctgtagcagaccaaaatctgtttctcaaaagcagagtagacgttcactgaggatagtaaggccttgatcccaaatcctaaaggcctgcactgtgactcacctgtagcaaccctctctgccactgacatttcaagttccctgaggtgtactctatcatgaaacccaagaggcagagcagattgcatagcagcctggatctgttcagagcccttttgtgttctgggcctcacccagcattagcaacttttgagtcactatgtaaatgggccagagaagcatatcttaatgaggtacacacttcctccataatccatggaggtctcacaggaatagcacaaaggtggaaaaacaacaacttatcctttacctagacaaggatattttgacaatctccaggccactgggccgtggaaactttgaaagacacataattaagccatcagaggtattatgaatttaaggatgaaattaatgggatagaaatatagtactttttattgttatcctatgtcattgtttatttttttttcagtagtctttgacatcataaagcagtggttctcaaaagtgagcatacaatggaatcacctggatatcttgttaaaactctggttgctaggccctaaccccagagtttctgattcggtagatgtgggaaggagcctaggaatttgcaattctaagttcccaggtgctgctgatgcagggaccacactgtgcaaaccactagatggagaaagaagtggatgatttatggtagaaagcaagttataagttgactgtaatatgatttgtccctgataactctctgttttgtttctgaatttgttctgtgggtaaaggatactctgtgtaaaaggaaagttaacaacattcaaactccaggtaccaagtctgctgtaagaccacacagacctctgtgtcaagcctccttgtgtctaggtgctgcatggcatttacacagcagaacagaacatttaatacatttcagaagagataaacattttagtataaatatttagtattttaggcataaaatatagtgtttttcaaaaaactataaaaatagagataggattttaacttgatttcagtagcacatctaataattgaacttttttgaatcccaattctaaattctaatctaagttaaattctgatctaagttaattcttctctagaacacgtttgagtgaagattattttgtgaacaatgggaagacaattgcttgtgttatagatattccctattttctgtttgaatgttgattactcataagtcatttggtagctttcattcatttattaatccattaaacaagcatgtactgaatacctgctatatactaggttatctactaggcactggaattcaaagatggatacggtataattcagcctttaaggagctcacagtctactgtaactgagtcttctcagagaaaggccagcattctgcttctgattctttctagaacaatattatatttcatagaatatgatatttcatgcaaaatacagctgttaaccatatttttatagttattacctccctggattgaggagaacagtcagaacaaaaggtggtaatatttatatttcatattttctgcttttaagattatatttcagatttattttcactcaatgtgcccaatttaagtctattgttgataacattgataacatcagtaaggttatgactttgcaatcagtttgaaatgcatagctccagttgatttaaatgatttctctttgagaaaaaaaggtaatgaattggccgtaactaattagcatgccataaatcatcacactggtgttcttttctacttgaatacctgagaaaggtatactaacagaaaatactctctttctctttttttaagtgtttgctagtgccttttagaggtaaattgtttcaataaagcttcttgcacacacttgcagaacctttgaaagccattttactacctcctgttgacaaacagcaagatcctccgcacatcacagaggtgacatgcttggtcatttgggggtggatagtggaactggttccctgtgaggaagcagccacctgttcactctttcagtaggtgaagcaaaacagctagagcatatgaagaaacaaggtggaatgacacgacaataagaataaattgggcttagatagaatggtgcaattatgctacaaacagcttgcctttcattgccataaattatgccgggttatagtattattttctggataagcacttcgctattttttctttcactggtcttctttttacattttaccattcagaattctctattttcatcagtcttgccatatatcatacttacgtagccttctgaaagctccaaagtttatgagacttttatgtcaaatatgttaggctgggttttgtttatttgttatttatattatgctgtggtgtttctgggataaaatcctctctgtcctcactataagcattacatacagccatttggtaatggtaagaaaactaagattttattgtaacagatattttatcctttttttggttcatcagaagcagtattgaagggcaaaaggagaaaaatgcttggcaaatcgttgctaattttgaaatattgggttatcagcataggatgctctaatatgccaggtgaatcagtaagtagtgttccattgattcacaagagcactactggaaatagttcggcaaatcatttgcctcactatctttggttaatcagctgtaatttatgttgagaaacaatcctctaatacagaattatgaggggaaactgttcttgttttttaaaaaaataaactttaaattctgggatacatatgcagaacatacaggtttgttacataggtatacacgtgccatgctggtttgctgaacctgtcaacccatcacctaggttttaagccctgcatgcagtaggtatttgtgctaatgctctacctcccctttctcctcaccccacaacaggccccggtgtgtgctgttcccctccctgtatccatgcaaggaacgtgttcttgagatgagactggtgataccaatcaccattgaatatttgtcctctcagtatattgtctcagttagcctatgtatgatgggacaataaaagggagaatttcatggtcaataactcaaaagcaaatgtaataaaaacaaagaaaaatagctggggcctaattaaactaaagagcttttgcacagcaaaagaggatttccaaatatcaccatattgtttttacctttccgtgtttactggacttcatggagtcagagaagccacagagaaggcttccgtgtggcctgatttattgagagccctggtgtgcccagtgggcatcccaccctgagtgcagcacaagaaagccaaatctccaaaaagcttttgttgttgttttgttgtttgttttgtttgtcatatctttttaaaaagaacaaaaccagaagcagcttggtattatcagattccactggcctgggatgttggagtctctggctcaacaactcatctgctttttaggtttgagaaatttacttgctttctttggtccttagttttttcatctgtgaaataaggaagttaggcccattttgttgttacaccatcatgtaacatttccctgatcattattgatgttgagcatttttttcatatgtttgttggccatctgtatatcttcttttaagaattgtctattcatatccttagcccacattttgatgggattgtttgttttactgatttgtttgagtttgttgtagattgtggatattagtcctttgtcagatgtataggttgtgatgattttctcccactctgtgggttgtctgtttattctgctgacattccttttgctgcataaaagctcttcagtttaaataggtcccagctattttttttttttaattgcatttgcttttgggttcttggtcatgaaatccttgcctaagccaatgtctagaagggtttttccaatgttaatttctacaatttttatagttttaggtcttaggtttaagtccttaatccatcttgagttgatttttgtataaggtgagagatgaggatccagtttccttctcctacatgtggccagccaattatcccagcactatttgttgaaaaggatgtcctttccctgttttatgtttttgtttgctttgtcgaagatcagttgactgtaagtatttgggtttatttctggattctctattctgtttcattggtctgtgtgcctttttttataccagtaccatgctgtttgggtgactatggccttatagtatagtttgaaatcaggtagtgtgatgcctccagatttgttctttttgcttagtctgctttggctgtgtgggcttgtttttggatccatatgaattttataattattttttctaattctgtgtagaatgatggtggtattttgatggggattgcattcaatttgtaaattacttttggcagtatggtcattttcacaacattgtttctacctatccatgagcatgggatgtgtttccatttgtttgtgtcatctacaatttatttcagcagtgttttgtagttttcctcatagaagtctttaggctccttaggtatattcccaagttgtttttttgttttcttatttgtttgtttgtttgtttttgcagctatagtaaaaagggttgagttcttgatttgattctccacttggtcgctgttggtatatagaagagctactgatttgtatacattaatcttgtatctggaaactttgctgaatccttttatcaattctaggagctttctggaggagtccttagggttttcaaggtaaaggatcatatcatcagcaaacagtgacagtttgacttcctctttgccaatgtggatgccctttatttcttccttttgtatgattgctctgactaggacttctagtactttgttgaagaagagtagtgagagagtgcatccttgttttgttccagttctcagagggaatgctttcaacatttccccattcagtattatgttggctgtgggtttgtcctagatgaccttcattaccttaaggtatgtcccttgtatgctgattttgctgagagttttaatcataaagagatgctggattttgtcaaatgctttttctgcatctattgagatgatcatgtgatttttgtttttaattctgtttttgtggcgtaccacatttattgacttgtgtatattaaaccatccctgcatctctggtatgaaaaccacttgatcatggtggatcatctttttgatatgttgttggattctgtagctagtattttgtttaggatactagcaaatacattcatcaaggatatcaatctatagttttcttttcagttatgtcctttcctggtttaggtattagggtgatgctggctccataaattgaattagggaggtttccttcttcctctatcttgtggaatagtgttcaataagattggtaccaattcttatttgaatgtctggtagaattctgctgtgaatccatctggtcctggacatgttttgttggcaattttcaaattagcatttccatctccctgcttgatattgttctgttcagggtatctaattcttcttgatttaagccaggaagttgtatttttccaggaattactcatctcttctagattttctagtttatgtgtgtataggtgttcatagtagccttgaatgatcttttgcattccagtggtgtcagttgtaatatctcctgtttcatttctcagtgaggttatttggattttctctcttcttttcttggttaatcttgctaatggtctattaattttatttatcttttcaaagaaccagctttttgtttcatttattttttgtacttcttttggtttcaatttcatttagttctgctctgatcttggtaatttcctttcttctgctgggtttgggtttggattattcttgtttttctatttccttgagatgtgaccttagaatgtcagtttgtgctctttcattttttttgatgtaggcacttagggctatgaactttcctcttggcaccgcctttgcattagcccagagattttgatagattgtgtcattattgtcattcagttcgaagaatttttttacttcaatcttgattttgtttttgacccagaagatgactctttctagaaagcatcagctgtagtagtgtacagagagacaggcggtgggcagggccctagaactcacaagattatatgccccttgtcttctgctaccaggatggatagggaaggaccatctggtggggacagggctaggcatcactgacctcagtctctacttgggcagttcttgctgtggctgctgtggagaatgcaagtgaggttcccatgtcactggagttgtgtacctggaggactatggctgcctctgctgagtcatgcaggtcatcagggaagtgggggaaagccagcagtcacaggcctcacacagctcccatgcaaacctaagggctggtctcactcccaccgtgacccccacaagaaccctgagtctgtttccaaggagagggcatgatgggcttgaaaacttgccccgggatacctgccttccagctgtgaaagaaaagggcttggttcttcccccatctgtaaagtctgcacaccagatttccatcctccctggatttctggccaggaggtttctcgccccgttcaaattgttacaaaattcagctagagatttccttctccctgtggagttatacctcctgctcctctggtcaccctcccaatggatccctgttatgccaggcaagaatggcctgctaggggatgcggcaagctcccagggcctttctgcttcttcctctacccctgtatttcacttagctctctaaattgactcagctccaggtaaagtcagaaaggtctcccgcaaacagaccttcagcttttccactgggggtgtgtgttctggagagaagggtctccctttcccacttctgcagttgtatttggggtgtcttctgggtcctacaggagcagttcacttccttcagagggtctgtgggtcctctcagggctgttggtttgttcttgcagtcggcctggagctaaaattcacaatgagagtttgcgcaagctgctctgtctggaattgcaactagtcctgcctccggtcctccatgatgatgattcttgagatgagattttaatatcaataattttcatggggatctttatccatccaaacatatgaaagtggcttaactggagtaaatttcaggaattatttgggcttaatataaaaactatccttttatgtaatgtccttagtctgtttcacactgctgaagttgatggaattgtcccaggaaatcactgttgtataaagtctaatgattctctatctgagttgaccagtatccattagagtttttgacctagtgtcaaggcaaaagcacttaaataattgtcagaaggcctggacagaagaccctgatttgccattttatggctagcaactggtatctcgtaatccatgcaactgtctcagaattaacaagtacatgagattcttatgaaagcctaatgaaatgatttgtgaaaactgcaatgcacaatgaataatcatgattattaaagataaatttagaatatttgtagaagctgcctttaaactctctttttctcttctttaagccgtgtctacttttacagcaagtgtggatggttgaaggatctctctctctcatttgttttggattatttggatcaaagcattgtctgctttcttttttaatttcattctatgtagaaaagtactcttcatagaagagcaaggagaaaagttgtttggggccagacttggcaagtagatgtgaacattcttgatgttttaaaagtagcatataggctgggagtggtggctcatgcttgtaatcccaggacttcgagaagctgaggccggtggatcacttgaggtcaggtgtttgagattagcctggccaacaagctgaaactccatctctactaaaaatacaaaaaaaaaaaaacaaaaaaaacccaaaacctagtcaggcatagtgatgtgcacctgtaatcccagctactcaggaggctgaggcaggaaaatcacttgaacctggtaggtggaagttgcagtgagctgagatcatgccacggcactccagcctgagtgacagagccagattctgtctcaaaataaagaaagaaagaaaaattgaaagtagcatacagagagagaaagaaaacaggaatttttaaaataaaagataccactttgctactacttggtttattttcttgaaaagtaggaactggaagagtaccgaaatttagcaaaaatgattgttatttatttccatatttatttttctttgtggtcttcacttgcaaatagttgaattaatcatattatttggtctatggaaaacatcaccactggcctatgcaaggcccgcctgattatacatttatgtgtatgtgtgaatatgtaatatgtacataaagatatatacattcaaatacattcctgtaagcagtatttctgttgtctgtttacatacattttaggattgcatagtttattgtgctctaatgctttctcattctattgtacttttgctcagcatttttttaaaaacttgtctctgttaataggtgcaccttttctctatcttttagtttctcagtattgttctccagagattgactttgagattgcatccagggccttgtcatcacaggataacaccagaatgaatatccttgcatactttcccttgtgtgagaatatctttggaatatttatctgtgatctgactttctaagattttcacatgcttaaattttgtattgccagattactgtccagagtggcaagctacatatcactaaaaataaggatattctactttatcattttaccttccacattgaggtttctgatgcatctcgtttcaaacttggaacatggtgttatgcaggtacacagttttatcatttttccctagtagtaaacatgtcctagtaccgtcttctaaaccatctatttttcccgttggttttactggcatatttattatattttctttttttattttaaaaattatcagtctttattctcatatgcagttcaaacaatacaatttaacaattctaagacattattttcaattgtcacttataaattgaccattcttaaatctctctcttgtgttctgttggtgtccacttccctaccaatgtcattatatttatttccgtactttgcagtttatctgcacatttgtcttcttttcagaatgagccccatatcagatagcagcctgtgcccagagcgcaggtgaagtctcccatttgccgcccctcagcaggtgcatcctaggccagtgacttgactttagactcagaaaaaaacagcatctgattgggagggatccagctgggagaaagcagtctcccgggttgaatccgccggctctgaaggtggcagtggggagaagggaaataaatgccctttggcgacttgtcctgctaatagcgtttttcctttcctggttttatcatgccacaccatcagtttgagttgctgattatttctctggaaataggataggcaatcattttacaaggcaatatggggcaagtaaatcctgaagcagaagatttttctccagccttgacacagtcctcaggcagctacagagcccaaatctgttcctcaaatctacagggctctgcaagccctgatgatttacctttgtgacaggtgacagacactcaggaagttcataatagggaaggaggcagagtgattaacatcagcagcaaagtacagtaaagcatccatttcttttttaaaatgtcatactttcttttaattaacaacttgatgccttgtagaatttttaggttcagaagctagcaagtacagctatgaatgctacaattcaaggaatcacagtgtgtttccacaatcatttttccataccagccaatacactatgatcttggacttttttggcatcacaatcattaggaggttcaagtcttttcgtagagtatcaacagtatgaaagaaagggacctcaaagctaaaatccctgaattaaagtcctacttccagtgcttgttaaatgtgatcctggtcacactgtttttatttttggtggaagttgtaaatgaaatgcttacacagggaattagtactgaatatggttagcattatctcacctgggaagtcaggagcaaaagtaatgtcatcaggctcagatttggaatgcattctctgggatgaagacggtggaagatagtttcttctattctgtaaaagtttttatttttctttgcagtgtttttttttaaaatcacagtttcttgtgattagacaaaactgttgaatgttgaaacacaacgattaggacttaatttccttttttttttttttttgagaccaagtttcactcttgttgcccaggctacagtgcaatggttcaatctcggctcactgcaacctctgtctccccagttcaagtgattctcctgcctcagccccccaagtagctggcattacaggtgcccaccactacacctggctaatttttgtatttttattaaagacagtgtttcaccatgttggccaggctggtctcgaactcttgacctcaggtgatccacctcctcagcctcccaaagtgctgggattataagtgtgagccactgcgcctggcaggacttaacttctgatgtgctcatagtaaagcaaatcaaccaacgtggagttgagcccaaaattgtgttgaagcaattctgagaaatatgtggcaggacaagcagaccctccttgtgagtacagattctaggaaattatgacgacgctgagtgcaggtcgtcagctgccctgttttggtgcatgactgccttatctacaggatagtatggaacctggtggatgtagggtgcgagtcagccaacagctgttccaatcttccagtgggccttatcttagcagagagtgcaaaatacttcttgcacgtggtttcagtttcatcagtgatttgatctgtagggaatattgattctgaagtgaatgacatggataaagaaacaaaattagggaacctgtattgtgggtgtggattttagcaagcatttgggcgctaataggatgataggcaaggagtgcaattagctatttgtatcattcccccaacaaattggtttttcttttgagagtctgaataatataaatgcttaccttcatgtgcctacctggttgttttagaaaggtgtatgtgacataataacagcaaatattttcttagcccctgcttcctgccagacattgtactaagcactttgcatataatgactcactgagtcctcaaacaactctgtgaattaattcccgttagtatctccactttacactgaaaaaacaaggcatcaaaatgaaaataattttccaagggtcgcattgagcaagtgctggaagtggaagtgggactttatctcaggcagtttagctctgaagtctcctcacttaagctcctgaagactatgacatcagaaaatccaaggtcacaatgacttgagctgtggagaaagtaaatgatcatagaaacagacgttgattccttgggttgtagcattaatactcgaaactcaatccccagacttgggctaaaatgaaaagtgtagcaagcagaaatcttctctgtgtggaaagatgtgtacttgtaattctctgctctctcttaaaatctggcctgttccatccaggcgcttactgaacaaaatgccatctacaccagggatgcccttcctcaactctagtcaatttagtcaccagaagcacaagaggagcaaggattggaagcatttgagcaaggatacctcaactgatgacagacactagaaaggcaatttcagaatgaatcacgataaatgaaaaccaaataggcctctgtgaagggaaggggaatgatccatgcaatatttatacatgtgtcagtgatatttacagcaaactagggctaaaaaaagtaaaacaaaccaaaaaaaacctctaagtataaaaagaataaatttgatgtaaataaattgttgactttgttcttcacagtggctaccactatgaatccagtgtacaaatcttaatttattcccctaaatcagagaaggggcttatgttataaatcaaaggaggggctcattcattgtcttttgattttttattttaagcattaaaactttctctaacatcatggcttgctttgaggtatactgatggaatacttcatgaaaaaaacaatatgttatcaagtccttctcaagattaaaaactagaagtttaaaggaggtaacatacatcttatagccatgtgcccaggatcagacaattaataatgaagtttagagttttctcatttatctgtaattcccagaaatttaagtgatattttgctataataatgtggctgaaatctctctttttcctaagaaaactgaattcctttcactgtgatttttaaacataatttaatatttaaaactgttttagatttaaagaaaaattgaaaagataacacaaagagtttccacacattccacacaaagttttctgtattattaacaccttctactagtactgggtatttgttacaactaatgaaccaatattagtatgtcattattaactaaagtccatggcacatttttaaaatttattttacttttatggagcactttcttcctttctagcgctgcgtgacactccatgatcatcttgtttactttctgagttctagaattagccatttctctaaggagccttggtttattttactgaacactgatactagaaatcaggaactgggtgttatgtgtccttgtagctcttgatgtgcttttcttttagacaatctcagcaaacataagtgtgtatattcattggcttttaaacagatatttataaatatttttgtatatatccatttgtatctatattcagctaaacatgaattgataccaatgacctcaactctctaatctatcaccacctgaatcatttagcttcttcttgtctataaattttcacttcaatagttagaaacatggctcccaccatcaaacagccatttactgatgtattcaattctagaatacaagtatagcaatatgaggatttttaacccacgtctccatgggcaacacctttatcaaatacagcaccgttcttatgtgccgttctttttgcatttagccttatagacaatccttctttccagagttacttaggtcagcaccttttcttcccaaccccatcaatgaggttgtttcatatatttgtaatacagttagattttcttatcatggtctgaattccttcctgggatacccaatcctcctttttttaaatttgcatgtattaattttcactttatgttctgtaagttctatggtttttgacaaatgggtagggccatgtatccacaattacatatcatacagcacagtgttaatgttctaaataatctcctgtgcttccttcctctactctcctgtcctcccctccttcccctgatctctcttggaattactgctctttgtatcatctttatatctttgcttttccagggtgtgatataattgaaagcatacagtatgtagtctttttccaccgattctttcacttagcaatgtacagtgtttcctcagtgcccttttacggcttgatagtgcatttctttttactactgaatactgttctattgcacagatgacccacagtttttttatccatttgcttattaaaggacattttgatactttccaatttttggcagcagagaataagttgatataaagttatgtgcagtattatctatggaaataagttttcatttaatttgtaaggagagttaaagtaaatttaccctttttcttctaaaggtaagcattccctcacctcccattcatggcttctttcaagactttctctttgttttgtttttttttttttacagtttgaaaatgttatgtgtaggtgaatgtatttatttattattttactatttatactgctctgtgttctctgtgtattctgtttttttgttttgagtagcattaattttggaaagatctcaatgactattacttcaaatatttcttggttttgtctcctttttcttttgatattgtcattacacatatatgacagctttgaaactgtcccaaagttcttgggtacttcttctttctcctccttatcctcttatttttctccttcttcctcttcattatatattttttgctttttccatttcagttgggaagttcctgttaacatgccttcaagctcactcattcttttctttgccacgtctaggattctgatgaatccatcaaaggcatgtttctgtttcagagtttttcagttctagcattttccttgaatttttctgagagtttttatttacattacccatctgttcttccatgctgaccactttttccagaagtgttaactttagggctccagcagcccatcctccaggtaagacaatctcagctgtttctctgtgttcacctgtctctgcagatttcaggtgacagtttggcatgagacttcagttctttaatgggcccaagaaaagccattaactttcagtgcattcatattttttcttgttgtaaggagtggagtagctatttctaagattttttatacatcagacgtgaaagaaacatattgtattttttttaatagcagcatttcggctccttacttagtggttgttctttgtgtgcagaaaaccaagcgaaaaaaatgtgaaacatataccttttatttgggcatttgtaatggttctgaggagctgaaattgaagcttagtttcgtattaatacaaaatttcatccattgtactattattgtcattgctatgtggcagaattaaatatgtgtgtgtgtgtttctgtgtgtgtgtgtttctgtgtgtgtgtgtgtgttcgtaataaaatcttgttatatttgtactgaagaataatgtaagacttttagtataaaaataacaatgtaggatgactagaaataactgcaacgtcaatgcattttttgtagcaaatctatattttttcaacctaaaagttatgttgttattgatgagctctgtaaagggcaactctgcttttgtgacctgtcagttttataaggtgatgaaaaatgcataatgataccccctggaaaaatttagtagatacattttgtatacagacatagaatttagtgtaaattaaacaatttactaatggactgaaaaagggaatgggaatgtttgatttcctcaagttttggtggctaagagactagccatctaccttacagccctccgaagatatgtgccaagtaagatttattttcttcaagtgaagaacttttcattatttttctatttcataatatctccactctacctaggtctgtactagatgtatagtacatatcttttttttgtccagtaaatatggcactgaaatgaattgtagtcaacactcagtatctgggcatgaattatgttccaagtagattatcttgatcatgattttctgtcttttccttgccaatgtgtctgtaccttgccagacaatatttgtctggactagatatcttccaaataaactgcaagttcattttgtatagcatattaatctaggaattgcataaatgtaaatttgttgaaaatacatctttgaaaataaatttatttaatcttaaaataagatataaattttttattatacttcaagttctagggtacatgtgcacaacatgcaggtttgttacatatgtatacatgtgccatattggtgtgctgcacctgttaactcgtcatttacattagttatatctcctaatgctatccctccccactcccccaaccccatgacaggccccggtgtgtgatgttccccactctgtgtccaggtgttctcattgttcaattcccacctatgagtgacaacatgcggtgtttggttttctgtccttgtgagagtttgctgagaatgatggttcccagcttcatccatgtccctacaaaggacgtgaactcatccttttttatggctgcatagtattccatggtatatatgtgccacattttcttaatccagtctatcattgatggacatttgggttggttccaagtctttgctattgtgaatagtgccgcaataaacatacgtgtgcatgtgtctttataacagcatgatttataatcttttgggtatacacccagtaatgagatggctgggtcaaatggtatttctagttctagatccttgaggaatcaccacactgtcttccacaatggttgaacaagtttacagtcccaacagcagtgtaaaactgttcctatttctccacatcctctccagcacctgttgtttcctgactttttaatgatcaccattctaactggtgtgtgatggtatctcattgtggttttgatctgcatttctctgatggccaatgatgatgaacattttttcatgtgtctgttggctgcacaaaatgtcttcttttgagaagtgtctgttcatatcctttgcccactttttgatggggttgtttgatttttttcttgtaaatctgtttaagttctttgtagattccagatattagacctttgtcagatgggtagattgcaaaaattttctcccattctgtagggtgcctgttcacgctgatggtagtttcttttgctgtgcagaagctctttaattagatcccatttgtccattttggcttttgttgcaattgcttttggtgttttagtcatgaagtccttgcccatgcctatgtcctgaatggtattccctaggttttcttctagggtttttatggttttaggtctaacatgtaagtctttaatccatcttgaattaatttttgtgtaagatgtaaggaagggatccacttacagctttctacatatggctagccagttttcccagcaccatttgttaagtagggaatcctttccccatttcttgtttttgtcaggtttgtcaaagatcagagagttgtagatgtgtggtattattcctgagggctctgttctgttccattggtctatatatctgttttggtaccagtaccatgctgttttggttactgtagacttgtagtatagtttgaagtcaggtagtgtgatgcctccagctttgttcttttggcttagggttgacttggcaatgagggctcttttttggttccatatgaactttaaagtagttttttccgattctgtgaagaaagtcattggtagcttgattgggatggcattgaatctataaattaccttgggcagtatggccattttcatgatattgattcttcctatccatgaccatggaatgttcttccgtttgtttgtgtcctcttttattttgttgagcagtgttttgtagttctccttgaagaggtccttcacatcccttgtcagttggattcctaggtattttattctctttgaagcaattgtgaatgggagttcactctttatttggctctctgtttgtctgttattggtgtgtaagaatgcttgtgatttttgaacattgattttgtatcctgagactgctgaagtttcttatcagcttaaggagattttaggctgagacgatggggttttctaaatacacaatcatgtcatctgcaaacagggacagtttgacttcctcttttcctaactgaataccctttatttctttctccttcctgattgccctggccagaacttccaacactattttgactaggagtggtgagagagggcatccctgtcttgtgccagttttcaaaggggatgcttccagtttttgcccattcagtatgatattggctgtgggtttgtcataaatagctcttatattttgaaatatgtcccatcaatacctagtttattgagagtttttagcatgaagggttgttgaattttgtcaaaggccttttctgcatctattgagacaatcatgtggtttttgtctttggttctgtttatatgatggattacgtttattgattttcatatgttgaaccagactttcatcctagggatgaagccaacttgattgtgatggataacctttttgacgtgctgctggttttggtttgccagtattttattgaggatttttgcattaatgttcatcagggatattggtctaaaattgtctttttttgttgtgtctctgccagcctttgttatcaggatgatgctggcctcataaaatgagttagggaggattccctctttttctattgattggattagtttcagaaggaatggtaccagctcctctttgtacctctggtagaattcgactgtgaatccctctggtcctggactttttttggttggtaagctattaattattgcctcaatttcagagcctgttattggtctattcatggattcaacttcttcctggtttagtcttgggagggtgtatatgtccaggaatttatccatttcttctagattttgtagtttatttgcatagaggtgtttatagtatactctgatgtagattgtatttctatgggattggaggggatatcccctttatcattttttattgtgtctatttgattcttctctcttttcttctttattagtcttgctagtggtttatcgatgttcttgatctcttcaaaaaactagctcctagattcattgattttttgaagggtttttttgtgtctctatctccttcaattctgctctgatcttagttatttcttgccttctggaacttttgaatgtgtttgctcttgcttctctagttcttttagttgtgatattatggtgtcaattttacatctttcctgctttctcttgtgggcatttagtgctatacatttccctctacacactgctttaaatgtgtcccagagattctggtatgttgtgtctttgttctcattggtttcaaagaacatctttatttctgccttcctttctttatgtacccagtagtcattcaagagcaggttattcagtttccatgtagttgagaaattttgagtgagtttcttaatcctgagttctagtttgattgcactgtgatctcagagacagtttgttataatttctgttcttttacatttgatgaggagtgctttacttccaactatgtggtcaattttgaaataagtgaaatatggtgttgagaagaatgtatattctattggtttggggtggagagttctctagatgtctattaagtccacttggtgcagagctgagttcaattcctggatatccttcttaactttctgtctcgtcgatctgtgtaatgtggacagtgggatgttaaagtctcccattattattgagtgggagtctaagtctctttgtaggtctctaagagcttgctttatgaatctgtgtgctcctatattgggtgcatatatatttaggatagttagctcttcttgttgaattgatcccattctgtaatggccttctttgtctcttttgatctttgttggtttaaagtctgttttatcagagactgggattgtaacccttgcttttttttgttttccatttgctgggtagatcttcttccatccctttattttgagcttttatgtgtctctccacgtgagatggttcttctgaatacagcacactgacgggtcttgactgtttatccaatttaccattctgtgtcttttaattggagcaactatcccatttacatttaaggttaatatttgttatctgtgaatttgatcctgtcattatgatgttagctggttatgttgcttgttagttgatacagtttcttcctagccttgatggtctttacaatttgtcatgtttttgcagtggctggtaccagtctttcctttccatgtttagcgcttccttcaggagcttttgtaaggcaggcctggtggtgacaaaatctctcagcatttccaagatggccagataggaacagctccagtctgcagttcccagcgtgagcgaagcagaagatgggtgatttctgcatttccaagtgaggtaccaggttcatctcactggggcttgtcggacagtgggttcagcccacggagcagggcagggcatcgcctcacctgggaagtgcaaggggtctgggaattccctttcctagccaagggaagctgtgacagatggtgcctggaaaatcggtacattcccaccacttttccaacagtcttagaaaatggcacatcaggagattatatcctgcacatggcttggagggtcccacacccatggagcctcactcactgctagcacagcagtatgagatcgaactgcaaggtggcagtgaggctgggggaggggtgcccgccattgctgaggcttgagtagataaacaaagtggccaggaagttcgaactggatggagcccactgcagctcaagaatgcctgcctgcctctgtagactccacctctgggggcagggcatagctgaacaaaaggcaacagaaacttctgcagatgaaacgtctctgtctgacagctttaaagaaagtagtggttctccgagcatggagtttgagatctgagaatggacagactgcctcctcaagtgggtccctgacctctgagtagcctaactgggagacacctcccagtaggggccgactgacacctcatacagccaggtgcccccctgagatgaagcctccaggggaagaatcaggcagcaacatttgccgttctgcaagatttgctgctctgcagcctccgctggtgatacccaggcaaacagagtctggagtggacctccagcaaactccaacagacctgcagctgagggtcctgactgttagaaggaaaaataagaaacagaaaggacatccacaccaaaaccccatctgtacgtcaccatcatcaaagaccaaaggtaaataaaaccacaaagatggggagaaaccagagcagagaagctgaaattctaaaaatcagaatgcctcttctcctccaaaggaacgtagctcctcaccagcaacggaacaaagctggatggagaatgactttgttgagttgagagaagaagactttagatgactggtaataagaaacttctctgaactaaaggaggatgtacgaatccattgcaaagaagctaaaaaccttgaaaaaatattagacgaatggctaactagaataaacagtgtagagaagaccttaaatgaactcatggagctgaaaaccatggcacgagaactacgtgaagcatgcacaagctttagtagctgatttgatcaagtggaagaaggagtatcagtgattgaagatcaaatgaatgaaatgaagtgagaagagaagtttagagaaaaaagagtaaaaagaaacaaacaaagcctccaagaaatatgggactatgtgaaaagaccaaatctatgtctgattgatgtacctgaaagtaacggggagaatggaaccaagttggaaaacactcttcaggatattatccaggagaacttccccaacctagcaaggcaggccaacattcaaatacaggaagtacagagaactccacaaagatattcctcgagaagagcaactccaagacacataattgtcagattcaccaaagttgaaatgacggaaaaaatgttaagggcagccagagagaaaggtagggttacccacaaagggaaggccagcagactaacagtggatctctcagcagaaactgtacaagccagaagagagtgggagccaatattcaacattcttaaagacaagaattttcaacccagaatttcatatccagccaaactaagcttcataagtgaaggagaagtaaattcctttacagacaaaatataaatattttaatgacaatcccctcctcattggtacatagttagataatgattaaaacttaaaggattttcactgttgagtttgtaccactcaaggattttgcagtagaccagtaaatttaaaaacaaaaacaaaaacaaaaaacataattcatgttatgatactttagttcttagaaatgacaggttaaaaaatgtaccatattagaagctagacctaattgtacatagtcactaattagcttttctcttagctaagtcatgtatctttctagatattatttgtagtgcaaaatacccctgcaatgagtgtaatttatgcattggtaatgtatgattgcttctttcaagtctaatattttagaatccatgttgttaaacaatattaagttggaatatgggtgttacaaattcagatcagaaatatgtaatgtagtataatcatcccaaaatatgttgactctagaggctgtgcacaatggattttttaaaattacaaatggtaatattgaggtaaagtacataacttagtgtaaagaaacatggaaatttattgtttagtactatcaagagtatattaaaaggtctgcttaacttaatgaaaattatttttaatatcttaaatgcacccttagaaacaatagctattatctggcttttgaagtgatttggtaagatctttgttatcagagaaatattacatttcattttctccatataattatattcatttaataataattgactaacattgtttatgtacttggtgccatgcattgtgctagttctttaatgcattatctttcttaatcctgagagcaacactgtaaagtcaataattttatactcagttgcaccaatgagattgcaagactattaggatcagtataagaattctaagccaacatggatttgattcagaactgctatgtattgctacttctcaattaaaacaattctaagagaaatgaaacaattatcaatgaactgagccataagattccacgtcttatttttttaaaagagagatatcaaacatttttaaaaaatgttttattttcataagaaacattgcaattacaaatacaaaatcattttgcttcagtgagatcaaagaaggtttacatttgacagtatctgacactcaagtttcaaaagttattttcctgttattctgtgttttctgaatctctagtatctgagtagacagttgtgagagagatcaatagaatttttctctcaaggtgttattattttctaaaggagaaatagaaaataaataaaataaaaagacaggctgttatatgtgttctgcagtaattcttgaatttattcagaaatttccataataattttaatgaattaaataaatatactatcacgcattttggcaacattgagaatagcccccaaattttacatctttctctcaaaactggtttttttttctctcattttcttcatcagcggacttaatacaaactcagcaatttcttgtacagtatctgttttaactttcactgtgataatgagggaagtcattcaaacaaatcagctctgttgcctgggcaacacgtttctttcctgtgttcatccagttccagataggggtccattttaaccataagtaaagctatgtagattatatcccctaatgaatgatagagattttatcaaatgtgagtaatgaaaattgcctctaggagaaattgctctttatagagcaattgagtttagggttgagatgcaggattacatgaacataatctctccatacctattgaacattcattaggaaacattctctgagcacataagtaatgtgtgatgtatacagaaagatacagatccatgctctccaagaattcatggtaagagggggagatgagcaagaaaataaaaaggggaaagctgataatactttctcataagaaaatgataagtattctgttttcctattacaacgggccacagtggtatgagacagttaattctcatctctagcatgtggtctactcaccaaagccatgtctatatatactctgtggcagaaaaattcaaattctgaaagtgctgttgaatggaacagatcagacacagttttgtccatgaggcagcaaaattggctgaaattcaaaagtgccattcagtttcttccagcagctgtgttgtaagatcagactgaccaatttgaatagaagttttggctggaagttctcagaactattctgtgagagaacgtgtggaagcaaccccagagcaattgagacctgcctatgcgatggcaaacagcattttaatgatgcctctcccaataaactccatttggaaataacatttcttctgcctctaaactactcatattttattgcctgctatgcattcccttgagtctttgcagtgttcacatatatcatcttccctatgaaagagtagacacacatcatcacttatcgaaaattctcagacaggcttgcttgtgcataggcggtgtgccaatagatatttctagaaggaaataaatcatcatatatgtgtggaggtggcaaaatcttaacatctgaacaggaatttctcagtgaagtattctgtataggaatttctttcatatggctccagcaaaccaaattatattcttgtgaataattactgagtgataaaagcaaacccaaaaggaatgaaagtagtactgataaaattgacttaaaaagtatgtaggctatgtcataccacataccaattgctgtgagggggatgttttctggcatatgaataaattcatgtgagttgatttgaaaataaactattttgtcatcaaaattttgggaaaaataaatatgtactttattttcaatcacagcattagaaaaaaatcaaaattttctgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccaccttttgacggggttgtctgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcctttggtgttttagccatgaagtccttccccatgcctatgtcctgaatggtaatgcctaggttttcttctagggtttttatggtttaaggtctaatttgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtggggggaggggggagggataacattaggagatatacctaatgctaaatgacgagttaatgggtgcagcacaccagcatggcacatgtatacatatgtaactaacctgcacattatgcacatgtaccctaaaacctaaagtataataataataaaataaaaataaaaataaaaaatgaaaaaaatcaaaattttatattctctttatgtttatgtggaccagtaaaatagtcagaaaaccactttggactggatgatacaacagttttcacctacagggacacaagtgtttgaattttctatgtacttggaaaattggggtcaagaaaatacatttcgtgcactcatctactgtgttttattttctgctcctggtaatttccttggtgttctttgtgtaatgtaattggcttgacttgattcaatactaagcctatatctctaataacagtgttatttgggatctggcaaggccttttcaattgtccaccctagggttggacacttaaaataaaaataaaagggacctggcaaatagagaatagccaagtcaaaaaattgcaagtgagatgggcttaactccagtaccctgacaaagctgaggatactatagaatagtaacatgctagaagcaaggggaaactgtctcgcaactcagctacctggatgtctcaaagagacctcatttgacttcatttagtggcacgtccagtggcgttgaaggcaaaggcaaagaaatctgttttcctcttccaattctgagaatcaaaatgctgtagactgagtttgctttgcagggtgggttctcatcttgggctgaccaccagatggccacatgtgcaccagtcccggaagatcattctcctggggccctgtctcctagggcaggaaccactcctttaattacaatcgagtggaagtcacaagacaaaaacagaacaatcagctgagacttttagaagattacattcttcaggagattttgatgtttttatttttttataataaaagttaaaatatccatctgggaaaagttgtatgaggaagaacaagacattttaatattggatacctcagtttgaagtgtgaacaaggggcatagagaaatgtgtatataaatatatatatgtgtatatatactatatatatatactatatatattttatatatatagtctatatatatgtagtctctctatataatatatatatatagactatatatatatagactataggcatagatgaaaggttgagattagtttaagatatcctgacattttattataattgttatttcaagtgacaataataaggatcaattaggtttataacaaaggtgataaattatagcttaatttaaaaaataattttaaaagtattatcaatccagagaaactgttgaactctaggtactcatcgaatccaagctctctcctttcaaaaagattataggcagagacatatcttctgagactaaaatccaatcactttcaaactttctagaaagttttcagaaggagattatgaatttaattaaatttaatctcagctaactcttcacatggcatctgccacatggataacaaggatcaatgcaaaaaacttcttatgagtaatatgcagtttaattgcaaaactgaattagtgataactttcactagaataggcttatttatggtaaaatgtattaacaaatctatcaagatttattgtaaaatcaaggaatttttttacagaaagccagagagtgtctatctcactcaggagcatggctcaggtgggtcttccctcctgaaaaatgtctgattctttggtactgacagatggcttggacacctgtcattccaaggactgttttcaatgggtcagctgatttggctggctagattgatttgctccttctgtatctttccatgtaagcatctttaaaagccacaaaaggataggaacatttgtaaatgacctttttacatattgctgatctcttttcatgttttagttttaccttccctctcattaatcacttctagttccatgtgtttttatctctttgtttcacatgttgtcttttactcaacttcttttgaaatgtagaactatcttttcagtaagataatacattgctgaaggaaagaagtgtcccacttattttttcaataatcacatattaggttgttataagagtctggcatgagggaaataagtagactccataaatttatactgttaagagtagcaacagacttaggggatgaaagcaggttgcttcgaatctatcacatccttttgttataaattacttagacaaatttgctttagattttatctgaaggggtgtatactagacagtataattaaaggaacattttttctgggtctagaatatggtaattacaactttgttggcaattaagaaaaataaccatggatcgtgctatttgaatgttgaattagaaattaaaattcttaatgtctgagaattattttcataagaagaggaaagttgctaaaattttatgtcaacaattgcccaaaaagtgtaacttagtgaatgattttagagattactggatgcatttattccagaatgcatgccagaatagcatttggagaaccatcactaagaggtttgttacatcagagactagtcaacataccagatagtatcctgttaatatttaacagaagtagaaaacttatttattgagtttgggagaaaagcaattcaagggtaaatttataaaatatatatatatttataagtttattagtattgaaaattaatgaaacaaatgggctgacaaacaaatgaaacaaatgggctgacaccaaaagaagttgatttttaagccgatgattcaacttagtgtagacatattaattaataaaagtaaaacttcatcatgatatgactacatatttaaatattactcatttatgaatggttaatatactggtacacaccataatttgtttcatattgatgatgtaaaatctcatgtaggaaaagtgtaataaaaccaccttggcctatgatgaaagaagtattaatgaaggggagtcatttttttcaatcactgggaagacagcccaaagggataaagcactatatatatattatatgtcagaatcaatcttaaaaactctatttcctgacctttgcaataaaacccagtcacctatttgtactcttacttagcaccttcataatatgtgctgtcatgtaatgttcttaccttaagtctgtatactgaaaataggccaatagcagatttaatagaaaaaagtcgagtgggtgcacacaaggccaaatctatttacaatttaattacaggatctagaatcaacttatgatattaaaaacctattatattaaaggttccatggttccattacattctacaaaccactgttttctcatttagcagaatatactcttcataacaactcttcaaattatgaggctaagaaagcctaccatattttctagtaggccagagagtgatggagaagttattcaaaatctgttgttctgatctccagctctgtgctgtttccacaccactgagcaaaagcagagtctgtggatgtgaggatgaggaggaaagactgtagactgcattcattctgagccatgtaaaagaagaaggcatatcagctcagttcaaagactttcattcctggttcttaatgttgttaagttctgctctgtgaataaaatcaaatataacaaaaataccaagtcacctcagaccttgaaatgaaatttcatggcttcaaaaatactaagccattatttcagcacgagctaattccttgccatgacattagggcataaggctttttcataatagttaaaattttcactctcaatgtaaatgttatttttgaaaatgagactaatgttttatgttgcctaacactggcaatatacttaccaactatctctgaggaatgcactgagcatagggatggttgtagaaaattacacaattgaggcctgaatgcacgtttagcactgtgggttacgctttgcttccaacaactcctcaatcattgtaaaaatttaagaaaaaaaatttaaatgctcacaaagaaaagaattcattcacatatccactatatcagagttcagcatttatactcattgtgtggttgttatatatttaagtttatttagtattcataaatgcctgcattatatgttcttagagaaataaaaataactatttttcttaaaggcatacaaacttataaagtgcttaataatcagtattacattttttctatgtttttttttcagtatagtgaatggttttatttaaaaaataatgttatgtttaaagtaatactttctcatgataatatgttatggttattgaaatttttaaaatacaggaccacagatactaatataaagtattagtaatataaagtgcagctataatcagacatctaattccagcaatgtagaagactacttgcccaaatagcctttgtaatacattacaaattaaagaataaaaaactggatacaaatatcctctttatgtagagttgagttgacaacaaagtaagaggaatccagagaggcagaaacaatgaattggacaggcactgaagccacagagccaagggctcacagcctccttgatcctccatagcccaagtatctgcatttaaatgggcttcacgaggaaaagaagagaaagtctaggtcctgagaaggtgggaaatcagtatgggaatctcccacagaaacaatttccaaaaggtgattttctctaggaaagaactaactatgaagagaagaaagtaaccaaagaatgagacagtggggaaactttgatgttttggcttatatggaaggaggaaaacagctttaataaagcatttccaatgacaggctggttacaaggcatcttttagactagaatccactctacttctaatgccaaaagacctaagcccagcattaactttaagaagctcccactggtgacccttcctagttatctgacagaaagaaggcctaaatcaaaacctcaaaaatcccacagatcaaattttattgattgtgatatcacaattttcaaagtcacatgaaataagaagatataagccattgtgagcaaattttagaagaaacaataaacaccagtgtttttgtctgttctcatatcgctacagagaactacctgagactgggtaacttataatgaaaagaggtttaattggctcatggttccacaggttgtacaggaagcatggctggggaggcctcaggaaacttacaatcatatgggaagtcaaaggggaatcagacatgtgctatatagctggagcaggaggaagagagagaaacgggatgtgctacacagttttaaacaacaaaatctcatgagaactcactcactatcatgagaacagcaagcagaaaatctgtcgccatgatccaattacctcccaccactcatcctccaacattgggggttgcaatttggcatgagatttgggtggggacacaaatccaaaccacatcaaccaataacaaagtagcaaagattccagatggaataacagattttaaaaggcaaatgatagaaaagtagtgaacttttattagtctaagacgaaacagactttaagaccaaaagcttttcttgagatcaaacatgaaagtttaattcaccaggaggggagaacaatcctaaacttacctaaacatagtaacataactttaaaatatataaagtcaaaaatgaaagaactacaaggagaaattgacatatctggaattaactttaagaaggtcccattggtgacccttctcaggtgtatgacaaaaagaagggccaaatcaaagcctcaaaaaatcccacagataaaattttattgatcatgataccacaatcctcaacatcacatgaaatatgaagatagaagccatctttggggtaatttcaatgcagctgtctttaatgtcgataggaagtgtgtgaaagatttgaaccacacaaactgcaaggtgaaactgcaggttatatagatatatctgcactgaagcactgtctacttcctgaaaaatatattgttctgaaaaatatattcaaaagataacagggattatgagaacaaagagttgtggaagacagtacaaaactatgcagctttgtaacaagaggaccaaacagaaaggaatacatgagactggaggggataatctgtctgcccatccagatatattcatgtgagcacatgctgccacagtggttgctaaaaatgctccagaacaatagagtggaaatgtattgaagttttgttggagcagagctggtgggtacaaactggcagttgggaggagcatgagccagcgtgctcctttagggtgtctgtggaggcagggcaatggagcaagagtgcagcacagtaggaagagggttgtggccctgagaaggaccctggcacttgtttctagttttcttaagatacatgcagtagtgcttttcctgccagcatggcagcaacattgaagacttctatttcccaataaagatatgatcctaccatcattctctcccctcttgtctaaaatatttgtggatgaaccaacacagtgtttactccattctaaactaactcccttattaacaaatcacccatgagtgaattcaccttacagaaactcacactgtggctgcagatagaacactgcactaagcaggtggagaaaatgtcttcctttcaaatccagtccataaaaccagtactggtattacatatattatattatctgatgacagcacaattgagttaataattggtaacaaaagaaatcattaaaactcctatatatttggaaattaaaggaaatcttctaagtaactcatggtttaaagaggaaatcataatgggaagacatataaatgtacacaatatggtaatatagaaaatattaaatataaaaatttgtatgacagagagaaatgtatagcctttaatgtaatgtgggaaatgcaagacttaaaattagtttgaatgttaaggaatgtgcagtagagggaaaaaatagttacaatggggaattaaaatggaaaacaaaggcacaagggagggttcaacaaagctgaagtgttaaaaaatataagatcaacgtggcaaaatattaataaaaaatagaatattaataaaaaatagagatgataatgcaaggacttttacatctgctacccctcccaacacacacatacacacacacacacacacacacacacacacacacacacaagactgacagataataaaaccaaatacttaaaggcaatgagagagttagtaatataggatggatctggtagaagattgcagtatatccgtgtatgctgtatgtgtgacccatttaaaaaatatattttttattggacacataatagttgcatttatttatggagtacatagtcatgttttgatatgtacaatgtatagtgggcatatcagggaaattagcatatccatttaacaatgcaacaggttccttttgccagctgcccagatagagccaatttatcaagacaggggaattgcaatagagacagtgtttaatacatgtatagccagctaaatgggagaccagagttttattattacacaaatcagccttcccagaaattcagaagctagggtttttcaaagatagtttggtaggtagggtgctaggatatggatgtttctaattggtaggagatgcaatcttaggggtgcagaaaatggccttcatgcactgaggccacttctgggtgagggtcacaggagtggttgagtggagagttgcaggcaaaagcctgcaaaagccagaaaagacatatcaaaaggccagtcttgggttctagactagtaaattggagaagttgcaaaccttgtgacctctggaataatggctggtaatcatttaactacacctacaacttatagaaactcatcctcctaacctggtggtctttcattagatttataaaggcagtatagcctgagggaggggctactatcatttaaactataaactaaatttctcctagttagattggcccaagtccaggaatgaccaagggtagtttggaggttaaaggcacatctctttcactgtcataattttctgactattataattttttacaaagatggtttccccatcatgtcaaacatatcattttttggtgtgttgggaatcattgaattcttcttttctaactctctgaaaatatatgataaagtgttttcaactagagtcatcctccagtgctacagaatactagaacatatacctcctttttccttaattgtccagtttgggaggattttgaccactgacttcaaggcattgtggggacattagtttgccgctagggattgccaaggtagtgaccagccactggctaagagtaaggattcacttgatgcagacagaccctcagcggggattgcttctcagcctcacagcatctccagcaccaaaattaatttagaatggcccggggaactagtgaccacagttgcagacagaagcaaatgtagatgctctctagagacatataacaccatctgaggctttaatttatttctgtaaaaactcttttcaaatgcactcttcaacccacaataaaaataaatcactcataggagaaggggcaagaaaacatgcctgaaaatcagagaaagaatagtcaatagaaatagaccaacagaggcttcaggaattggagttattagaaagaccctgaaaaccttggtaccaataaatttgaaaatttatataaatttaaaattttccaggaccaactcaaaataaaacaagcaatctaagtattaaagaattcaaagatatatcaaggggagggtgatgaggaatgactgctaatgggtataggtttatttctggggtaacagaactgttctggaattagatatcgaggaaaagtacacaaccttgtaaatacattaaaaacaatgaattctacactaaaagaacaaaaatactggacttttctccacaagcagaatagcttagtatgctcattttatatggctagtacaactgatctcctaatagaaaaggaatataaaaatatgcaattttaatcaaatacacagatgcaaagtaattaaattaaaaattagcaacaggaatcaatgatatataaaaatatcataggaaataactagtattggaaataactatttatccttattgagtttattatgcaaaaggaaggtattttcaacattagaaaaatatgtccttaagaaatttaaggagaaatacgaccatctcattaaatgcaaaagataataatttgatgaaatgcatcacttaggaaacaaaaagaaaagagcaataaaatacagaaaatatattttttcaaaaggctgtctctacatcaatgggaactcttcaaatcaataaagtgcattttcaaaagagctacagcaaatttattgaatagagaagaataatttttttaaatccctgtaaattcaggaacatgacaaaaatgtttaatttcttttcagtgtagaacagatgcattagctacacaaaaatagtgataaccctaaagtataaggaatataagaaaggaataaaatactgtcactctttaaatgagacattcatctatgtagaaaatccagaagaatcccaaactgatagatttaataaaaaaatagtaaaattgccagatacaaatctattcaatttagtgagtgacacttttatacagcagcattatcaaaaaaacaaaaaatatttaaaatgcctaaatattatataatatgcataataatgaataatgtaagacatataagacctacatataaaaacatataaagtgaataatgtacattacagaaaacttaaataagttgggagacatatcacattagtggaaatattactatgctaaagatataaattctgcttacattgttttaaatatttaaaacaagggaaaagtgacatagattacacacacagatttttcaagcactatcatacttagacctaatcaggggacatccctccatgggtcccaggctttgtagatcccacagatcacaaacaaacagacatgcttttactaaagagcatatggctaatctgtcatgcaggatccagaactcagttttcaaaggaagactcaggaccctaggcctcaaggatgtgactaacaccattcacacctaagtaaacctttcttcatatctattctcctctatccgtaaaacaagatatgtttttcctgaatgcagttgtaaaccaaaagtaaaattctaagcaccccccaaccaactgactggactcctctcagctaagggcattttaaggtaaagctgaagttctagttcaggccaagatgggaatggatggttgaacatgccttgttatactttcctccctttggaatccaggcatagctgaccagcattaacattgaaacagagaccttaagactaacaaagcagactctgtagcaataaaatgccaacatgacagatagcaggcccaaaatatattgccctgatgtattttaaaatgttcctgcaaggctgtctcttctggggaaaatctacattctagagagaatccccttctcttttcaggctttttcctgataaaggaaagaattaactaaagagtctggtgtatttttttatttttatttttttttgagatggagtctcactctgttgcccaggctggagtgcagtggcgtgatctccactcactgcaagctctgcctcctgggttcacgccattcccctgcctcagcctcctgagtagctgggactacaggcgcccaccaccacgtccagctaattttttgtatttttttagtagagacggggtttcaccatgttagacaggatggtcttgatctcctgacctcgtgatccacccacctcagcctcccaaagtgcgtatttttaagtctgataagaaacattttaaatctgttctctctgaagcaggctacctggaggcatcatctgcataataagaaccttggtctccacaaccccttatcttaacccagacacttatttcggttggttccaggtctttagataaactataaatgctttcaaccattgtcagtcagaaaatgtttgaattcacctatgacctggaagtgccacacaccccaccaccttgagttgtcccctgccttttcagacagaaccaatgctcatcttacatgtattgattggtgttttttgtctccctaaaatgtatagaaccaagctattgcccaatcaccttgggcacatgttcacaggatctcctaactcatatttggctcagaataaatctcttcaaatattttacagagcttgagtcttttgccaacgccattaatatttcttcttttaactatattaaaaatagggaggattttgaatatttaagtgcttgagtaagagaaaagacaaattaagtaacacattagacacttgccaattcatgaatggaatacgtttttagataacaaagtattcttaatcagtagagccaaatatccattttgtttactttatgttgtagcttgtggttcaagaagtattgacaattggcatagtatttgcaacagttatcactggcagctgaaaatattttgcagtattaaaaatttacactattgttaattatgtacacatataggactagatatgcatacatacaacatgataccgattctttatattgacaacaaaatgaacacaatagaattgcaaatagtgttatttttattaaaaatactataaaagtttattttcaaaaagttaaattctggtttttatttttattgaagtaattttatgcaaatgttatatatattgaggactaagctctgatttttttatcttacccaaattcctatctaaggggtctggggagtcatcccctacaaaccataaattctcatcagatgggttttatttaaccctatatatcatgactcactttccaatctgactctggcataacactatgagacaaggaagaaaatcaaaatatttgatttttgcatttccctgatgtcctttgtgggggaaactctgtatctgtaaagaatctctattaagatagctagttttttttcttccaggccctcccagtcctaaagagattaactaaaagtctagaaacttttaaagatctgaataggaaacatttgccatctgttgtctctaagggcagccactataagacttcaaaagatccgtggtctccacaatcttttatcttaacctgaacatttcctttctatcaatcccaggtctttagacaaactcaaccaattgtcaaccagaaaacgtttaaatttacctataatctggaagcccccccacccactttgggttgtcacctttctgaaccaaatcaatgtgtttcttaagtgtatttggttgatgtctcatgcctctctgaaatatatgaaaccaagttgtaacccgaccaccctgggcacattgtagtcaggccctcctgagtgttgtgtcatggaccatggtcactcttatttggctcaaaataaatattttcaaatattttacagagtttgactcttttcatcaacagtatattcactataacacttcatttaatttgaatagatggttctgaatatttaccaaaaaaattttaaaaacagatttgaggggaaagtttgatttcagcactaatgggtaaagaatttggatgttgttactctagtttttacaacaaaatacatctggacacactgaaaatcaatgattttttttgtacttaccaataaccgaagctgccagttttatcatcaatataaaactctggggagacaggccaatttggagatcgacagtcaagattgcttctgtggagaagaaggccctgaactacagacctatagaaaaaatgaattgttgatgttctcaaattggtgaaggcaaagtgtagaatagcataagaatgagaaactcatggtgctgcagttttagagggggtttcacttccaggaactgaccagattctgatggtaaaatccaagaaagagaagagggaggggaagagtaatcattgtgaaacaggtcttgagaaatcttcattagaaaacctactctacaaggcaaaagaccactacagttttgtatcaaatgcagaatggtatttctctcactctagttccctttagctttcctgcatcacctaagagaatatctctggagaaaaacttgtgaaggtcccagaccacacacagaggcccatttggaagaaaaaaatttcatcatcaggttgtagaatgattctcctctctgacccttcccactgcatcaacgcagctccagtaaaatatcagtagctagagttgaaagagctataagacacagattttccctgaagacaagtcatcggagaagccaaaagtcaagggaacaaggataagaaaaaaaaaaggaaactatgagagcctttgacaaccataactgagaaagtatttataaagcccaattcctagccaaattaacatatatcccaaaaggtaaggtctatttcatctttagtttatactcaatgcaatacgtccagcctccaaaaaaaatgacataaacaacaaccaaaaaaaaaaaaaagaaacaccaacaccattataagcaaaacacagtctgaagagacaaatcaaaaattaaaataagaatcagattatgacacagattttgatattatcaaatggagaatttaaaaatagttatgtttaatatggaacataacagaaaaatatagacagaaggttaatgaaagaagagtgatagaaactctaaaaatgaattaaaagaaaatgtaagaatcaagaacattgtaagagaaatgaagaatatctttgctgttctaataagtagacttgacatagccaaggaaaaaaatattacgaaactaaaatataaaaagcaaaaggaataaaagaaacaaaacatctaagaaatgtgagaccatttcaaaactattacatacaggtatgtggactaccttacaaagaaaaaaagatgatcagaaggaatatttgaaattatgatagctaagaactttcccaaattagtgacagataccaaaccacagatccaaaatgaacaatcaatgccaaacaaaatactaaaattacctatctattcctaggaatatttaaattgttgaaaacaatggtgaagagaaaatcttgaaataaaccagaggaaaaaacttcttaaatatggaagaacaagaataaaaattacaagagacttctcatcaaaaaccaacccagccagaaaagagtggagtgaaatgtttaaaatattaaaggaaaaaaattacactgacttaccgttctctatgttctgcaaaactatcctttgaacatgtagaataaataaagaccttcttagacaaaaactgagggaattcatcactagaaaatatgacttgtgagaaatgttaaaagttcttcagggagaaggaaaagaatataactcacaaatgcatacctgtagaaagaaagggagagcacaggagggggaatacattaagatatatttaatgtgttatttgtttaattcttggctgaaaatatagctgtttaaaataataatagtaacaattataaagtgattatatcatatagataagttaaatgaatgatttcaatgtcataagaggtgagagagtaattgggagtactctgttgcaaggtccctatacaagtaaagtggtttattgttatttgattgtggatttagatcagctaaaatgatatattatgaactctagggcaattactatttctaaaaatgtatggtggatatgcttggaaaggagataaaatgctcaattaaaacccactaagacagaaaaagaggggaaaataaacaaaagcaaatgcaacacattgaaaatgcttaagtatggtaaatattaattcaataattatttcaagtggacataatcttaaacataccaattaaaagacagtgagcttcagagtatacccaagtgtatgctgatacactatcagaaatccactttaaatataaagaattaaatagtttaactaaaaggatagagaaagatatactttactaacacaaattaaaaaaataaaaataaaaagactgggttagctatataaatttcaaggaaaaaaacccagacttccaaacaaggaagattatcaggaataatgatccgttttacaaagcaatttaacaatccttaacatgtacacaattaaaaagagagtcaaaatttgtgaggcaaaacttgatagttgttaaagataaaaatatgcaaatgtaagagtgtagtttgagactttatcacccttttttttaagtaacattgattaagcaggcaaaaatttcatttagttgactgaatagcactgtaaatcagttagttctaatggctttttatagaattatccatccagtggcaagagaattcaaattctcctccagcttatgtcgaacattcatgaagaaaaattacgttttgggcaacaaatacacattaacatatttaaaataacagaaatcatgcaaagtctattctcagacttcaatagagttatgccaaaactcaataacacagtgagatgtgggacatcctccaatatttgacgattaaacaacacacttctaaataacacataagccaaagtagatgactcaagactaacttaaaaatattttgacttaaatgaaaatgacaatgcaacttatcaaaatgtgagatgtggcaaatgcaatgtctagagggtgatttacagcattaacaacaaaattagagaagaagatctgaaacaataatgtcagcttccaacttaaaaactagagaaaaagcaattttagcctaaagcaacagaagaaaagtaaagcagaaatcaatgaaactgaaaacagaaaataatagaggaaatcaatgaaacaaaaatctgtttcttggaaaagattaatgaaactgacaaatctctaaaaagattgagaaagaaaacagagaagacataaattaccaatattactatgaaagaagggacgtcactacagaccctggaaaaaccaaaagtacattaagggagtaatactatatgtatagctttacacataaatgaacaagttagataatatggatcaattacattaaaaggacaaactacctcaacttgtccaatatcaaatacataatttcggagctttattactattaaggaaatagaaagtataacataaaaacttctcaaaaaagcaatctataggacaagatcgtttcatttgcaaattctacccaacatttaagagcaaaaatacaatgggaaaatgacagtctctttaataaacgttgtagagaaaacaggatatccacatgcaaaaaatcagcctggacccttatctcagaccatgtatacaatccaactcaaaagtattagagactcaaacataagactggacactgtaaaactactagaagaaaatagggggaaaactatctaacattggtttgggtaacttttttttttttaatttgactcaaaaaccacagtcaacaaaagcaaaaatagataagtaatgttacatcacagtaaaaagcttctgcacatcaaaggaaacaagagtgaacagtcaaccttcagactgagagaaaatatttgcaagccatacatctgataagggattaacatccaaaatacataaggaactcaactaactctaaagaaataaaacaaataatctgattaagaaatgggcaaggaaactgaatttctccaaagatacaaatagctaacagatacatcaaaaaaattcaacatcactaaccactggggagatgcaaactaaaaccactatgagatatggccttatttgtattagaatggttgttattaaagaaaagacaaaagacaagcattggcacagatatgagaaaagggaaccctcatacactaatggtgggaatgtaaattagtacaactattatggaaaccaatatggtggttcctcaaaaaactaaaaagagagttaccatatgatccagcaatcccacttctgggtatttatcaaaaagatttgaaatcaatatgtcaaatagatgtctgaactcatatgttcattccagcactgttcaaaataaccaagtgattgaataaacctaagtgtctatgaagggatgaatgaataaagaaaatgtaatatatatggaaaatgcaacactatttagccttaaaaatgaagttctgttgtttgtgacaatatagatggagaatattatgctaaattaaataagccagaaacaagaaagactgattccaaatgttctcacttatatatgaaatctaaaaagaaacgtttagaatagaatagaaaggtggttacaaaggctggggactggggagaatgggaagatgataatcaaagggtacaaagcctcagttagaaggaatacatttgctttattttttaaatcagtagcacaatatgctgaatattgttaataactgagtactgtacatttcagttttgctgagagtaaatttctcatggtctcaccatcaaaatagttgcatatttgaagtgataaatatgttatttagcttaatttagtcattttacattatattgaactgtcatgccactttgtactccataaatatattcaactataatttatcaaaatattaaaaaatgaaatgaacaccaattctatgcaacgtcttcctgaaaatgaaagaagataaaacacttaccaattcattttaatgaagctagcactactgttcccaaattagcaaaggcagaatcaaaacaagaaaaggcaaaaataaataaactacagagcaatatgtcttaaaaatatagatgtaaaactgtttttaaaaattttgtaaagtagaattaagcaacatatataggaaatatacactgtgaccaaggggtcttattccaggcaagcaggctgtttcaacattttaaaagcaattagtaaaatccattattttatcaggctaaaaggaaaaatcacctgaataataatttgacaattcagcacacatttatgattaataaatactctcagaaaattaatagtaggaaagaacattctgaacttaataaagaggatctataaagaaaaatagaaaaactacagctaacttcatacataatggtgaaagagtgaatctttacccttgagtttagacacaaggcaagatgtttactcttttcaatttttgtgaacatagtcctgacatttttaaacagtgcgagatgacttggaaacatatgcaaaagagtctgaaggaagaaataatattgtccctatttgtagatcacatgatcacctacatagaaaatcttaaggaatataaaaactaacttcctagaactaataagtaagttcagcaaaaaccacaaaaatacagatcaacattcaaaaattgctttgtatttctatatactagcaatacattgaaactaaaaataaaattccaatattacttacaattgctcaaaaaatgataaaatgctgtgatataaacttaaaacacctacaggactttaacccgaaaactcaatgattctggtgaaataaataaaaatgtaaataaagtcatactgtgttcatggattataacactcaaaatagtgaagatgtcattgtcaaattgatacataagtttaatgaaattcctgccaaaatttcaacttgatatgttgtggatatagacgttattgttgtaaaatttatagaatcaagccaaaaaaatgtaatagcaaaaacaattttgaaaagaaagaataaagcaggatggatcattatacctgattttcaagataacagtacacagttatcaaactgtgtggtatcagcagagggatagatacatagatcaatggaccggaagagatggccctaaaatagtcacatacaaaaatgaccaagtgatttttggcaaatattcaaaagcaattaaatggaggaaggatagtcttttcaaaaaatggtgctggtaacaattggatatcaacaggtaaaagtaaaccttgatttaaacttcactcctcatgtaaaagaaaaaaataaagaaaacttcaaaatggaacataaatttaatttcagcctttaactctataaaactttgagaataaaatataggagaaaatactaggacctagagtttggttaagacttcttagacatgaacaccagaagcatggtccatccaaaaacatcaatcaaaaatcaattaaacactagctttgaaaattctgttaagaagatgaaagacaagccacaagctggcaaaaaatagcttcaaaccacaaacctgataaagagcccatatctagaatttataaagaattctcaaaacttcactttaaaaaaacccactaattagaaaatggaaaaaaaaatgaagacacatttcactaaagaggctatatggatggcaaataagcacctgatagaatgttaaacatcattaaactttaaggaaatgaaaatcatcctagcaatgtaatgtcctacaatgttaggagagctaaagtaaaagttactgataactccaaatgctggtaaagagaaagagaaaacggatcgctcatatatttttgtaaggaatataaagtcataaagccactctgaaaaaaatgctttggcattttttaaaaatcaaaccaaacagaaattgaccatgttaaccagtggttgtattcctgggcatttattctagagacataaaaattcatgcttacacaagatccatacacaattattcataccaaattcatttgtaatagccaaagactggaaataatcaaatgtttctaaatagttgaatgattaagcaaacttttgtacctccatatcatgatatactttcatcagtaaaaaggaatgaactaatgatatataccaaagcttgaactgatatgaagaacattacactgaaggaaaaaggctgtgtcaaaaattgcatactgagtgatgccactgaatgacaaaaggattaaaatggcaagcagattagtggattgcgtgggttaggggtgtgtgtgtaactataaaggagtagtacgagggagttgtggtcatggaatagtttttcaaaatagttctgtaccttcatttggtgttggtaaccagaatctaaacatgcaataaaatggcatcacactatacacacactttgtaccaatgtcaattttctgcaatgatattttaccatacttacatcaagtgtaaccaatggaaaaaactgggtgaagggtacaagcagcctctctaggctgtctttaaaactccctgtgaatgtataaaaagtcaaaataacaaattaaaatgtgttacatctataaaaccatatcctaaatattgctactattagtatttctaaatattataaaaacccaacaagataaatttatatcacaaagtgactaaaaatggcatcaagcaatcacttcaacttttaaaaatggtcctttggatctctttttctgatagatcatatcagaatctttttgctagaataagaaaaggaggacaacagctaacagatagaagctgttgttagtagatgtggaaaaattgataagattggcagaaatagtcataggatattagacaaaatcagtgtgaggaaagatgcaggtgcatttggaaatttcagtgaaaagttaaaactgaaagaatcaaggttagcttggttagttgacaaaaatttaagaaatgctgacaaaatgtatactgttctctactggacatatatcaaaaggagttgaaatcagcatgctgaacagatatcagcactctcatgttcattgcagctgtatcataatagccaagacatggaagtaacatacgtgaccaccaacaaatgaatggataaagaaaatgtggaatatgtgtatagtggaatactactctgtcataaaaggaagggaattctggcacttgtgacaacagggatgaatgtggagggcattatgttaagtgaaatgagccaggcacagaaagacaaacatagcaagatttcactcttgtgggaccccaaaaccttgttctcataaatagaattaatcattctgtatatatcctgcaaaacatcatgttgtacatgacaaatacatacaattttatctgtcaatttaaaataaaaacaaaaattatgacataaaaacaacaggttttctaagaaaaaaatgtacagtgatctgtgagtgagtggaaatcaatcaacacatttttgttggaaaaaataaatatcaaggtcaactatgcttattattggaataaacttgctggtttatggggaatgtgttggctagtggattacgtgtgaaggaaaaagctcattagataagaagtaagtcaaagatttgaaaaacaattatgattctcttctttttactttgtaggtgttctttccctaaatgcatgggaagacaatggtataaaagtattcaaaataaatgtacttcggttttcttattttcctccaagtaaaatatgttagcagtttctcacaaaaacttcagccaaaaaaaaagaaaaaagaaaaaaatgtttctagcattatttaaatttaaagtagataatattctacccataaagaaattcccatagttaaataatctcttcttagtgagtttataaaccaacctaagatactaaagcccagtcatctaaaagagccgtgtagttgtctctgtcccacagtgtgagagatttttgaatggcattgggagtatggaggagaggttgtgccactttaagatggtacaattttatctggatggtttttccacattacacaaatttccttttcctagtctaacaaagagtgccactatagattattataatatgctatatcttgctcaggtgtactgaatacaaaagtaacacattaagaagataaaattttttgaatagaaaatagactataactgaacgtagacagacattccataatatttatttctaattagtgtcttagtgactaagttcttaaaccttctccttccaaggtatgattccggtgcatcatttttatacatttaaattttacaggtgataaaaagctctgaatgtttacagaaactttttaattgtaaattttttttttttttttttgagacgcagtctcgctctttaggccaggctggagtgcagtggcgctatcccggctcactgcaagctccacctcctgggttcacaccattctcctgcctcagcctcccgagtagctgggactacaggcgcccgccactgcgcccggctaattttttgtgtttttagtagagacggggtttcaccgtgttagccaggatggtctcgatctcctgaccttgtgatccgcccgccttggcctccaaaagtgctgggattacaggtgtgagccaccgcgcccggccaaaaatttttaaaacatatatttatatatacagatataaaataacctaatgaactgaaatgtagacattacacagcttcaagaaatgtcaacatgttgtcagttttgtttcttcctcctgtactttctctgggttatttggaagcaaatcctagatatcataaaaacttcctttaagtagttcagtgtgtgtatctaaaaaataactttttgatttacagcaataccactatcacaaatattgcttgaatacaaacaagtacttagtatttgaatttccccaattgttacagaatatcttgtaataatttattaaaatcagaaatctagtaaagattataaattaagaatcacacattaaatctttttttcctcactctatttttttacctttttttttcttgcagttcatttcttgaaagaaccagaaactttgtctgatagtgtttctcacagtcaggatttgtttgcaattgcttttctatggagtaggttaacatgatgctctactctctactgtctatatatttcctgcttatttgtaattggagctctaaggttgataaaattcgggttccattatttttggcaagaatactttattggtgatgtcatgtacatctatcagatgccgtgtgttaactttctctcttttcatgaatttggccatcattgctgatcattcattagatttcttatttcattggcattttgagatgacattcacttattccctagaatatatttaatggaaaacatcatcttatcaactattcatgtaacttgaaaaacagaccttatagaaaagacaggaaaaatgctcaattatttatctctactttcaatataatgatttttttcctgaactctccttcaaagaaggcaaaaggggattttattttagtatccatttaaattcatagttttaaacatatttaatccatcactgttaagattctcactgatgctaaaataatctcaaatttggccaataagaacttcttcatattgtctcctgagtctatataatatatcctaatagtgtaaggtagtgttttgtcttcttttataagagattttaagggttatacattacttgtcctgaaattacctatttctataaaaaaagatatttagatatgaaactctgggcactctggctactcattactactcaaacagtcttcgtttctttgcctattactagaatgatacaactttttgtttttaagataagacacatcatgagatcatatcctgattaaaattgttgagccatatgcataggaggaatcaatattattaaaatggccctactgcccaaagcagtttctagattcaatgctattcctatcacactaccaatgacatttttcacagaattagaaaaatttctaaaattcatatgaaactcaaaatgaacccaaataaccaaagcaaccctaagcaaaaggaacaaaactggagggatcacactacttgacttataactatactacaaggctattgtaagcaaaataacatggtactgatacaaaagtagatacataggctaacggaacagattaaagaacccagagattaagtcacacagcaacagccatctcatctttgtcaaagctgacaataaaaagaaatgggaaaataattcactattcaataaacgatgttgggatgacttgctagtcatatgcatgagattaaaactggaccccttccttacaccatatacaaaaatcaacttaagatggattaaagacttaaatgtaaaacctaatactataaaaatcctagaggaagacctaggatatatcattctggacattatttctggcaaagatatcatgacaaagactcaaaaagcaaccgcaacataaacaaacattgacaagtgggacctaattaagctaaagagctttgcacagctaatgaaactgtcaacagagtaaacagacaacctacagaacggaaaaaacatatttgcaaagtatgcttctgacaaaagtctgatatccaaaatgtacaaggaactcaaacaaatttgcaagaagaaaacaaacaaccccattaaaagatgagcaatgttcatagacagacacttcccaaaagaagaaatacacatgaacaacaagcatataaaaaatgctcaacattattaatcattagaaaaatgcaaatcaaaaccacaatgagataccatctcacaccagtgagaatggcgattattaaaaagtcaaaaaataacagatgctggagaagttgtgagaaaggggaacgctatacacagcttgtaggaatgtaaattagttcagtcacacgaaaaccagcttggagatttctcaaggagcttaaaacaaaactgccattcaaccctgcaatcacattactgagtacataagcaaaggaatgtaaattgttctaccataaaaacatttgcacatctatgttcatcacagcactattcagaatagcaaagacagggaatcaacctagatgcccatcagtggaagactggatgatttagttcattcgcacactgctataaagatagtacccaagactgggtaatttataaacaaaggagttttaattgtctcacagttctgcatggctggagaagtctcaggaaacttacaatcatggtggaaggggaagcaggcaccttgttcacaaagtggcaggagagaaagtgagtgcaaacgctggaaaaactaccatttataaaaccatcaactcttgtgagaattcatttactgtccatgagaacagcatggggaaactgcccccataatccaattactcagttgtaaatgaggaccagttggcaatggaatttctcctaatatcaagggtatcagaataatatctgatttccctgctccactttctcctggaatcactgctgacttcaccagggattgttgcagtgtgtggttcaggcttccaaatcttttaggtttgtgaggatacttcgtcaatattgttacagatgttcttcatagttttgtttgttcctttaattattcactaggtttacactgcttatgctattgtttcatttatttcagggatcaggggagagttaaagattttggggtgggtaaatctactattatctttccagacctcggtctcaatttgatagtatgctcaacagttagaacagcatcaatttaaaaatcccaattctcctttctgatataagaacaacctttgacttccatcacttctgaaaattcactaagtaactataatcttttgactgctgcaatgggcaggaagttgtaggtatatttgtaaaaacagttaatgctaaagatattggggttaatggaaagacaaactaaagactctcttggtatttgcagagagagctcattaatatgcctgttagacttttgcaatgagacatgcctagatatttccatttgaagaaagtaaattaacagaaaaggaaataagccatttttgctcctgaaatgcaggcaaggctttgcgtattgtttgctttcacaaggattccaagcacttttcttttatgaagttggttttgtatttttaatttcagcagaaggtgacaacaggctgaattgcttttctcaataccagaattcataatttctccttaataatgattgtggaataaatgacatttacttagctaaaaaatttaaaattccagtaagtctctttagttacatttgaaataatttaaattttacgaaccatcatgaatcctgaactctacttttgctttgtgacttcttagaacaaactaaacctatcacaagattttatatattatgtaaaaaacaattttgtaccaagagagctctcctctacgattagcaggagaggcgggaaacaagcggcacagaggatcctggagctcagtcaagctccatcctccccgacattgtctcagcccatagttaagcaacacttcggttcttcatgttggcctctgactcattccctcacccataagtactttatagcataatgcttaaacaaagaaaataagtttatataaactaatgcttaaacaaagaaaacaaatttatgcttaaataattttgatttaccagtttctaaaatagaggtatttcccgtgaaagattcatattccaatttcatattttttaatctcaaggtgatgatttatatttttctggattttttttccctaacaacgaagggtgataaatagaagaaaggtagccttaatgtaattaaaccttgataaattcaaacaatgtccactataaaaagtctttagggagtttatgaggtcataggatagtcttctctttccttaggaagttagagtaagtagaaagacaatttcctctcagtctgggttaaggctagtggtagagtaaaaagttctgatacacttatacttccagagttaatgtatacatttgttttgtgtttttaattttacaaagtgttttgaaatattgtggttctttaaaaatgtttttactctctagctactgatttatgtgaacctacattatatttaaagtcaaatatatagaaagaagagcagagagtgtgaatggcaatggcttgccatcagagagatactttgagaaagacaagttcagactgaatgttactagatgaggtgacagaatggttccaggtaaatggaagaaaaacaatattttttaatgtgtggcaatattctgttgaattttagtctctaggctgccacagtgacaaagatgaagctatgcaatatttctatgaatctgtttaggggctggagtaaagagcagttatttaggtgggtggtgtctgatgtcccagtgggcagacattctgcatctatgaagcttcttcaaggccttaagtactgcttttaggtttacgtgaacagactttacttttggcgaagagaagagtaaggtgatgtctcaatgtgaagaggaagttgcaaaaacagttttcatagtgtgccaacatgaactaaggtagaactatattgatgagcagggttaatgattcatgccagatgggatgataatgaactttacaattatgcagtaattcctcttctcagctcggaagtgcctcagagtacgcaggtagaacttgggaagcaatagggatcccactgcccagcactaacatatcagtctcaggtcatctgcccatggtcttgaggttctcactgcaaacactaaacctcacttctggagtgatgggggatttaggctgatacttgcttcaaaatgctccctcttaactggagccctccttcctctcgatggatcactagatagatacatagatagatagacacacagatacacacacacatatctacgtatatatacgtatacatatctacatatatatgtatacatatatacatacatatacatatgtgtatatatgtatattaatatttatatttggtttatcataaagaaaatgtcttctataagtctttgaataaagctgatgctctaagaagatgtatcctaggccaggtgtggtggcttacacctgtaatcccaggactttgggaggcagaggtgagtgaatcgcttgaagtcaggagttcaagatcagcctggtcaacatggcgaaaccccatctctactaacatagaaaaattagctgggcatggtggtgtgtgcctgtaatcccagctacttaggaggctgaagcaggagaatcacttgaacctggcaggtggaggttgcagtgagccaaaatcatgccactgctctccagcctgggtgaaagagtgagaatccatctcaaaaaaaaaaaaaaaaaacacaccaggaaatgtattgtatttattctgtaggtttttatggaagcttgtatattgatgtgaagcccccaaatatgtacacattccaacttgtgaggtgtgggagtggttagtcattatctactctgtatctttccattaatttgtttgtatagccatatccatatcacgtatgtattatgatattattactataataattactatataattatctattatcatatattatctatttatattaccatattatctatttaaagaaaatataagcatgtaaataaacatagaaaatataagcacatatactaccttttatttatttatgtgcttatagaaaataaataatgtatgtttttagaatagcattgcatagaaatcatgaaattttctttgattcatgcaggacttacagagcatgtctgttgagatctatgagtttgtctgttatttctactaaggttttgaaatagttttttgaatattgacacaaaataaataaatttgacttctgagagttaattacatgtgagaattagtaaactgttgaacaaaaaacatgtatctatgaaatatttaagaataaattgaccgctaatggtatatgttcagataaatgagtcctgaattatcttatatatttgaaagacctctgtgaaaattaattatattgtaacattttaacagtctgacccaaaactatgtgacagtattatctgacatttcaggttcataaaagaattgcaattatatatgcttagttagggtttgatgcaagtgtaggttttctgaatttatagatatttttgaataattcaattatggagtaacttttccctattttactaaaatttatctagatcaatttgatttttaaagatcctctcatctttctttccatctctactgtatccatcttagaaataaaaactctccggatttgaagggattttaaaatgcaaatgtctgtttgctgcatcaagcaattctactctattcctggataccactgattaaccatttttaaacatcttcagggacacagaactcactagttttaacacaacactttttgggcctactgtaagagcaaatgtgatgcattttaaggcgtttgggccaggtctcagggtaattaattaattttttttttactgttccatggacatacacacagattacatgttctagaatgttagattagagtttaaaactctaataagtttcctcttttcattttatgaaaaaaacaaatacatgattcaagaatgaacatatgattgaggataggaataactgatatattccctaatatctcctttttcttcattgagataaccttagaagactgaggaatcgacctttctgtcattgagctggggttttgggggaaggagaatatattagaccattcttgcattgctgtaaagaaatacctgagactgggtgatttataaagaaaagaggtttaattggctcctggttcttcaggctatatgagcatgttgctggcatctgcttggcttctggggaggactcagggagcttttactcatagcagaaagtgaagtgggagcagacatgcaggagcaagagacaagagagtagtgggaaggggagtaccataatttacaacacgcagatcttgggagtacccactcgctatcatgaggacagcaccaagccatgagaaatccactcccgtgacccaaatacctcccaccaggtcccactgccaacaatggggattacaattcaacatgagatttaagaggtgacaaatatccaaatcatgtctgagaaggcttttagtaagtggggagattctttttttcactgtgtcaacaggctcaaagtatcaagggaggcctacaaaatccaaccttagatcctcttgttattcatatttgtgtttcatgacactctaaaatacaagtcatgagcttcaaaaccatatccatctgattccaaaagtctgtgaatgtcctacctcaagcatatatatttttaaattctaggttgagcatgtttaattttctgtttccctcaggaggactctggttactttaaatttcaatataaaatttagctgttctgaacatagggagctctattagcacagcagacattctcatgggctccaacctgaatatctaccgcatccacaaatatatgaatatttaccaactctttgccaatgtaagaccacataatggttagtcaagtgtcaagatattcaggttaagaaaaacttgcagtctcaaatatgcttggcgatcacagaatagatgctagatacttatttcaagtgtattatcctataaacctaattcaaagagagaaaaggatagatagacattctacaaagctaggattaattttcatttgaaaaattttattgtacagtttaaagtatgattcatgttaatataagtaaatgccatttttacattttttttccattatcattcttgcaacaaaagttttattatgttttcttggttggatcagagcaattacaactctcaaagtgtctaggaatcatctcagtgcatgtgtacgcagcaataaacatgcttcattctctgggtcagtcagattgttctctctcttccaaatggcctaagaagttaacagactaaatgaaggtgacttgaaaatcatgcttggggcttctctcacactcctgaaagcacactgatctggagttttcagtgtctcacaattccttgatttgagacagatcaccagactatagattctttggtttcttctgcttttttaagtttgatagttaaataagtagcagcatggtatggagggaggagcagaaactgtaaagtgaatgtaaaatagcctgagtgtggtggctcacacctgtaatctcagcactttggaaggctgaggcgtgcggatcacctgagatcaaaagatcgagaccatcctggccgacatgatgaaaccccatctctactaaaaatacaaaaattagctgggcatggtggtgcatgcctgtaatctcagctacttgggaggctgaggcaggagaatcccttgaacccaggaggcggaggttgccatgagccgagattgcaccactgcacttcagcctaagtggcagagtaagagtccatctcaaacaaacaaacagacaaaagaaaacaaaacaaaaaaaggatgtaaaatagatgtaaagtcctcttctcattgtgacctggggcttgtcagccatccctgtgagctcaactttcttatatgtcagtcgtaacactatagtgatgagaatattcttgtcttgtggtagtcattatgcgtgatagaacgtgtaagtacaactttgcaaactatgaaaactttgtcgattattaagaattacatcaatgcctatcccttttgtcctcaaattagggtaaccgctaaacaattataatttcaaaagccatggtcaatataatagccagatgaaggctttatctattttgtaattaaagaaaaacagtggaaaacattaaataatccttattaaaatgtattaaaatctctcatgcacagaagtaatacagacctgatactagatgcataaaatgtgaaactattaataatgggtaagtagatattgtctgatcatttaaaactggagtagaaatataacatccttaatctgcttattctttggtaagttcctagggctatggtaacaatgatccacaaactagatagcttaaggagcagatacaaggggacatcaaaaagtgtgtggaaaaatggaattaaaagacaacaataaaaatatcaatcagctctacttctcaacataagttccatcaagtttaacacacttttgtaaatgatgataccagccatttagtttatccataaagacctgaggatcctgggaatagaaccaagtcaatccactcttcttaacattactaagtgaagaaacattagtgtctttctttttttttttttttgcttaattagaaaagaaagaaagtcagaaggagccaaatcagggtcgtaaggtggatgcctaatgatttccctcgaaattgctcacaaaattgcccttgtttgatgagaggaatgaataggagcattatcgtggtgaagaagggctctttggtgaagctttcttgggtatttttcttctaaagctttgggtaactttctcaaatcactctcatggtaggaagatatcatgatttgaccctccagagagtcaacaaataaaatgccttgagcaccccaaaagaccaatgtcatcctcttgactggtccactttggcattgactaaactacttcaacctctttttagccattgcttcaattgtgctttgtcttctggattgaaacactgaagccactgttacaattctttaagcaaatgcttcaggatcttgaactcacttgttaaagatttccattgaaagttcggctcttgtctgtagctgatctggacacaaagggcttgtcacccactgaatggaaagtttgcttacctttaatttttccatcaggatttagtaagctgaacctattaaggtgttggctattgtttctgatcttagtcattggtccttttccattagggaacgaacaagatgaatattttctgcacgatttgtgtatggtctattactgcaggcttcatcatgaacattgtctcatcccttcttataatgagttatccactcacaaactgcttatttctttggggcattgtccccataaactgttcataaagcatcagtgatgttaccattcttccacccaagtttcaccataaatttggtgtttgttcttgcttcagatttagcagaattcatattgctttgataggggccattttcaagctgaagaaagcatcatccttcttagtgcctcaaactagattttgttctgtcatgttatcttaagttagtgcaacttactttggtgcaaaaaaattgaaatctatgaatagattaaaaaaattttagagacaaatactctgtcacccaggctgcagtatagtggcatgatcatagtttaatgtaacctcaaactcctgggttctggtagtcctcctgcctcagcctcctgagtagccaggactaacggtgcattccaccagtcccagctaaagtttttagtttttttttttaatttttattttgtagagactgggtcttgtcacgttgcccagactggtcttgaagtcctgggcttaagtgatcctcccacctcagcttcccaaagtgttggaattacagccgtgagccactgtgcttggtcccatgggtttttcataatactaattttccatgagctttttgaagaccctttgtatttattgtctcataattttgtaggcaagaagtctgagatcaagttgttggcagggttggtttcttctgagagctatgaaggaaagatcagttctgggactctttccttggcttatatatggttatggtcgtcttctccctgtgtctcttcacatcttcttccctccatttgtgtctttctctgtacccaaatttcccctatttataaagacatctgtcatattgaattagggtccacacatatggcttcattttaagttgattagttctgcaaacaccttatctccatataagctcagattctaaggaacgaggagttaggacttcaacatttgcataatggtgggggagggaaattgtcaacccataaaatagtctatgtttaaaagcatagcccccaaatcaaacctccttatttgataactataaagccttcttgacttgtcaaataaaagtgacaagtctctccatatttgactttcaatttctcttcagccatattattttaaactcaattcccccaaggacaaacatgttcttatacatctttgcatttccaaaagttgatttacttgtcccaaagattttttctttgcttgacatcttcataaatctctctgcataccactttcctcagtcagactattaattctccagtgaagcctttttctaacacctacttcagccttaatgataaattctccagattacaaggcctctctggtctttgtaacaagtttatgctctttgaaatgagtaactctatctctatctagatatatccagagaccaccacaaaaataaggtacagaatacacggcaatcactaaatatatgttaaaagaacaaataaaaagagaacaaagtaattagagagatagaaataaagatggtggtgctgctgattatgatattagcaataattcatatttcttgagtacttaccatatgccaggtatgtgctaattggtttataaattctattctcactttacaaataaaatgttataatttggctaaatatcctgcctcagcttacaaagtgactagaaagagatgccaaaagagaatgacatcagcatggtggccatcaaggtaacatcaaaattcctgtggagcatgggagcccagtataacaccatatagagtggagcatggtaccctgtatctgtcacactgtatctcctactagatcagatcacagacaggagaaacctcttcctacaaggaaaatacaagctggagacactcattggtcttcatcactgccagatacgaatggtaactgatagaggaggatcttctagtccttacaggccctgagttcagtgtgaaaattgctggaaatctgcacagttgcaacccatccccagggcaggagtcctcatggcatttgcaacccgtatgacctaagaagctatggcacagtcttggacattggagcagagttctgcatagcagcaaaactgcatgcacctgtccccaccaacagccaggccagaggcagtcctgccccataagctggcctcacctcagcagagaggtttgggggcagcccctggactcacatgtacctgcccctagcttgacagcttcctagaggtaaacccatttctctagaggaactcttgctcagttgcttaacacatgcacacccacccctgccccttacagaccaggcagtgaccctgacaattcagaagagcctaccacaaaatttgacttccatgcctgcatgtgtcctaccaatgactagtccaccacccttgccactacaacaccacagtcacaaactgctgtagcctaggcctataataatctcacacatcacaatcaagggttgtaactgaagcatctgcacagagaacatgctactgagttcacccagaaccaaagccaatgctacattctcaaccaacatcctaggatccatttacaggaaaaagctttttcctatgaaagttattccataaattggaaaaagaaattgttctactagatacacagatatcaaggtagggacacaagaaacaaaaaagcaaaaaatataacaaccacaaaataacagggttctttgtctctagcaacagatcataaatgaaagggtatttataaaatgcttgaaaaagaattactaataatgatttcaagaaaactcagggagatataagaggatctagaaaaaaaaattcaatgaaatcaggaaaacaattatgatatgaacgaaaaatgtaataaagagatagatactataaaaaacagaattgttggagctgaagaatttaacaaatgaaataaaaatacaatagagagttttgacaacactagatcaagcagaagaaagaatctctgagcttaaaagtaggcattttgaaataaccctatcagaaaaaaatttaaaaaaaggaaagaagaatgaaaaagaataaagaaagcctatgtgatatatgggacttcattaagcaaacaagtattcacattatacaagtgccacagaaaaagaaaataaccaagtatagtaaacatacttatagctgaaaagttcccaagtcttaggggagatatggacatccatgtctaagaagctcaaaagttttcaatgatttttaacccaaaaatattctttccaaagcacattataatcaaaatgtcaaaggttaaagacaaagaattctaaaagctgcaagagataaatgtcaagttacatataggggaatttccattagactatcagcatatctctcagcagaatctctgcatgccaggaaaaaaattgatgacatactacaaacactgaaagataataaacaaacaaaaagaaagcaaacaaacaaaaataaaaaatttctcacagccaagaatattatatccagcaaagctattcttcagaaacagcaaaataaagaccttcgcagacaagcaaaaactgaggcaatccatcacaattaaaatgaccttattagaaatgctaaaaaaggaaacaaaaggataataattaatattatgaaaatacaaaactcagcagtataggtaaatgcataaccatacccagaattccctggtgctgtaatagtgctatgaaattcttcaatattacagtatgtaggtttaaagtcaaaaaggtaaaaacaccaacagctgcaattaatgactaaggaacacatagaagataaatatacaaattacagtaaccaaaatgcaaatgaaaagggagagggaaaaaaagtctatagtatttttatgtgaccaaagttaagttgttatcagcttaaaataggccactatacctataagacttttcatgttaaccttatggtaaccaaacacacacacagacaaaattatagtaaatgtgcaaatgagaaagagaaaagaaacaaaatttagcattacagaaaaccaccaaaccagagaggtaaacaacgagagaaggaaaaagaaacaaaatatctacaaaacaaccaagaaatcgttaacaaacttgcaggagtaattatttgcctataaataataacatgaatgtaagtggattaaattttccaatttaggtttagagtagttaaaaggataaaaaacaaaatcccactatatgttgcctataacagatgcacttcactgttaaacacagacagactgaaagtaaaaggatggaaaaatatatttcatacaaatggaaaccaaaaccaagcagagatacgcatacttatatcagataaaatacatattaagtgaaaaactcagaaaagacaaaggatattattatataataattacataactaactcaacaagaatttacaacaattatgaatatgtatgcacccaaaacaggtctagcaagtattactagacctaaaaggagagttagatagaaatataataatggtaagagacttcagcttcacattttcagcaataaacagatacttttagacagaacattaataaagaaacaacagactcaaactatacgatagatcaaatgtacctaacacatatttacagaacattccatctacagctgcagaattccaagttttcttaactgcatatggaacattctcgagggtagattacatattaggccacaaaacaagtctaaacagatttaagaagatggagataatatcaagtatcttttatgaccacagaagtataaaactagaaattaacaaggaagacttcaaaaaccttacaaatacatgaaaattaaacagcatcctccacattaaccaatagatcactgagaaaattaaaggagaaatttaaaaatttcttgaaacaaatgataataaaaacacatcatactgaactgtatagaaaataacaaaagcagttctataagaaaagtttatagcaataaacatctacatcaaaacaagaaaaatatttataatcaacaacctaattgtataactcaaggaactagaaaaacaagaataagttaagcccaacattagtagtggaagggaactaataaagctcagacctaaataaacaaaatagagactaaaataattcataagatcaactaaacaaagagttgggttttggaaaaaataaacaaaattaacaaactcttggttagattaactgagaaaaaaagagaaaaaacccaaataaataaaatcagagataaaattgaaacatgattattaagatcacagatacaaaggttgcacacaaagcagaatgccagcatctgcttctggtgagggcctcaggatgcttccatggtggaagttgaaggaagagaccacaaatcacatggcaaggctgagaacaagagagagggagtggggaaatgccacgttcttttaaacaaacggatcttgagtgaagtcattaccactcattactgtggggaagacacaaaggcagtcacaagggattcacccccatgactcaaacacctcccaccaggccctacgtccaacattgacagtcacatttcaacatgagatttgaaggggacaaaacattgaaccatatcagacagtaaaagacatttctcaatagaagaaatacacatggctaacaagtacattaaaaagtgctcatcagtaataatgagggaaatgaaaatgaaaaccacaataagatacaccctcaatccaagtagaatgtctattatataaaacccaaaagaaaacaagtggtggtgatgatgtagagacaggggaacatttacacaccgttggtgggactgtaaatccgtacagccactgtgaaaagcagcacggagattactttaagaattaaaaatagaggccatgctcaatggctcactgttattccagcactttgggaggctgaggtgggtggatcacctgaggccaggagttcaagaccatcctgaccaacatggagaaaccctgtgtctactaacaatacaaaattagccaggcgtggtggcgggcacctgtaatcccagctactcaggaggctgagacaggggaatcatttgaacctgggaggcagaggtgactgtgagtggagatcacacgattgcatttcagcctgtgcaacaagagtaaaactccgtcttaaataaataaataaataaataaaaataaaggtagagctaccatatgagccattgggtataaatccaagggaaatgaaattggtatgtcaaagagatttctgctctcccatgttaattgtagcactatttccaaaagccaatttatggaattaacccatgtatacaaccatggatgaatggagaaagaaaatgtggtgtgtgtgtgtgtgttccatatatacacacatatatatgtatacacacatatatgtatacacacacacatatataaatacacatatatgtatatatggaatggaatactattcagctgtagaaaagaatgaaatcttaccatttgcaacaacatggatggacctgaagaacattatgttaagtgaaataagccagacacagaaaggtcacaagatctcattccatgtagaatctaaaaaaaaaaaaagttcatctcatagaagcagggagtaaagcgaggggagtagggagggaaagatggagagaggttggtgaatgaataaccattgataattacaaggaataggttgtggtattttactgcacaatgtgatgaaaatagttaacagtaaggtattatatattggaaaacagaaacgagaggattttgaatattctcacctcaatgaaatgatcaatgcatgaggtgatggatacactcgataccttgatttcatcattatacaatgtatatatgtattaaaatattacattgtatgccataaatatgtataattacaagatttcaacaataaatttaaaataaatgcacaagtatgatgtcagaattggaaccatgaagatgaaactcaaagactatattctcgatcaatacaaatttttaactactaaagaataaaacccatgtaagatgttttggttagatggtacagtttattttgcagaactcaccttcatccgtgtaccttttttgaaaactcaaagattactaaaagagctttgaaatatcatccttatggtttgttttatagcctgagttttacaattcacatttaaactccttggtaattttttaaggatttttcttctacttgagtctcaaatttcttatgaactatgacaagactaaaagatactgagtgagaatagaaaatagaaacaaacagggccaggtgtggtgactcacacgtgaatcccagcactttggagactgaggccagtgaattacttgaggtcaggagcttgaggccaggctggccaacatggggaaaccctgtctctactaaaaatacaaaaattagccgggcgtggtgatgcgtgcctgtagtcccagctactcaggaggctgaggcaggagaatcacttgaacctgggaggtggaggttgcagtgatctgagattgagccacgagccactgcactccagcctgggcgacagagcgagactcctcaaagaaaaaaaaaaaaaagaaagaaagaaaggacaagctgctgagtctcttgcgcaagacttctgctgctggaggcttgataatctcttttattgccacttttttttttttttttttttttttgctccagacatttttatcaccttctggtaatttttcttcacttcacttcaatctgaattgtagcctttctgaaagtatttatcactgtgattttgtttgctgtagcttattaaatgcccttttggtcctttttaattgacctttttaaatatgagctcatcttagagaactatctttatatctaaaattagtccttagaagttcctagttgtatttcttatcagggtcacttgtaattataatgtcagacttttagaatgaaacataagcatttgtcacatttagccatgattggtattcttagcactgaactggtttccttaactctagtaagttcctttctaatttataaattatgtcaagtttctaatgttttggattaaattctaaaggatattatcacactttccaaccatgtctgtcatcatgcacattagtttactagggctaccataacaaagtggcactcagtaggtggcttaaggacacagaaatttatgtcctcatagttctagagactagaggtccaaaatcaagttgctggccatgttgtttccttctgagacttgtgagcaagaatctgctctgtgcccctctcatagcttccggtggtttgctggcagttcttagtgttctgactagtaaaagcatcactctgatctctgtattcatctttacatcaagctctccttgtctgcatgtttatgtctaaatgtctcctttttatcagaacatcatttgcattgaattagtggcccaccttactccagtatgacttcatcttcactaatgacactgcactgatcctatttccccccaaaatgtcacattctgaagcactgagggctagaagttcaacataagaatttggggggtggggagacaccatgcagtctgtaacatcatgtcacttgacacagcaaaaccactaatgttttccattaccccgtaggacaggcaaaccctaccttgcctataagacctatcacaaggtgtctgtaaacagtgttatgatagaccacctcttccattagcccttatcctcaaatacttgtctattcaccaaaaacaaagcatgttgtctgctttctgacactgccttgttgctctatactttgcctgcttgtatgtatgtcattaggatttctcttcaccgacatagcagttaagtatgttccatgtgtctttttgtttatacattcccattttgctatatattgtgagtataaaaaaaacagcagccaagcctttcatgtctttgtaacacccacagggcccataaaagtgtataccacatagcaggtactatatattgttttctttaagagatgaaaaataaagaataaaaagtgaaagactagtcattatactaaactaatctacaataaaatgtttaaaattttaacattttgatttaaaaataatattaaaatatattaaatatttaagcctaaacaccttattaatcataacaccatttattaatgtatttttaactaatatgttctaaaactacatgaatgtgagtatggataaaacatgtcttcaaaaatttgcagactggtaggggagatggacaatatataaggaaatagcagaattgagggaaatccattccaaaagcattgttttggaaaaaaaattatatttaacatgtttaataaatattttgtaagaaaattttaaaaagaaagttattgtaacttagaaaattaagggatcttcactcccagaactgcatttttaagaaatcaatggacagacccactccacaaccatttaactgcttaactggaaaaaagggtgtgtgtgcgtgtgtgtgtgtgtgtgtctgtgtgtgtgtagtttctaaaaattgtcctaagagcatacgtcaaatggagaatcatttattcaaggaaagctactaaatcttaatcagaataacaataatctgtgacatttgagccagctgcctgctaccacctctgtgttcagttccatgtgatggaagagctattctgaataagtatggccaagaaggcatggctttgtagcccccctgctcccctcttaggagttcagtttaaaccccagaagaggcacacccaccagcatgaagcacccccaccagcagaagcacacccaccagcagaagaggcacacccaaaacccttcggcttgtgcagcaggagctctttctgaggcaggcatggttaaaattgaggctcccttctcccactgaacatacactcgttaagaaaagctttatccaaggaattgcagatgaaaaatactggaccctattgtccaaacctagcccacttatagggtgtagttttcttgccaggaggagaaaactaaaaaggacaaatgctgccatttacatctagcaccctcctcgtagagtaggggtgcccctccgtgaaaagcagaaaattttccctgtccccatgtgtggtgcagagtttctgccaagagtgaggcatgccataaggacaaagagcctcacagctctccctaagtgaagtagtgttctttgaactaatttcgaagggtgtttcagaaaacaatgtagatttggttggtgagcagttaagagggggtaaaatggtagaccagctacaagtttaacacatttgtgcctgagattcaatctttttgaatttttgcaatcagtccttggcgatggccttgagcagtatgatataaataactctcacatgcttagtgtttcaataatggaacactagacataagtgggaagagagataaccaggaaagaggacagctaaggagccctcttcagttaagagcaagctcaaagaaggacaaaataaccctactgccgcaaatggagctccaaacttaattgaatcagactgtagaacaattatgcccctgggtcttgtcaaaaataataaagcaatcagctagcaattaatggaagccgacagctaggtgtgaaaccaatagaggcagagcagccagaaagttaacatgaaatcaaggaaagaaacagtcaaaggaaatctggaaaagccacatccattactttgtccaaggaatctgtgcacatgagcagtaatatgtcctctgagtctgcacatgcaagaaaacagacttcgctgaacaaatctagcctagctagtaacaaatgaaacaacagcagcagcaagcttggagtgcagaatcaatatgcagagttgctacaatatattatttaaaatgctgagttttcactgctagatgatccgaaagcagtttcactgatgaggatgctaatactgtatattttgagtgtttaaataacactatgaaatgtgagagtaggaaatattatattactaatttttctgaaatatgctattttaatgtgtatacaaataaaatatatttttgatgaaacataaaatgttcacttttcagaaaagcactgtaaaacatgcaaagagacaagaaggtgtcatccatacacaaaagaaaatcaagtgatagaatttgtttttgaggggtcatagatgtagacttcaaagcaattattgtaaaaatattcaaacatttaaaaaattacataattaaaagatggtatgatgataatatctaattaactagagaatatcaacaaaaataaattttataaaagaactaagtgaaaattctagagttgaaagtagaataattaaaacgaactattcactcatggggctcaatagtatatcaaaacttgaagaataaacaatctatgaacttgaagagacaaggatagagattatatcatctgaataacacaggaaaaaaagaagaaagaaaatgagcagagtctaagagaaatgtatgatgccattaaatacataaacttacacataatgagattaccgcctgatgagattaccagaagagaggacaaagaaaaaggagcaaaaaattattttaaaacatagtagttgaaaatgctctaaatctgattaaaaacattaatttacacaccaaaaagttcaacaaggtctaaacaggaaaaatgaaaagagacctaaatctatacatatcacagtaaaaatgttgaaaggcaaagaagaaaatcgtaaaaagattaagatacaaagggatcaccataggattaatagatgacttctcattatttacaaggacattgccatggaatactgaagtcagcgtaatgacatattcaaaattctgaaagaattatgaaccaagaatcttatatcaggcaaaactagcttttttcaaacattaaaggagaaaatcagtcacagtggctcacacctgtaatcccagcagtttgagaggctgaggcatgtggatcacctgaggtcaggagtttgagaccagcccggccaacatggcaaaattctgtctttcctaaaaatacaaaaattagccaggcatgttggtgtgcacctgtaatcctagctacccaggaggctgaggcaggagaatcacttgaacctgggaggtggaggtggcagggagccaatgtcacaccacggcattccagcctgggcgacagagagagacgctgtctcaaaaaaaaaaaaagaaagaaagaaagaaagaaagaaagaaagaaagaaagaaagaaagaaagaaagaaagaaagagaaaataaagaagaaaagcacatttccaaataaacaaaaactgaatttgttcctagacaatccatcttaaaagaacgactaaagatgtatggttttccatatgatatatatggatcttggaagttgtcaatttcattcacactataagaaaaagctgaacaaactgaaaatcaaaaactcttagatccttcagaaaactgagacaataggagaaattgctgccacataaattgaagaagcaggaaggtaaatgcagatgaatcacaatttttttggaatataaacctaggagaagaaattttcatgagacacagtctggggttgggaaaccgaagctgtaattgataaactggtggatgagtattaatagttccaaggagtacctgtcttagaagggtttcccacacttttatgtaagttttgccactgagagccctaccaggttttcaccaaaaagattggagaaaaaatcccttatgcttctggcagagggagaaaaaagcaactgttttgaaatacacctgggacattctgttcttaacaagaattaccctcaaaaccaaatagtttactagagtctaacaaatggtttttaccagagtttaagcaactgagaggaaggaaaatatccaacttcagcctctctctagatttcaatgtggcagggggaagaacaatactcaactgcaacccactccaaacttccacattgtattaaggacatacctagctctagtcccttgtagcatttctgtctcaccaaagcagaggagactgaaaaggatttgttaagtcacaacacagaggcacaagctcactaaaaaacagaactaagcacgggactatagtacacttctccacacacaacttacaaatgcatcactaaagtactgttgaatgcaggttttttcacccagtacatcacatccagcttttaacacacacacacacacagacacacacacacactacacagtattctaaaaagcaaaagagagtttgaaacaacaagaaaaaataagcataagaaccagaatcaaatatgggaggaatggtgaaattatcagaccagaaatgtaaaataaatatgactatcgtgttaagagctaatggaaaaaaaaccagacaatattcaagagtagataggtaatgtaagtagagaaatagcaattctaaaaaaaaaaaaacaattaaaaagaaaagcaagaaattaaaagtattgcaaaagaatgaagaatacttttgatgggcttattaggagaatgaacatgattgaagaaaggagatcatggaacatgaaagtttttctgtagaaacttccatactgtgggataaatacaatagctataacacatgcataatgggaatactagaaagagagagaaaaaaaggagcaaaatatttaaagcaacagttactgatagtgacaactcttttacaagattaatttcacagagcagactacatacccaggaagttcagaaaacaccaagcacaatacattgcaaaagaactacatctaagcatattatattcaaactgcagaaattcaaacacagatcaaaaaaacatgaaaaagtgaggtaggggtgacaaccttatctgcagatgagcaaggataataattgtatcactcttgtcatcagaaactatgcaagcaagaagaaaatcaagtaaaatatttaaagttttgaaaaatgaattctcatcgatttagaattccattcaagtgaaattattcttcaaaagtaaaggagaaataaaacttttccagataaataaaaattgtggatattgttgttagtagccctatcttacaatgaatgttagttcttcgaaaaataggaaaatggtataggttagaaaccttaatatagttttcaaaatgaaaagcactagagaaaaaataagtaaaggtaaaaattttttttattcttagttgatcaaatagacaacagattactactaatctgttagttgctactaattattagcaacaatgtacccagtggatataatttatggataagtgaaatgaaagtaatgacagaagaaatggtaaggcaaaattgggaatattttctattaaggtacttgcactctctgaaaagcagtacattataatttgagagtagacttgcattagacgtaaatgtaaattgcaaattctagaacagccaataaaaaagtgaaaaaaattataactgacatgctaaggaaggaaagaaaacagaatcacataaaacattcaattaaaaccatagaaggctgaaaaagagtggaggataaaaagacaaacaaggaacagaggagaatagattataaatatatcatatatgaatgtaaatttattaataatcactttaaatgtcaatggtctctatgcacctattaaaatatagagaatttggcaggggtccctaaccccagtgtatgtgctcagatcacagtaaaattaaactggaaatcaataacataaaggtagctggaaaaatcaccaaatactagaagattaaataacatatttctaaataacacatgggtcaaagaagaaatctcaagagatgtggaagatattttgaactaaatgaaaaatagcatactaagatttgtagaatgccatgaaagcagtgattaaatgtaaatgtataacattgagtgaccatattgaaaagaagaaagatcaaatcaataatctaagtttccagcagaggaaactatagaaataagagcaaattaaatccaaagtaagcaataataattaaaattagaacaaaaatcaatacaattataaacagtaaatcaagagaaaatcagcaaaccaacatctgtttttttgtttttgtgtttgttttgagacggagtgtcgctctgtcacccaggctggagtgaagtggtgcgatctctgctcactgcaggctccgcctcctgggttcacgccattctcctgctcagcctcagagtagctgggactacaggcacccaccaccacgcccagctaatttttttatatttttagtagagacggggtttcaccatgttagccaggatggtctcgatctcctgactttgtgatccactcgcctcggcctcccaaagtgctgggattacagacgtgagccaccgcgcccggcccgaaatctttttttttaaaagatcaatgaaatcaataagcccaggctatctaaaaagaaagaaactatcaagctgtgaaaagacatggtaaaactttaaatccaaattactaagtgaaagaagaaaactggaaaaacaacatacaatgctactccaaatatatggcattctggagaagacagaactgtagagagaatttaaatcacttgttttcagggattagaggaaagagagagatgcattatcacagaagggagaatttttagtgcagttaaaatactctgtttaatattaaaatactccgtttagcagtctattttataatggtggatacatgtcattatactcttgtccaaatgtatgtacacaagagtgaaacctaatgtaactatgaacttttcgtgataatgatgtgtcagtgtgggttatcaattttaagaaatgtaccaccgtggtgggagatattgataaggggataggctatgcgtgtgtggatatggtacatttctgtaacttctttttaattttgctgtgaacctaaaattacttgaaaaataaagtctttaaagaagatatatatttgaggtaaagacatggagtacaaaaggaagaagacaagatgataagacatatagaaagaaaagcaaaatgacaaacgtaaatctaaccatattagtaatgttattaaatataaatggattaaataaggtaataaaaaagcagatattatgaaaattaattgaaatggaaagtgtctctaggagacacaacttagattcaaagacacacgtaaattgaaactaaaatgacagaaaaagacatataatgcaaatgatgatcttaagatagctggtgtggctatactaatagcataaaatagatttaaaggttaaaaaatttactactaaaaaagtaacttcatttttaatgaatttaaaattcatggggaggaaataacaattataaaaattataggcatcttacagaggaaacacataaagtgaaaacacaagtttgaatgaagaactagacaatttcacaatagtagctggagacttcaatacaggtagagcaagcagaaaaagcacaataatgcagaagacttgaacagctctatgaatccttgctaaccccaacagacatgtgtagaacacttcactcagtgattgcggcatacacattcaagaacacatgaaacatctgtaggacaaatcatatgctaagccataaaacaagcttcaatacatgtaagaaaattaaaaccatcaattgttttctctgaatgcaatggatgaaaagcagaaattaataacaaagaagatgtggataacccacacatatatgaaaattaaacattaagcattctcgaataaacaagatatcaaaatgagaattacaacggaaattagaaaatacttgaagatgagttaaattaaaacactgcataccaaaacttacgggatccagataatgtagcgtttacaaaaacactacattatagctgtagtctattatattaaaaagcagaagaatctcaaattaataaccataattttatcttaagaaaccagaaaatgcactgggtgcagtggctgatgtctgtaatctcagtactttgggaggctgaggcgggaagatcgtttgaggtcaggagttcgagaccagcctgaccaacatggtgaaaccccgtctctaataaaaatacaaaaaaattaattgcatgtggtggtgcatgcctgtactcccagctactcagggggtggaggtaggagaatcacttgaatccaggaggcagaagttgcagtgagcagagatcgcaccactgcactccagcctgagcaacagagcaagcctccgtctcaaaataaaaaaaaaaagaagaaagaaaccagaaaaatgaaagtaaactaaacccaaaacaagcagaataaggaaataataaaatggaaacacataaaaatatagaagagaaaaataattaaaaaaaattaatggtaccaaaagttgatactttgaaaacacctgcgaaattataaaacatttaaatagagagaagacttgaattattcgaatcaggaatgaaaaggagaacatcattactgagcttgcagaattaatgaagaaggtaagagaatactataaaaaactctatgtcaacaaattagataatttagataaagtggacacattaccagaaagaaaaatataccaaagtaactcattaagaaatacaaaactagaatagacctataaataataaagagttgaaccaataattttaaaaacttcttccaaggttaaaagctcaggtcaaataatgttactggtaaatccttccaaatatttaaagaaaaatttacataaatgttttacatatgattctaaatatttaaaaaagagtgaacactcctaactcattctgtgaggttattaataccacaatatcataaccataaaaagacaacacaaagaaataaaattaccaccaaataatttttatgaatatatagcaaatatttgcaaaacagcaccagaaaatcaatcccagcaacacatagcattatattccacaacccggtatcacatattactagaataaaaagttggtttaacattttaaaatcaataatctaatacatcatattattggaataactggaaaccaccggattttcttaatagatgtagaaacattatttgtcaaaatataacaccattttatagtgcatacactcaggagactggacatagaaaacaatctgatcaaccttataaagggcatctataaaaaacctatagctggcaatattcttaataatgaaaaaccaaagcatttcttggtaagttctggagcaagaaaagagtatttgcttttgtcacttctattcgaatttgacaggaagttctagtaaggcaattcaccaagaatatggaataataggcatccatattggaaataagtaataaagctatttttattttcagatggcatgatattataggtagaaaatcctaggatctacaaaaatttagagttaattaaaagttcagagagacattaaatcaattgtatttttataaagtagtgatgaaaaacctttaaatgaaataaaaaaacaattacatttacaatgatatcaaaaaaatgaaatactttggaataaatttcatgaaagtggtataaaacatatacagtgaaaactagaaaaaaattaaaagaaattttttaagaaacctaaatgaatagaaagacataccatattcatagatagtaagaacactgttaaaaaagctatactttacacattgatctacagattaaacacaatttatatcaaaatcctagctttttttttttgcaggaattgatgagctaatgctaatattcatgtggaaatgcaaaggacctagaatacccaaaacaatcttgagttaacagaacaaagttggaggactcacatttctagattttaatactcacttcaaagccacagtgagcaagaagtataagactggtataaggaaagacatatataaatcaatagaatagaattaaaattccgaaaaataagtctcacatttatgccaaattgattttcaacaaagatggtgagagaattcagtagaaaaatattcttttcagcaacttatcctgaaacaactagttatacgtaagcaaatgaatgaagttggatcatgtcctcaaatcataaacaaaagttaacttaaaatagattataggtttcaatgtaagacctaatactataaaaatcttacagagaaaatagaagtaaattttcctgaaatttgattatgcaatgacttcttatgacatgaaaacaaaaatacatgtgatgaataaatataaataaattaataaaattaataattttggtggggcatatggtaccacaacagaagtgaaagacacagaattatgtgtgtgtgtgtgtgtgtgtgtgtgtgtgtgtgtgtgtatatatatatatatgaatgatacaaatgttaataagaaattaaataaagcagtaaactttctccttaagctaaccaaaaaaagcgaaagagaagtagaaatcattgtgtgattcttgccccccggttttgagccacagtgctactcttcactttggaaactccactttaagcatcagtgactggaaaaatcccctgaagccactccccttgggtattttccacttgctcagacatctctgtgtaggaacgttaacaagatcaccacgccccagagaagctgtctgtaaagaacatttatatttaagacaccctttttttttcatagttactaaagattttcattctgctatccttaggacatactttaaattcttaaaaatgataaccatttctcatttgtcaccatatctaagcaaatagtatacagtgtaatgaagttctaaattttctttcagatgtttacaggtttttcttttatgcctttactgtgttattaaagtttaaatgtatgaaggtttttttagggttaacctaaataattttatatagcagaaaaagtatttttaaatcatatgtctgataagggatttgtagccagaatatataaaaacttctgcatctcagtaataagatgaaaaatgacctagttaataagtgggtgaagcatttgaatagatatttctccaacaatagtgtacaactggcaaatatacacatgagaagatattcaacatcgccagtaatcagagaaattcaagtcaatctatgagctatactttacatacacaaagccggctataataataaagtgataggcaatacctacagttggtgaggttgagaaaaaattagaatgctcatctattacagatgagaaggtaaagtgctgcagccatatgaaaaataacttagcagttcctcaaaatatcaagttcccacatgaagacagcaaggcttattcaaaattcaaaagtcaatctatgtaatccaccatattaatgggctaaagaaaaaatatatagtagtatcatttgatgcagaaagcacatttgacaaaaaaattcaacacttgttcatgataaacatctcatcaatttaagaattaatgagaactaactcaatagagagaatctacaggaaaaatagatactgctaatgtattcagtgatattgtgagttctttccctagaaatcatgaacaaagcaagggtatacatgctcaccacttttattcaatacagtactagaaggtaaagtcacacacattggaaaggaataaataaaactattcctgtttaccaatgacgtttttgactatatagaatatttcagtgcatctgcaggaaacttccagaaacactatatgagtttagcaaggttacatgacgcaagacccacataaattgatttgcatttccatgtactaataataaacatgaggaaacaaaaattgaaaatacaataccatttaaaatgtatccacaggaaaattatttggtaaaaatttaacaaaacatgtataagatctgtatgctagaagtcacaaaatgttgctaaaatgaaatcaacctatatttaaataaatggagagacatattatgttcatggatccagaagtaatggaagattcagcacagtaaaggtgccaattcattctcaaattaatctatagatttaatatccatcaacatctagcaagtttttaaaatagacataagaaagacatattttttaaatagacataaaataaacatatatggaaatgctctggtcctagagtagccaagacaatcatgaacaaaaaaagagaataaagtgagaagaatcactctaaccagtactgacctttaataaatagctacagcaaacaagacagcatggcactggaggagggagagatacacagatcaatggaacacaattcagtagagaacctaagaatacgtatacatactcatacatattcaattttttttttttttaatttttaggcagaggctccctctgttgcccaggctagaatgccgtggcaggatcttggttcactacgacctccgcctcctgagttcaagcaattctcatgcctcagcctcccgagtagctggaattacaggcacacaccaccacacccagctaatttttttgtatttatagtagagaagaggttttgctatgtcaccctggctggcctcaaactcctggcctcaagtgatatgtctgcctcggcctcctaaagtgctgaggttacaggtgtgagccatcgcacccagcctcaaccagtttttgaaaggtacaaaagcattttatggaaggtagggtggccttttcaccaaatgatatttgagcagttagatttagtgggccaagtaaaaggggctaaaccttacatcttatacaaaatttaactcaaaatgaattactggtttaaacatgaaatgtaaaactattcaacttaaagaaaatatctttgatatctaaaactgggctaagaattcttagtcctaacattgaaagtatgattcataaaaggaagaattcataaattgggctttataaaaattaaaaatattcaccatataaaatacctgtttaggaaaagacaaactacaggttgaaagtaaatatttgcaaacaaataatataatatctagaatacataaagaacacttaaatttaacatggataactgagaaaatttgagcaaaatttgttgattttattactgtcataattatggtcatgatagtgtataagtttgcccaggtgttaccactcggggaaatgctataaagtgtaaactacgtctctctatattcattcttacaactgcttgccaatctaaaattaatgcaaaataaaaagttaaggaaaaaaaattatgtgccagcaaaattgcgttttaacatcctccacagcaacctcaaagtatggtactcacattggtacatacaacccagcagtccaaatatgtatatttatgtgtaaacttttagtactgaccacgtacaacagcttgcatttggcaaaaagataatttgaaatagaaaataaagagaaaaaaaacagagttttttccttcaaggattctgtaaggtagtcagaaaataagacacatacaaatgactgtggtacaggcagtatgtggggagttacataaaagacgtatacacatttactctatgagcttaggaggaagatagcaatgctttttggaaaagttcatggaacacaggacttctgcagtaaactttaaggacaaaaagattttttcttctttctccatgtgtttttaattcttgtttaatcctttctttatcattccttatgattgaaaataatttttaaaaagatttttccaagtataagttagtaatggggtaacttcagggtaaatccagcatgaacaagaatatcaaagcagaaaacatgagctagcagaatacaatcagcctatttcttccaaagcaagagctataatatatgatgacagcagaaaaagatgcaggccagattttaggttttgaatgccaggttaagaattttatttttgtcctatagagtgacagacgctattaaaagtgtttcagtggggccacacagagatgaaacaggctatccaatgaaaatgtgtatgtgaaaactttcagtcctatcatagatatagaaagaaaaagaaacaagaactataaaaagagaaagctgtactgtggatagttctctaacaaaatttaaccaataactctcttatcatcttgctggatcttcaaaaaagtttatgaattcaacacgaaaaatctgttatgattggagatcagagaggtatctcataattttgctgtcataatcttccaagtcagaggaattgagatctgcatggcctttgaaggaactaggttgataagctagatttgagaacttttcctccctgtgaagtcaatgagggaaggaaactcactcctattcaggtctctgttgtcattgctttgcatagtacttggaacataataacagatcaacatgtattttgagtgcattatgaatgaagacaaacatgagataaaatcaaaaggcttagcacatattgattctgagtgtaaaagagaaagaaagacctaaaaacaaagagctgttcaagccctgtttctggtaagaatagagtttcaataaagaatcaggaaagtcacagccacaccgtgtgaattatgagccaatcactgctcagctgtttgcgatgcctttgggtatagttggaagacgataaaagttactctaaatatgtgcttgctgcctctgtttttgccatttacaaatactcagagacagaaaaatagatgaatctgattattttttctaaaggagaacatgagatactctgtaccaaattcaaataaaaaatgagtgctttgagattgcatgattaaatagaataacaacatccctggcaaacgtgattaagggagaagattatagaagcatgtgagaaatggaaagtgttattaaaaatatgtcagcttttggtatatcatccctaaccctttcagaagatccattattatgccaacaaatttcgtgtaagaataatgatagtgacatttactgaagaactacaaacaatataactttccattttaatgtttcatatttctcatgtttatctaagactcagaaaggttttaggtttgtattcaaattcaaggtgtttttattcacttctttttaaaattagtaaatattttattttggcatctgcataaagtctgaaattttatgaaatgttctgaaaatgaataggcagtaagttttaatgggctgtagctttttaagctgtttttgtggctgattaaatttataaggttttatttcatatctatatagatttcttataactattggctttccaaaaactaaattatcaggcaaaaaattaaggtataattcagttttctttcatcgggatggttcaactgagctttttagagaggtagagagtacattcgtatgacagttgacctcctaaatatttcatcctgaaaattccattactaagattctctgggaatctctgggaattctctgggaatgcttttgtttaagacataaaatatacatacctggtgttatgatatgaatgcctgtgttcccatgaaatgaatacattgaaatcctagctccaatgaaggattaggaggtggagccttttgaaaggtgattaggcaatgaaggcaaaaccctcatgggtgagattaatcccctcataaaagagaccccagggagctcttttgtttttttgaccaggtgagagtacagctagaaggtatcatctatgagccagaaagcagccctcaccagatatcgaatctgcctgtattttttattggacttcccagccttcagtactgtgagaaataaatttcaattgtttatcagccacacagtctaaggtgttttgctatagcagccaaaaggaactgaaacatttagttatatatatcatcaatttggtaattatttgcaaactgttgaggttttctcaaatgtttatttggctagtctgcattgtatttccaagaattaccctttctgtgtgtttctggttacagtgggccacaggagatattcttctgggacagttcaagtgtcaaagtgaagcagcagcttttttgtagctcacatatacatttgctttcatgcctgcaactttctgtctttccctggatcctctgtcagcttctttgattcctgggccaggtgtgcacagaactttgtgccataacaaagagacctggtgctgtaaggcaccaggacatgaagattgttcacagcaaaaattggcactggcttcagccttccctgaggacttcagctcttgcttgacgggtatagatggttcttgttctctttggctttctatgcatagttccctcccaatggccacaggatacccgtggactttaagcactagtatcagactagaagaaaagagccatgaaccttgatttgtatcatgtacatgtgtacgatgtatcatttatatcatacaacttgtaattctacactttctttttttatagacagagtctttctctgttgcccaggctggagaacagtggcacaatcatagctcatggtaacctcaaactcctgggattaagcaatcctcctgcctcagcctcctaagtagctgtgactgcaggtgtgtgccaccatgcctggatacttaaaaaaaaaaaaaaaaattctagagacagagtctcgctatattacccaggctggtctagaactcctggcctcaagcagtcctcccatgtcagccacccaaagtgctgggattacaagcacgagcatatttttaaatattagtgtttattcaaattttttataattacaaataagaaatagttatctgaaattgtcttgggagaatgatgaaatttgaatcaacatggtaaatggttaggatgctgatgtttagaacagttttaagatatttttaacaaatcttaggatgttatattataagggctttgagggaaataaaagcagccttcagaatacaattgtgaagtttcatactaagagcctcatacaaacacttaatccaaaatggttcaaaatgttttgaaaaacacaagttctgacagaagtctgcacaaaatccacatactttgtcattccttcatttgacacattgatgtggcatctataacctgtgccaggcactgttctaggtctcgggttatataaataaccaaaagagaaaaataattctgccctcttgagcttatactcaggaaagaaataaaacatatgataactgcaatagtaagatgctgtgtgtaggttaagtcattttaagcattatgaataaaattgaaagttgttcggtgtcatgggtattggaaggattggaagcactaaataggagcagatgcatgatgcagtttcaaacagaatgatcagtgtaggcctcctggggctggcatttaaacaacaatttaaagaaagagataagagggttaacaatggtggtgacgaatatcttaaattctgggaataatcatgccaaggtcctaaaatgagttttggactggtatgtttggtaaggaaggaagcatgtttgactgaagccaaagagggagaagagtgatgagagaaaagtcagatatttaatggaggatgtcctggaatggcagtatgaaaagacttaggaatcatcttatttatttagaccctttttgattcatttcatcaaaactttacagttttttacatatagattgtgcacctacttaattaaatatttatctaattatttccttttttggttctatttcaaatttcaattgttaaatgctggtatataagagcacaactgaattttgtgtgtcagtttttgttgttgttgttgttgttgcttttgagatggagtctcgctctgttacccaggctggagtgcaatggcgagatcttggctcactgcaccctcgcctcccaggttcaagcgattctcccacctcagcccccctagtagctgggattacagatgcaggccaccatgccaggctaatttttgtgtttttagtagagacagggtttcaccatgttggccaggctggtctcaaactcctgacctcaagtgatccactcacctacgcttcccaaagtgctgggattgcaggtgtgagccacagcacccggcaatatataaatcatgtaccctgcaaccctcttataattacttataagagtattttttgtctattattgggattttttacatatataattatactatctgtggaaaaataaaaaaaaagtttttacatttcttttcaatttgtatattttaaaatttccttttcttgacttattgcattagatgagacttccagtacaatggctaatagcagtggggagagaggacattcttcccttcttccccatcttaggataaagacacctcatctctctgactcgtgaagtatgatgttagttgtaggtacttttggagatgctctttattaaattgaagaaatctctctatattcctaatttgctgaaaggttttaatcattgatgggtgttattttctcaaccaaatttctgcatgtattgatatgatcatacgattttatctttagcttgctgatgtgattgattgattacataattgattttctagtgttgaactagcgtcaaatatgtgggataaattccactcggtagtactatgtaattcttttgattatttcgattacaattctataatcctgttgaatttgatttgccaatatttttgaagacttctcacctatatttataaattatgctgcagttttccttttttttataattctttatctggttttggcattacggtaatgctggccttctagagtgaattagacttctatattttggaagggattttaaagaattggtgacttttcttccttgactatatagtagattttactagtgaaatcatccaggtctggtattttaaaaaattattagttattgatttattttcttaaatgaatcaacactctaatagtgtttgtcttttaattgatatttagacaactgatatttaaagtgattacttatatagttagattacctacaatatgtgtaattgtttttatttgttatatttgttctttgttattttttaaatctttgtcttttttctgccttctctgatgttagtgaatatcttattacatgatatttcttttcctcttctagcatattagtttatatctttaaaaaatatttttgtgtttcttctagagtttgcaatacgcatttacagtaatctaagtccggcttcaaataacattataacacttcacaagtagtgcaggtaacttaaacccctgtgtaaaacatgaggtgatttttctctattcttcaccattagaaattgcggtgctggaggtagaacccatgaatttgtggagctcctaccccacctaagtccgggcccccaggcacctttaccttcaagcttcaccacattcagcccccagcaattcattagttactgtggaaattttcctgcaagatatggactccagcgactactgctctaagttgatcttgactgtaagattccctgcatttgcttgtcttttcagattttagggtggcattttgccccatgaccaccattcttacttggatctaagaaaagataacttgtttctctttgctctggtttctcttgaggaggatggagtgatgctttcagatccccagtgctgaaatcagaagtcctccaactaacaaatatttaatgtgtttatttggtaaccaatgtctattttattttttaacttattttacttctgctaaattttgaatctctacatattttatttcaatatataacaatacctacgtaccagagacatctagaagcataactcatttaaagagcaagaactagggagacagctgtgatttgccacagtacaggcccacggcattctgcttgtttgttaattggtagatgatggaacagttcagtgagtcattgccacactacagacctacaagctctcaacactcacaactgtgatacagctagaaaatgttcttagcagtatgctgtgacttattctaaattcgtcatcagcattcaacttaggttttagcacacatatatgtgcaagtaaattttatatatatatatatatatatatatatatatatataaatcatatattaactaactaaacaaaaaaatacaggttcttgtactttaatcttccttttgtaatatacctagaaggcaatgattttaacattctggaaggaaactgtcattgcttttttcctcttcattttttgtaaattaaaagcaccaggactcatttgggcaagacactgattaaaccctaagcctaaatctatgttgagtttttaatcatttcatgctatggaataaatgtaacaagcactggtgtattcatctgcctctctacctgaagtattaaatatcaaaaataacatttttatacataaagctctagaatatacaaattattctaaattaaaataagtttgtcttagccaggaaacacagtgagacctcacctgtataaaaaagtaaaaaattagttgagcatggtggtgcattctttttttcttttcttttttttgagatggagtcttgctccgttgcccaggctggagtgtagtggcatgatcttggctcactgcaagctccgcctcccaccattctcctgcctcagcctcccaagtagctgagactacaggcacccaccaccacgcctggctaattttttgatttgtagtagagatagggtttcactgaattagccaggatggtctcgatctcctgaccttatgatccacctgcctcggcctcccagagtgctgggattacaggcgtgagccacagcacctggccaaagtggtgcatttttgtagttccagctactcgggagcctgagatggaagactctcttgaacttaggaaatcaaggatacagtgagctatgattgcacctttgcactcccgcttaggcaactgagcaagaccctgccaaaaaaaaaaaaaaaaaaaatgagtttgtctttcacagaacatctaaactggaaacacattataataatataatgaataaatctaattatggtttaatattcttttatactcaattaactactgtggctttattagattacagaaactttttcagacacagacaaattatatgtatttttgaaatatttggtaaatcattaaatgaaataatttcttatcgaaagtaagggagacctatgtgatttcaatctattttgaacagagttgaaaataatactatttggctgatagttgttataaaatggaatccaaagcaacattaaacaattgtgtgatatgatcttacattggtataaatagatattcattctttgtgcagaggtgtaggtattctacaaacttttcccaagctccatttccaagttgtatacttaatgcatcaaaaaatcataaccttttctgagatattattctcttctgtcttattaggaagacacctaatcaggatttgtataaattaagtttttattaattttatttacatgtactcattattttaattaattataccgtattaattttatcgatggttatgaaaggtacctaatcaggatttacattaactaggaagagcacgctggctcacacctgtaatcccagcactttgggaagcctaggcaagtggatcacttgaggtcaggagtttcaggccagcctggacaacatggtgaaacccagctgtactaaaaatacaaaaattagccatgcttggtggcgtatgcctgtaatctcagctgctaaggaggctgaggtgggagaatcacttgaacccaggaggcagaggttgcaatgagccaagatcgcaccattgcactctagtctggccacagagtgagactccatctcaaaaagaaaaagaaaaaaaaggacttatattaattaataaaaattaattccatgaatttttctttctctataattttaaggaaaggtgtaattttctctcattgttgaatataatatttttcaaagacaaagagttgcttagttatttataggtctttaatccttgtaactgcagagattgttttcaactggctttgtactttatgtctgtctgttggctttggccttgttctttctgcctcagtaaaagtataataatgatgcctgcctaattgaaatggaaatctcttcagaaatccctgtgattgaatttattgtgaatcataaacaaggactctttatgacatacaaaactttgcatatggattcatagttaaatgtttaggctgttataggtggcttatttatcaaatttagtgaccccttttagtattctctcaatcatatgtttaggggaaatataaatggaccctaaatcagtaatctcaaacatgaactaaaggagtctatatgaaaaaatgctaaaaaaaaatttggaaaaatgtagaatttttttaaaccttaaattgaatcaagtacagttacatatctaaagaaacaaacatcagacatctttcaattagccacagtgtttcagataaggccaatatttatacctttaacttaacttaaaaaattcatgtctaagagagcagtttacagttattagactggcatttactgctatataaatttcagaaatgtttataacattatcgaagtcctttgagggatcattttgatattgtcattgttacaaagttatagaaataaaggctaacacagttcacatcataatttagaagaagatgagtacaagatacgagagtatgctttcaaatattttctcacatctattctttatgcaatcaattaatgaatatttatcaaaagcttaaatgatgcataaaaaatgcagaaaaccatggtcgacacctaaataatttacaatctaattgagaaaaataagttgatttcacttatgaagcatgggtatttgacaaaagcaataagagtattggtaaatccaaaaaaatgctcataagaaatcaataaacatgtggaaaatggccttgagaaaactcttttaaagatgtttttgatttttggttcttgcttcttggtactaaatgaaaaacaaaatctgagtaaagcattatgaaaatttgaattaatatatttgaatatcatcttgattaactttaccagtgtgtttgtatagttattaattgtataacagactgaataagtagaacaaagttttttcaactaaggctatcttgtcattataatcattttatgaaatacatttatcatatatgtgtttatgtgcatttttaaagtatatcatgtaaatttaaaaaaatatttgtttctctgccctttttgagttactagttgggacagatgcttgtatcaaaaaatagattaacaagagaaaatcaaacaagtttattaaaatgtgtatatcatgcatacaagagagatgacccagataaattactatattgccagagtagatctcaaagaggtcactttgactttgggattaagtaccatcccttgctgaaacaaagaaagaagggtatgaggaaagggtaattattgggaaatagccaggaaaagtacagtgaaaaagaacaaagtctgttatgtggacttcaatcaatgccttccccactgataacacattttagagatgtagtcatccttctcttcctggagcagagagggagacacccttacaaatggatatttccttatagatgtaaacttctcttacaaaagggtaacttctactctgttttcaaagcttctcccttgtctgatgtttctcaaaatagtttgttccaaattatttatatatactaaagagacatatttggggtagcatattctggcctcctacagtcatattttggctggtgagtgataggcgtgagccctctcatttttccatttgaaaattctgccagaagtttcacagtccaggacatgagttggtggattatctcataatttgttgaagaggcatttctatggaaataaaagaaaaacaaatgttaatagttagagcaaagtaaaaaccaatttctgcatttggaggacagtcagttgaaaaaatttctagatgtgggttgggcttaaaacatcttttgcaatttaaatgtctcaatgttccagtgaactttctgaatgacctacatagctgtaaacaaaaacagaattaaactctgtaaaatatttaaagaggtttattctgagccaagtaagtgaccatggcccaaggcatagtctcaagaagttataaattggttttgtatgttttagggagacagaagacatcaatcaatatatatgaggtacacaagcgttcagtctgaaaaggtgggacaacttgaagagggggtgcttataagtcataggtggatacaaggattttctgactggcaattggttgaaagagttaagttattatctaaagacctgaaatcagtagaaaggagtgtctcagttaatataaggggttgtggagataaattgtagatgaagtctcataggtggccacctttagagataacagatggcaaatttttcctgtctgacctttaacaggtgctagactcttgctaatccattcaggataagaaaaggacttaaggcccagcaaggtggctcacgcctgtaatcccagcactctgggaggccgaggcgggtggatcatgaggtcaggagatcgagaccatcctggctaacatggtgaaacccagtctcaaaaaaaaaaaaaaaaaaaaagaaagaaagaaagaaaaataaaaggacctagaaaagggacgaggattctctacagaattttaatttccccattagaagacagaactgcaagactatttcaaaatatgtcaaagaaatatgttttggggtaaaacctcctacatgttatgtggtgctacactagagtcaggttggaatttggtatcctactgcaacaaagagtctgttttgtcagtcttaagatctctgttttaatgttaatgctggtcagttgtgcctgaacaccaaagggaggagagtacagtgaggcctgtctaaccctcacttcccatcatggcctgagctaacgtttcaggtttctttggaatccccttggttcataggggggttcattcagttagtaggaggacttagaattatatttttggtttacataacaatacattcaagtctatccacacatgagctgttgtagcgatttctctgaagtttttatcaatctcttcaccttcagcttgcagggcttcaggaaaaagacagttttgtttttagtgatttgaagtcagaagagtgagagcaaatgagaaatgctagtttggaaagtcatagtgagatattggagaaaaactggaagaattccgaatccagtttactttatggataggtaacagtagttcaaggacaatgaaaaggactagaatctaataggtatactataatttttctctctacattcacctccatttttaccaaaaataatcatagtaacattggtttctttgcaaattaaaagtagtctcactaaacttcgagtatttatataagtgagcaagagtagcaattgaacgtataggatctgttaaagtccactttgctggaacttatgagatatagcaaatacaagttttaaaccctcttaagtttagaaagccaagccaaggaattgacattggacttcatctacaatacttattgacagagcaggagcatcgccatcttggacaagcactgccattttaaagttcaccttgatcaaaaactgcccaaatccaaagggcatcagcctaatggctaaggtcagcctgaccataaacgacaaataacatctctgaccagaaacagtctaaccataagataaaccccttccccaaccagagacataccagctcccctctggccagagaaatgtcagccccaagataacctcccctccaaccggagacattccaaccccacagtaaacttctccctcacacagaaaatttctgagcctgtaataagctctctcaccctaaaaccaataaatactgtcagtttgtaagagagagtgctcatgacaaaaatcggccagaagcccctctcacgtttattctccaaaataaacatgtctttcactgttgagccatttttcatgtttctttcttctttctttaactcttacacctatagatatgggtaaattccttacctgaaagttactcaacaaatttactcaatttataaggccaggaaaactttttagccaggtgctagaccatgtttttcccccaagggtctctgttagctatataaagtcaaccttatttccttaaaactgtctgccccgtccctactgaaaatacaaaaaaaaattagtcaggcatggtggcacacgcttgtagtcccagctactctggaggctgaggcaggagaatcacttgaacccaggaggcggaggttgcagtgagctgagatcgtgccactgcactccagcctgggtgacagaagagactctgtccatctcaaaaaaaaaggaaaaataaataaataaataaaagctgtctgacaatatctgtttctatgtacattcctagtatgacattccatccaatccttggtaatgcaaccaatgttaccaattgtgtcctgttacaaagagaacagattattattgaactcatgcaaataaccatattgccatgaaaataaaagtattcactaagagtttctaaattctggatgaattgggtagtaaacaaatggtaaatgcttcaacaatcgtttttacaaatgtgtattttaccgtattgctccaagctgtagtttaaggaaaaagaaagggaaaaatgtttccttgaagccaaaaaataaaacattaagtaatcaacagtgtttgaaacaaaaaagcgacaaaaattacaatcatcctcatcagttatttcagtctcatataattaatttctgttgtgcttaatcttgggttagcaattttatgaatcctgcttttccatgagagttcaggaaattcttacctagttcaacgggatggttttaaagttatcagaaacatgtaattgttagtcttttccaagaatttccttaaagacaaagcacatttgtattatagttgctcacaaaatatttcaggaaagaatcagagaaaaatgattgtctgcagatggcaaaagattttacatggccattgttgaaggtctgatgaatgtacattataatgcaattgacactcatcagtataggaaatataggaatatggaacaaaactgatttttgtgtaaattcacattttattttatatccgtcaattccagcatcctttagtattagttctccatttatatattttcagtgctcaccctatttacttttaaaagtttctcattcctgagaagttcatcttgaatcaactcttaactgagtacattacctggccaaatcatttcttcaaaagggcacatagttctgtatttcccaagctgttctggttgagaaagttgtggttttcttgatgtaggcataatatgatactctgggatcacacattattttgtttttaatcaactttatattttataagattttcagatttgtggaaaaacttaaaatatattatggagaatttctaaatgcccctgcacacagtatcgtttatgattaacatagtatatgaatatggtgcacttgttaaaattactataaattgttggtacattagtataaagtagagtgcatacttattcagatttcagattttaacttaatgttcttgtcccagtccacgatgccttccaggataacacatagtatttattcatcttgtctgtaacggtgtcacagacattctttggttttgatgaccttaacatttgaggaatactgaccaggaattttgcttttattgttttattagaatttgttagatgtttttcttatgaatagataaacatattcttatgaaatgataaacattttctattcttatgaatagaaaaacataagatgtttttcttatgaatagattgagattatagatttttcttatgaatagattgagattataaatttcagagagcaagatcacagaggtaaattaccattttcatcccatcatctcaagcagacataccctgaacatgccccatcattgttgaggctcatgatgcatctctactgtcttatttcattgttcaaatgttctgactttggccattggttgtcctttcagatgggtcctttaacatccacctgtcaatgtgtgctttggttttgctgttgttgttactgtttttaagcacttccttacttcctggaaccacaaaatgctccaatttcatcttgcatatttcctgtcctctgaaatcagccatttctccaaggagtcattgttctttttacaggaaaatgggtataagcttcttgatcatttgctacttggtgttatttcattgtggctcactgacagagtaaagaacataaatgtatttattaccactgaactgtacactaaaagatggtaaagatgttaattacatatatacttatttatatctatctagatatattatctcaataaaaataaactctcctatatccttaaaaaaggaaatatatgtgtatatattcacatttttgcaaaaagcaacttatcaatgtttattttttttacttttaaaagtatttgtttgcttggaaatgttattttgagcctcagtgtattccttcagatgggcaagttctcctttcatttcattctgttttttattatttcatttgtgtgcttttattacattgaattaagaagtagatgagaaggtatctagaagataaagaacagcaaatgtttctctccaggcacccttggtctatgcaatcttacttatttcatgacacttcctagtccagtttcaggccagccgccctacctctcagaacatttgtcatttttctcactatcaccattgctaagctcaacagcagccaatcctgtatctgcccatatccacacactgccaatggtttcctactacactattttctcctcactaattaagaattaaatacattatttgctaggaccaatcagcaagtatatggtgttttgttttgtgtgctctaggtatgatgttagagccatgatcatgcaactgcactccagcctgtgagacagagtgagacacggtcttaagaaataaaaaggaaaaattattgtggtaacaaaaaagagcaactcctttgtaggaaatacaaacaaaagagggtatcttctttcttaggaaatacacacttaaaatttgaaagtaagctgcatatatcatgcaccaacctctctcatctcattatttctgtcattcatgtctgtttatccatccatccattcatttttatatatgcacagataaatgactaaattgagttcatcaataaaaatggcgacttctggacagaaataacaggtaatttaaaactttttctccaatggaatttacaaaaaccataagggcgtcattcttttttaaaatgtattatatccaacaataaaacaatatatttccaaaaaaaaaaaaacaaaggtgcttattaacgtgacaatgaacaatataattatagcaagtataaaacattttcctcagtaacttgagttatgttgttttctaagtaaatttgtttcatcaataacatgctactttatttctttttctatttcaatattatgttttcacaattgccattttgtttttacctcacacttgaacccttctattctaccatttattttattctaacattatatacacatgttttggcgttttttctcactatatgtataacttctctttttcctatatgaccattctgttctgttttctgttctatccatttttatgtgtgccttatgattgaggtgagggcagtagtgttcagagaatgggaaaatctgagcagaggagaccaacaaaaagcataccctctttgctagaatggcagatctttacttgccttctcatgatgtattctctaactgctttctactgctgtttgtttcaacctatgtgggggctgtatctgtcccaatgtgacaaacacctgggttttgaatgtgttttctttgcctgaagtcagtgtatgctacaagtgtgctctagtctgcagtcacttgtgccatttatgatccctgattcactcatttctccccaccagtcacttcgtttctacttctatccaaatggggaaacataatgatagtaaccacatttttctcttgatatttgtattaggaggaattccacaaattgttaccacatacctgtgtggcttcaccattgtgaaggaagaatgaagacctaagctgagccgggttgtcggcttcaacccaacattattgtcgttgttgttgtttcctcttccttaatagttttaaatgttaattgcactatgttaaaattctgttgtctgggttaaggttggggaatttgttgctgtgttttataaatttttgttaagttcataattggtgaagaaatactgcgatgcaggtttaacctgttatttcaatacagaaggcaccagaatatttttcaagccatacattgaggcttctgccccatgactcagctgaagcagctctgattgaggtcatcagtgccttcattaccagtcctgttgcttgttttagacctaattttaccatattgcactccagtacctagcatcattaatttctttttctgtctaaaaattattttttcctttcttatcaatggccttgttctctccttgccatgtgctgaccaacctgactgttactccagtcctatttgcttgtcttttttcctttgactcctaataaaatactgggttcccctagagaaccatccttatcctggctttctttctctccctgagctattacgtccatctgtatgttttcaacatctaactttttacttactgccccaaccataaatcaggttaagctctatctctcaaaatctaggcctactgaatacttactagtgaaacttaccaaaagctgtagttgtcatatttttcttccaatgttgttcttctcctagttcccttgtctttatgaataaaaacactcagatgagcagtctgaaagttaacgtcgttgccatctggcccttgattcctgagctttcatgcaaagttatgcaagtcactgactgcaaaacagcaccaggccaggggactgtctgaggctcaggtttcccaacaagcacaaaggtgccctggggtcaagcagcagaccatccccacttacaaaatgatgcccaaatcctttagcagtagcctgaattgcagttctgtggtcggttatctcctttctgcttcagtcatagtttaggagctcttcctcttatacccaacctgtcttcctgcttccacaattaccaccactggatccatcttccacattgtctgagcaatgattttaatccatactcctgagtaggctctctaccagttcacttgctccccaagaaccctcataactcatctatctcctcatggtagactctggtgacaacattccataccatgttttaaaaaaatactttatacaactttacttatgctcacggcattcccagtatttactgtgtcctttccacccctctgtgtccatccagctcatcatattgtgttttccaggctcattgcaaacgtcatctctatgaagcaattctgactttctgctattcctctgtttctcccttgctcccctccaaatatggcatttatattatagacctttggggactgtaagttatttacaaaaataccaggatgcactcacttattcatatttgtatttctagtattgagaaaaatgcctgctccatacattagtacaggggagaatggcattgattgaggaagcaattgttattagttctgaataagcacgcttaaaaaaataatttggtcttctcaaaaggattaagattgcacacatctacaactctcatattttttaaatacaaagatttccctccatatttttaattgttttacaaaaagagaaatacaactaacctactcaagtaacaaaaaaaaattaaatatttctaaatggcaggacgttgatttactggtctaattggtttatttgttctagagaatgtgtaatgtaatgtaaattatttccctgtaggtaaagacatctactatattgagaaattccacctattttatactgcctgtgagagcagaaatagcctttgcttgtcattttttaaatttactgacaaacccagcactctactcttgccgacattagatgaacaatgaattaaacagcttacttttgacaactcaactctctgaggacatgcagactcagaaacatcaaagatttcatgggatcagttttgtgtgtagagctatgaaatgtgttgattaaggtcatctggaaaaaaaaaggataggataaacagaatgatttttagttatatgattaaaggatgttgacatgtgaggctatttttgtcatttcagaggttaatgtacttaaagctttattcttactccacctaggaattgcatgttataggttgctagcattaattttcagtgtctcttctccttaaaataaacactacaattttatccttttcttggtgaaggcacagagctgtgtcctaaggttaaatgtgtttactaggaaaaatattaattccaaaaatattatttccaaatattagttccatttagttccaacatgtgaccagtttaaccaagaggaatttgattctgttgcaacatgttttacattttgctttgcaaagttcctctaagaggagcaaaatggtaatgttcaacctttagacttaagataaatagtatataataagcctgggtagaagactactatataaatatttcaatccttggttgtatgcggtatggaaaacacagtaacataaaattcactaatctgctatgtaatgtttatgtggatccagatgaagctgtgtcttcactagataatttatcaagtttactgatcttacagtatcatttactaagttatcaccgaatagaatgcacagacttaggacaaatctccagggtgcaactgcatcagtgcccatgattcttttgtagcacaatcatgcataacagcctcagaaagtggaagcgtggggtcagtgactgaagttgtacttcctcttgcttataccttagttatagtgagacagtgctgtgcaccattaaagagtttgcacacatcattgtatcactaacaccattgaagttcttgcatttttaattattcatacttaaagaaatattacagaatcctgagccgtttccacaaatgtagaagctagaatgtaaatgacactggactggaaattttgtctgttttgcgctttgctgtattcccagtgcctacaataaggactgatatcataaatgaacaaataataaatgtattattatttatgctcagcaaacagttttgaaatgaatattgaaagagaggagaagtcagatgtgtttgctggtggttacagtcaggattggtaccaggaaaaactgcagagttgcttaaggtcctccaccttcctttgggatgtctgtttttccccttttatagcaagggaatgcacggaatgtacacatagtaggctttggattccgcagaatgtcatcacagaatttgattgggcatctgttgaagaacatgaggaatgggttcctactgagtattgcaggggataggggtacaattacgttattttcaacttgaaggattcttcagttccttcagtgccagcaggattcctggatgactgctatccagttttatcttccaggaaccatagctctctatcccacacagggctggggtctctttcagaaacattccttcagcctcatgtttctcagaccctcttctgtacctaggttcctccaaatcctgcctattttaggtatctggagttaatgtaaaaaacaagccacttgatgtgcttcgtgagtcattacattatttctccctaagatactcaatacaactctataaaaaatggcttagctacaatttcagaatgccatttgcaatgcctaaaggtccttgaaagaggattctttcttctttttaatctcaagaatcgtagggtgaataatgccatttttcactgctgtgttctctacagaatgtgaggcctttgccgggaaacatcactgtttaggttcctggggtttaaggaaagtccagtctttggcaaatacctaatacttttagtttgcagtttccgaagagttttaggtttttccagttgtaatatccttgattcctaaatatagtcattagtatagcacatatattactttattgtccttatttatttacatttgcttattcctattcattcttcttgaggacaaaatctagtcagttatcatattaataataactgtactcatttaaacatttttaaattttttgggatttatttattttgttttgttttgctttttttgagacagggtctctgtttgtcccccaggctggagtgcaatggcgtgatctcagggctcactgcagccttgacttcccaggttcaagcaattctgcttcagccccccaagtagctgggactacaagtgcacactaacacacctggctaattttggtattctttataaagatgaggttttgccatgttacccaggctggtctcgatctcctgaactcaagcgatgcctatctcggcctcccaaagtgctgggactgcagacattgaccaccctatacatttatgtatttattcattcttgcatatgtggatttcattaaagtaataatcagtgagcatttgcagtgcaatcttgtcggccttgaagtttcagcagagaacaaaagacataaggtctctcctcaaacatcttgcctattcgaaagagacagacttatgtgtttatatataagagagagagacagacatatgtgtgtgtgtgtgtgtgtgtgtgtgtagaatgcaatgtcagataatgaaaaggactgtgaagaaaaacaaaacagggtagaaggaaagagtgtgaggtactatttttttaaagagtgatagggaaaacttctccaaggagggttatttgagcaaagacctgaatcaagtggggtaactattctgggaaaaactttttcaggtggaggaaaaagcttgtgcacgtgccatgtaatggaaaccttcatagtgtgtttgaaggccagtgacataataaatgagacagccaggtaagaaatgacctcaggaaagttgcagggctagatcgaggaagactttctaggatgtactagggatttggaattttattgtttgtatgatagagaatcaatgcaggctttgaaaaggagtaatatgataaaatgactgtctttaaaaaattactctggcaactgagtgaagaataggctacaagaaagaaaatgagatcgtagagaccaattggaggggtgacatagcaatctgactgttgcttgtgtcctagaccaaggtgtcatgaataaagctaagtagaaggcatagttaggatacaattttaagacagaaaagaccggacatgttgatggatctgatctatgtgagagaaagggagacatcaagatgctctccgttgttttggagtgtccaatggtagaggcatttattgaaatggagggaagttcatggtaggaagcagaatgaggaaaggtgtgtgtgtgtgtgtgtgctctaatgtttggtttgaaatgtctatgacacatacatgtataatgaagtagtcagtgggtttgaatctggaattcagggaataggttaatcctacagctgaaaatacggtatccatcagtatatagagacagcatttaaaaccatggggctggatgacatgtcagagagtcatgtggacagaagtgcagagggaggaaacaagccagatgagtaaggaagacagggtgttccaggttggtgcaacatttaactgtagttgagagcataatctacttgaatccaggacaggtcagtttgggtaagatatggaaagaatgaagggtgtaatgtggtatgagccaaaaggagaaaccaggcaatatgttagaaaatggatggtcaatgatgctgcggtcctgaggaacaactgaaggattttcaactgggaaattactgacatattcagttattttttttaaatctctctgattgaagtgtgaagactggttcagaaaggaaaagaggagaggcagatagactgttcagaatacttatagaaatacctgtgagggatgactgtgtctggcgcccagatggtcactatggaaagagacaagcaaaggcatgtgaaagacaatgagaagatgtgggttaggtttctaggttgagtgcttggaagaggtattactgtcagttgagatgaagatgaccagggcatgggagaggctccgtgagtttaatgtgctccttgtgaaaggaatgttttgatatttggcaacagaactgggatgtatattttaatatttagttatccataacctacaggtggcatttaaaactaaaataatgaatgagctctctctgtaagtttataacataagaagagggagcaaggggcacctgaggaaaagcagtatgcaacagcattgaaggagaccctagcagaggaggtggagaaggaggatccaaggacctgagggaagacacagtgggttctggccttggaagtcaactaaaaagtgagagcttcatcacaggacccctcaggagggtccagaattgtgttcatacaaagtgtttccttggaacaacctgcgtgtagcctttggaattcattatagaattgggacatccaggttgtcttgtcacgtgattgtctgctagggttatcatagccgagtactaaacactgattggtttaaacaacagaaatttgtgtccctgtgattctgaaggctagaagtccaagaccaaagtgttggcagggttggttcctcctgaggcctctctccttgcttgaagattgtcatctcctacctatgtcttcacatggttttccttctacgtgtctgtgtcctaatctcttcttatatagaaccagtcatattggattagggcccaccttagtaggcttctttttttttttttctttttttttttagactgagtcttgctctgccacccaggctggagtgcagtggcatgatctcagctcactgcaacctctgcctcctgggttcaagagattctcatgcctcagcctcccgagtggctgggattacaggcatgcaccaaaacgcccagctaatttttgtaattttagtagagatggggtttcaccattttggtcagtttggtcttgaactcctgacctgaagcgatccacctgcctcggcctcccaaagtgctgggattacaggcgtgagccactgtgccctgcagtaagctccttttaacttaattacctctttaaagaccttatctccaaacacagtcatatctgtagtacaggggttaagatttcagtatataaaactgtgtagtatacaattcagcccatagcacttagaccacacaaatcctacatttatgggagctgtgacttgaaaaaaaataaaaatatcttcagaaataattcaatatttgacatcatataacttttgctatctctagagaaaaacaatttatgctgtgacattactggaaagaacgtcttatcaagaaaaaattatgacctaaacaatgatgataaattaatttacgatctgttattaggaaatgtggaagattgaatcaagttgtgcaaataggtacacatgtctactttctcttctatcaaaactgtagaaaataataaaataaaaataatcaaataaatacacagaataaaaaagttaagataacctaatattattacacttaagattaagtaattcctaaaactgcgacaagtaaaaatgtcaaatagaccagtaagaacctctatatcaatttaattctgaatgtgtagttctaatccacattaaatagctacaagaagcaaaaaaggctcaggagtcatccaacagcttcaaagtattcttaagctttctatgccttttaaagagaaacagaactataggacatgtgtatatattaagagagatctattttaaggaattggttcatataattatggatactggcaagccccaaaatttgcagttgaagttcaaagaccatcaggctagagacctgggaaacagctgatgttgcacttcaagttcaaaggttgcatgctggcagaattcctatttatgaggcaggaggaaaagaaggagtcagtctttagttctttagttctagtgaggccttcaacagattgagtgaggcccacccatgttatggcaaatctgctttccccagagtccacagatttaaaagttagtctcatcaaaaacacttgcataaaaatattcaaaattacattccaccaagtatctgagagccatggctcagccaaattgacaataaaattaagcatcataatactctacttctcctctacattttcttatcagtgccagcaggaaaaattagtaaggaggtcagtggagcagatgtgcaggtgagtggttcagatggccactgtcctgccaatggctcaccagagccggacaacgagcactaaaaaaactccatccaacaccacatcacatctctctctcagtcaacagatacaggctgaagtcaccagatcagttaggtaagtagaatattcaacagacaaaccactttgtacatagtatatacctatggaggtactgtagtctgagaaggaaacaatttaagacaatacctacctccaagacattttgcaaatttagggaagaaacaaagaaattaaaatcaaacctaaggacaaagtacattcttaaggatacgttttaaacaagaaataataatcatgttttctaataatgataatccaggtcactgtaaacagatagaactacaaataatggcaacgttgataggaggttgaacatagaaaatgcttttggttgccaaactccatcatctcaaacattcataatacttctatatctctacttattccagaaaaatccatatatgtctttaatcattttgaagtttaccttaaaggatatttttctcctttaaaaagataggtaaattatttctttgaaatacgattttttatccaaacagagcagtgtttcattgaacatattgcagctgctttgatttagtagtgagtttccagttgccatcacagatatgttgactggagtcacctgcattgtcaagtcatagtttcttctttgtgccataagttaaaaagagatagacatgactgccaaaggttgtttgcatgtaaacaaacaaccttccagaaatttaactattctcattgttttagttgttctttaactgccagagtcagcatttgcttggctattcaaatgacaatttaaggacaatttggaatctgccaagagtttgccaagatacatatgatgtgtactgaacatatcatgcatagaaaataaagtgctaaagacaaggatatctttggacaaaatgttcctcatttgagcctaatttcattctagaggcttcaacacctaatgattgataacaaaactcttaatgtaaaaaagtgcacctaaagcatttaaatcctatgatggcatttgagtgtgtgcatagctcattaatgtgatgctaggctgggactctatgttaaagtgtttaggaagatttttagattttaaaatatttaatattcaatttgtctttcagtagaccactcacagctccccaggagagatggagaacaccatgttctgcattttaatgagaaacactaggtaatggaaagactgtgttgcaggctacaattgaaaaaacaaaacagtgaaagacagtgtggtgattcctcaaggatatagaaccagaaatactatttgacccagcaatcccattactgggaatatacccaaaggaatataaattattctactataaagacacatgcacatatacttttattgcagcacaatttacaattgcaaagacttggaaccaacccaaatgcccattaatgatagactgtataaagaaaatgtggcacatatacaccatggaatactatgcagccataagaaagaatgagttcatgtcctttgcaatgacatggatgaagctggagaccatcattctcagcaagctaacacagaaactgaaaactaaacacctcatgttctcacccataagtgggagttgaaaatgaaaacacagggacacagggagggaacaacacacactggggcctgtcaggaggatggagggcaaggggagggaaagcattaggacaaatacctaatgtatgcagggcttaaaacctagatgacaagttgataagtgcagcgaaccaccatggcacatgtaaacctatgtaacaaacctgaatgttctgcacatgtatcccagaatttaagtaaaataaaaaataaaaagacagagaaagagaaagaaaaagcaaaacgaaaacaaaaaacagtttattccatgggcattacatcacatttgaggaaattagttatcctgcttattaagtagtaagcgcaagaagtactccctaaatatttgtcccacatagctcataaatccatctggagatttgttgttcatcagttcaactctagatttcttaaaaatggggtccaccttatccatccctaaatttgtagtttttggcacagattagaatacatggcagtgcccggtatattttcatggtctttaatttcatggacgtaaatattttgtggaattaattatttttcgaatgggaaacatttgaccaatgagtcatgattgcacatgacagtatggttgtcctccttatctgcagaagatacgttttacaaaccctagtggatgccagaaagcatagatagtatcaaatcccaaatatgttatgatttttcttatacatgcatgcctgtgatacaagttaaattaggcagaataagagattaccaacaatcataataaagtaggacaattataacaacatactatttacaatttcacagatagatggctcattcctaccatagatcttagcaaccccagcacacaattttttttcttttccttattgagtcaagaagtcacaacttttcacttggaagcactttatgggttgtctttggcatatctggcctctctacttttgcactttggggcattacacagtaaaataagggtgacttggacacaagcaatgtgatacttcaacagtccagatggcccctaagtgcctcagaggtggggaggctacacagtgtggagacgctggagaaaaggagtgttcacatcctgggcagaacagttggagattttgttatgctactcagaatggcatgcaacctaaaacctattcactgttatttctggagttttccattgaatattttcagattgtagttactgcaggtatctgaaaccaggaaaagcaaaaccagagagaagaggggattattgtggtgtggtagcaagagaactgagttgcaggaggaagatttggttgaaatatgtggcttttttttttttttacaacaatttggttcgtttatgaggacactattacatagagaaaaatagaagtaaaatattgtttttgttgtcaaaaacagggtaatgggggaaggaagaagacagaaacacattatgtcacaatcctgttgaaaagctaaaaaaaaaaatccatattaagggccgaatcatcttgtcactggccagctttacacctgctcatccctctccgcaagataaaggcctgatccaacggcaatgaaacttttcttatctcccagagatggacaaatgatcacatctcagattagatcctaggttttgtctccaaatatcaggaagagtagagtagttatctgcctaagtatttatatttcaagaagtaataatacctggaaatttggaaacatctctaggttggaaagattcagatacatgagactatttggcttctggagagtatatttatattccaatggggtggagttagggctcagattcatgatgtttccaaagatgcactctcaagaagagtgagggaagctgccttattccctttgtaagcagagaaaactcattttcttcaccccctgcccatgcaatgtacagctagttatgttggaaaaatttccctcagctctcatggcataagataaggatgaaggcaaggggctgatgcacttattatttactttgaagtaataagtggtctgtctctgatccagaacacttcatgtgtgcaatcaagatacatttaataaagatgaatattaaaaacctaacaagcttcaattcaattttattaccctttggatcagagaaacagaacaaatggccatagatctactccttattgtatgtgaagagtgaaatgtttctagaggaagtgacggcaaacatttcctatttttgtgctgtatacacttctgtgtttcaggctagggtttctagcatgagctctgagaaatacaagcaagtttacttcatggacactttattctttggttggtatttcatattccttcaaaattgatcttgtagcaacaaaatcaaccataagaaataataggaaggtttaattttttataaagtattgaagttcacgttgtttttaaatgcctttgtttgaaagtgaaatacatatattgaacttgaacactcaaaattcccatggaaacaaatcaaataaagtaattacaaagtaattgctaatgttaagtatgatcaaatttaagttgtctcttctaggaccagtttacaccttgatagttttagcatggcaggtgtagatttaagggtaccatgagaaagagaaataccaaaagttttccgaagagacagggttttgttggtcaaccaggctggaatgcagtgatgtgatcatagctcactgcagccttgaactcttggactcaaaataccctcctgtctcctctttctccttcttcaacttcaccttctcttcctcctcattattgttattgttgccattgttttagtgaaaaagaaagaagggggaaaaagacatcatatattgaacatgtatcataagaggggcattcaagtaaactctttggaatcttacaaagttttcaaatagtcttttggggaacaaagagacatcatagggtaatggaatcctaagttagtgccaaattgaaatatttgagtcacatgtgcaactttaagttttctaggaatcacattaaaaaagtaaaagaaattgatcaaattaattataatagtgttttaatttaactaaattgatccaaaatattgaaatttcagcttataatcaatatgaacattattagagagggattttacatttttgtactaaaccttgtctgtaccatatttatttttattgggatctccgttagaactagccctatttcaagggctcagtagatacgtgtcactaggagttgccatataggacagaataggcctatggagtaagatcttacgtctacaaccaacttgcctgttctttaacccatttactaaactttggtgatattacctaaatgctttcaactttatctttcatagcagtatctgatatagggtagttgtaaagactaaattaattcatatagaacagttagaccaaagcctgtcacatattttcaattattatagcacttataattgctgaataaatttatttttaaaacactttttttgagattagttttagtatctcattcacaaaagaggaactaaatgcagagaagtccaataatctgcccaagtttgctcagttagtagctaacttttgtcaaatttattgtaattttccctaatgcacttatcttttcgaccaaaagagtattacgaaacagttgtagtatgcaagcaccagtttgtatacttatttgtttgcatccttcatgaagacttttgttagttgttaattaaacacatgcacatacatatctacatagtatacatttttgtgtgtgtgaatacacaaattcgtttgattcatgttggactgtcccagagtcctggaagagggtttcctgaaaaacatatcttaaatctgtgcccagccaataagttttcaagattattcttggtttttctttgcagcatcaaaatataagaatgggaaaaaaagtatttcaaagtacttaagttaaaattggtattcttctaataaatttcaatagtttgaaatttcttcttttagtgatagattaagtaaagcaaataaatttttcccatggaagaaaaaattaaaaaacaggagactgattaaaaaaattctgatataatttttatcagtattcattgtttctctgtgtggattcaagttaccatctggtaccatttccttttagcctgaagtaattattttagcattggttgtaaagcaggtgctagcaacaaattttatctttctttatcttggaatgtatttaatttgcctgtattctgaaagatagttttgttagatatagacttttcagttgacgtttttattttcttttaacactttaaaaacatccttctgctgccttctgacttcattttagtaatgagtagtaagagagctatattgtggtccccttgactagaaggagtaatttttgccttgctgcttataggatgtttcctttgtctttttcaatagtttgaaaagcctgtgtagaattatctaggtgtgtgtttttgtatgtgcttatcctatttggagtttatggagctacctagatgtacaggataatatttttcatcaactgtggaaagtttttattcattatttttccattttcttccttcatcactctctcctgcctctgcatctcagactcacattacactcatgtcattatgcttgatggtgttctaatggactatggggcgctttatttttctttttacattgtgtgctttcaactgagtgatctttactgatttaactttaggttcactgattctctattctagcagctcatatatactataaccctatagcaaaaaatgttatttcaatatcatatttttgaattccagaatttcaacttcttttttatatgatgtctatctctttattgacattctatatttcataatttatcatcatcatactgtcatttaattctttaaaaatggtttattttagttcttcaaatatacttacaataattgatttggagtctttgtctagtaagttcaacagctgtaaattctcaggaacattgattactgacacctttctatttttaagcttatcttatttttttctggaaactggatattttatatactgttttatataatatattgttgcaattttagattctcacatcccctgggattgccatttttgttgtttttctgttcatttattttggtcattcatttttacataatttgtctatactagttctctagagctggtctgccctgaaacatgtatttattgaagtttctgctctgttttgtttttgtttttgttttctgtttttgttttttgttttttttttttgagacagagtctcgctctgttgcccaggctggagtgcagtggctcaatctcagttcactgcaacctccgcctcctggcttcaagccattctcctgcctcagcctcctaaatagctgggattacaaatgcctgccaccacgcccagctactttttgtacttttggtagagacagagtttcaccatgttggtcaggctggtctgctttttttattattcttattttttaagcatgctttccagggattacctgcttaaacatatattgagtgacactttgctgacagaccggtgtgtggattggggaacacatttaatgtggaagcagtttataggtctatccagcttttaatttctgcatgtgtaaggcatcctgccccactaagggttcagttagctgggccctttcctgttgcctattaggtgtgcagacttccagacaaccaacagcgttgtttcatcaatgttgtgacatcagctgtgatgtgtttccccgattatttgccactgggatcactataattttgacaatgctctggttaaaggtttttttttcatacttcactcagaatcaagactgccaccttctgtagtgagtctgccagtatccatgatcatccctccctggttaaactaccaagcaaaacaccataaactccaaatgttcttactgagatttagtgaattttcttgaataaatgacttttagtttattaatggatttaatttaaaaaggaatgaattactgtcattttaatgggagtatgttacatatcttgggtgtgaactcctgagaagcgattaagttttgcctccattttctctctgtctttcatactctcataaatgatgcctttcagcatgttataacataacacgggggccctcaccaaatgctgagcagatacaagcactctgcccttggatttccagtctccacagctgtgagccaaagaaacttcttttctttataaatcaccctatatgcttttggtcaatttctagtgttctgaaataattgcttttgacgattgtgtccagttttatcattgctgctgtagaaaagctttgctgagatgcttacttagcatttccagaataatgaatacaagtttgatggataaaataactaatgaatgtattcatatcaaaccatatgccaaaatgtcttaaaatttctcattttaaaaaacatttaaattaattatatagtaagcacataaacacatatttatgttactactttgaaaatctgtaaatacgttagtagcatttctatggtctctaagacgaggacttttttcacaatggactccctgattatttattaagttagttaattagatattaacctccttgattcaaatagttcttgtttataaaagtgactgacttttaatcacaacattaaattagtttctgagagtaagggtgtttttaaattatgattttagaatgtcctcagtacatatagcaaaattaatatgctaaaatttctcaatttattatttgaatgttagatagtaaataaaggtaataaatatattttatgacatattcatagatacttaatatacaatggaatatgcttaaaaataatataaaacttatgattaggcctcaaattattttgcattggaatacataaaaataaaactacctaacctatataatatgtataatttcatagaacatattacatcttctagaaataagaaatatgtatttgtagcattttcaaatagtaggtgaatttacaatgcatatgctttggtcttctgcaaaagtctttttggtcttttgtttttattattaaatatataatttttaaaaaacgatttgtatgtcttaatgttttagcttgtgagattcattttatgcctgattgtagaccctagaacatcctcttctgtgagctggacatggcaaatgtagtcatttcagagtcaagaattacaatttcaatattaacaactccatttgatgtttttattttattttttaactttaaaaaagaatcatattgaattgccaagctgctttcttctatttctgctacgtacagtagaatgctgcaaatcacacaatagttatgccaaaacagatatgtttgcactttgctttaaaatcccacactggctctgtgctattgtttcaatgtccactccaaaactcatgttgaaatttaattaccatatgatggaattaagaggtggggcctttaagaggcgattagaccctgagggttgtgccctcatgaatggattgatgtcattatcatgggagtgtgttgcatatcttgggtgtgagttccggagaagagaataggttttgcctctattttctgtctgtctctcccactttcatcatgtgatgccttggccctcaccaaatgctgagcatatgacagcactctgaccttggacttcccagcctccagagctgtgagccaaacaaacttcttttctttataaatcaccctgtttgtagcattctgttatagaagtagaaaatggacaaagacatctaatctccaccatgacattacagcttcttttgaattaataattttttggattaactataatactgcacattgtatcaactgatttttttctgtagttaaatagactgacacattaaaacaaagatagaaaagttaaaactaaagtggaggcaaagatatgacaggcaataccaaatagaaagaaagcaggggtcacaaacatgatatttgacaaaatacattacagaacaaaaaaaagtatttaaaaaaaactaaaaagtttattttatcctgctcccacccacttctagttcttgacttatatctttattgtctgagcagatagctttttcatactatactctgtctaatatagccatcatttcatgatgatccaccatcggatagaatttgtgtgaccactatttcttatgtcgcaatctctcttgtcattttggttatttgaaccttattctctgttagattcctcgagttgctcacaggaacttttatttttattttttatttcttttgtttttgagatggagactcactctctttttgcccatgctggagtgcaatggcatgatctcggctcactgcaacctccacctcccaggttcaagcgattctcctacctcagcctcccaggtagctgggattacaggtgcggaccactacagctggctaatttttgtattttttggagatggggtttcaccatgttggccaggctggtctcaaactcctgacctcaggtgctcacaggaacattttattgagctcttgtatgttgaaaggagttggtcatagtctttatatttctcacattgtctttttattagtatcttaagtatattactgcattttctcttggcataaactatagcaatgaaaaaaatctaaggacagtctaattttctttctcttatggtgtacctgctcaatttttgctcgggtgataaaacagtttttttaatgtttgtttttaaagtctggtattttttactagaatgtgtcttcttggtgttggtcatttggatttggtttttccaggtttgatgtattattcaaatacaaattttaagttttgtttacattttaatttgtggaaagttctgtggatgtttggtttgtttgtgcttatgtgtgtgtgtgtgtgtgtgtgtgtgtgtgtctgtatgtcttccattccattattttcccattattttggtttttactttgtttttgtattttttccaatgtggaatttcactatatatgtgttagatcactttgtctgttactttttttaataatacctttttatttagtttatctaaaaaattgatgtaagtaaaacatataaaccaaaaattactcataataaagtttaaggttcaatgaattggatgttgaataagtaatatctggattaagaaatctaaatttcagagtctcagtaacccagtagctccaatttacatttatccaatcaccaacattgccaaaagttatacagcatcctgtgttatatttatttaaaaaaaaaaaaactgtttcaatagctttgggggtacaaagggttttcggttacatggataaattttgtaatgaattctgtgattttagtgtacccatagtatacattttatccaatatataattttttatccctacccccctcccaccctcccccttctgagtctctaaagtccattgtatcactttgtatgcctttgtgtacccataggttagctctcacttataagtaagaatatacagtatttgattttccatttttgaatactttccttagaataatggcctccagcttcatccaagttgctgcaaaggacgttatttcattccattttattactgagtagtattctgtggtatatatataccacattttctttattcattcattgattgatggacactggggttggttctatatctttgaaattgtaaactgggctgcaataaacatatgtgtgcatgtgtctttttcatataataactcctttttctttgggtagatagccaagtagcaagattactggattaaatggtagatctacttttagttatttaaataatttccatactattttccatagaggttgtactaatttacactctcaaaagcagtgtataagtgttccttttttaccacatccacaccaacatctattgctttttgactttttcatattagccattctggtacgagtaaggtggtatctcattgtggttttaatttgcatttccctgatgattagtgatgttggccattttttcttgtttgttagccatttttatatcttttttgagaaatgtctatttatgtcatttgcctactttttgatggatttttttttctgatttctttgagttccatgtagatttcagatactagtcctttgttggatgcatagtttgcaaatattatctcccattctgtgggttatctctttattcttatgattatttcttttgccatgcggaagctttctaatgtaatgaaatcacatttactttttttttgtatttacttttgaggttttaaaattatatctgtttttaaattttacataagggatatttacagtatgtgctcttttgtgtctggtctcattctctcaacatcatgtatatgagctcatcaatattcctgtatatagttattcattacttttcatttatatatggtgtttctttgactgaatataccatgatttaattctttgttgttccgctaattaaaatttgaactttttaaagctcttggctattatgaatagttctgacgaccaaggtgtcaatctcttgattaacctatatatgcattctcttgtacataaatgtatgcaggagactaatgggtcttaggatatgaatatgtccaattttagctactgccatttttccaaagtgattgtacctagggttatatgagatatttaagcactgttcaacacaattagaattgtatatatttcattattattattatttagctgattggactatatgtagtggtattgcattataattttaattcatattttctccatttattttttatttcaaaaaaatttcctctcttccatctttctgtttcaaggaattttctatttttttattttcctcttagcctttatgtctgaaaaaagtattttatttatgaaataaaaaatattcctgtgttttattacttgatttttgtttttaatcctaatttatatcttcattttacttttcatcatcttcttagctcattttgaaacattaggtcataattttcatcaatttatgggcatgtcctatgctaatgttgcctctaagtacattattctgtcttcgatgtttttcttgtatcagctttatatgtaattcaattataacttctttctgttcttcatttttgtagacatcatttatttatagctgaacttttaggaaagaggttacaaaaggcttgtttttctagcttcatggcattagagatctttctgttgccctgtgaattgttttaaaaggcactgtcccacattctgagatgtcctggatctgttctaacatttcagctttccctttgcccatatttttcttactccttcaatgaaaatatatgttgctagaggtttctctcagctcagggctttgttctgaagaaagctttgactggacagtaagttcactcactccagtgatgctgcaattgcttccattgtctgttttgttttatcgttgtcctgcaaggaatctttggaagcgctcacaggactcagatggtcccagcaccttcagactttatcagagacccctttcactctggtattaatttgaaacaaaaacacttcaagtttcatcttttgttctcaaatcagtccattgtacactccagagagttcctattagtgggattagtttttctttatttagttcttccatagtcgtgagaggcttctctgcttctctctgcttcctccactcagacgctaatgccatgcaaggcctatagagttcacttgtattttcttcttgaccaagcaagcacattggggtgtgtatagctatcttacctccttttgtgtggtcattgttgtagatgttgcccatattttaatattttatgtataaaccactcttctcattttcagagggatttaagaatgttaaaaaatctacattgtcaccacctccatcttccttctgttttcttttaagatttgtaatattccaagttatattaaatatatagtcagctgggtagagcacactaccattaatttaatgtcattgtttctaatggattatatgtcatacctactcatttatgtgttattaaatgcttaataaaataaaagttgctatcatttcccaattgtccatagatattggtgtcttctaacaactggctcttaaagtcagaaacgctatttagacatttttgttcttgctaactttctgccctcgttttcctggcaaatgatttccagagctagatagttatacaaatgatgttttgtttttttttaaatgtttctattcataaactagatttttgtgtgttataactaggaagcaatagttttgatctacacatcaaagatgactttgaaaggctttcctgatagaacacaaatgtgtcttcccaaattctaggcatttatagtcatctggaaagagctaatacttagaagaaataaaaaaaaaattttctaaagctattttacaacattcatagccctttactgaatttaatcaagcttaaagttcagaagatgaagaaagccacaagcttttggttattgttatatatttgaaagggcacctaggtttaagtttctttcgaaatctgtgtatcattttctaaagcaaaaatgacaggatttcatgataagagggaagccgcgtatttactcttttctctcaggtttttgagttcctaaatattaaatagactttgcctctttcttttttaagacaaaaaaaaaaaaatcactgttctgtaaaaatgtactgattatttcaagaagagaaagtcagatggttttgattccttcggcccacatagttaaatgcaaagctaatgctgggaaaacaaatgaatttcgtatcagatgttattttactgtgctcatacttcaacgagatgagtgggggattttgacatgcaagctgcattcattaatttagggcaaattgattgtatctttcttggtaataaaacttcaaaaagctacagaagaggcaggtaacattgagggctggaacaaatataccatatcttagtagcggtttaggtatgcagctattttaaagaagagtgacattggcttctgagagacgaagtggagattaaaggaaaatgtgtatctaatttagctttaaccagttatcttccaaaagtttttaagaccttagaagctaagaattttaatacttagtatcaaaaaaaacctttttattgcaacaacaaattaattcgctgtccgcaaactccattggtcagtgtccaaaaaatattggactgagacaattaactggaaaacattgtgttttaacttctgtggtattaatatcaaaagtaaaaaaattcagtgtctatgtgcgtaaaaatagtcaaacagcccattttatttaatcaatattaattgaaactcaatctgtgtttgagcacatccacttgcatatgcatctatctagaagatcctcgtacatctaagcttacagtttaaaatgaccattgtccttcaagttggtcgcctggggaaggagtttacctactcgaaccatgtggcattgtttgaaatatctgctttgttttatctcaaacttgttacctggattattctctagttttattaaataaaataattattgattccttggagtgttataaaatttcaatttcaaagaataaagattttaattgctaacaaaaattgcagaaatgcatcctgaatgcagttctaagagtagaatttcaagaagcttaaacagtcgcaattttatttaatataagtatcctggctgggcttggtggctcacgcatgtaatcccagcactttgggaggtcaaggtggatgggtcacctgaggtcagaagttcaagaccagtctgaccaacatggagaaaccctgtctctactaaaaatacaaaattagccaggtgtggtggcgcatgcctgtaatcccagccactcgggaggctgaggcaggagaatcgcttgaacctgggaggcagaggttgcaatgagccgagaccatgccattgcactccaacctggacaacaagagtgaaactccatcccaaaatgagtaagtaaacaaataaataaataaataaatgtaagtatcctttgaaagtgagtctgtgaagctattaaagtgtttttacataagatttgatatattggttaaacaattagtattgtgagataagatatacataccagtataaaatacacatttcccatatataaagaatgtatgtgtataattgaatcatgaaatgtcatagctaaatggggtcttacagttaatctatttcagcgttcaattgccacctcctgcctttagacaaatgaggacaaaagtccagaaaattttatttcaagatcacacagctacttaaggcctgagccaaaattaggtcctgacttctgattcattgcttatttcactgaggcatgattctttctaaaaatattatgagccttcctatcaacttaaaattactgtttttaagttctgtttttgaaaatgtatttctttcattttatacttggctatctaaggtttgtgttccctctgtgtgttctccatcatcccattcatctcacatagttaagggactgtggctgcagccaagcctgaataattggatacctctgtcagcattcattatcagggcctgcagaacccacacagtgtgccactttaggaaaggttatgttccgttgtagacagcaatatgtgtgctgatcaaccaccaacttcacattttaaatgcagagcctaagtgcttttataatcatgttttgatgaggtgtgtgtttatgtatggcttttgacagaaagccttttcttaacaggatcccttgagtggatacattgagtaggttgtgtgcctagggttacgaatcatcttttacatacaaacgtcttattcttaaaatatgtatttttgatatgcataatgtgactgaaaatataaatgctttgggcctatgtaccttgaaattctgaaaatatatttcaaaatcttaaattgttatccactacaacttgttcaattctctttatatgtatatttcttatgaactcaacaaagaaaacacttaagaatgtaggtaagcgttggaaaactctatatcttgagattattctcaaaaatattctgtagaaaatacatggaaatacactttgtatagtttttgactgacccaagagtaatgtgaaatattcaattaagttgccagggtaaccaagtactagtctttgcatttaatttctctagttcagttatttgatatttgtgcattgtctgttctcctgggatcactgcagactcttaattatccccattaatggagaggactggaagaatagattctccttaataacagtaaagaaaggtagtatgcatatgattttggaatgtattttgtgaagaatatgtttttgtatgtttttaaaatagaaaaaaatccagctgtatgacaatggacaagttacatagtctgctctgggtttcactgtgggttcagtgttcctattttgaaaatataaaaatttaatagtaaatccaaagctattagagtgaatattatctgggatttcagtgatattgtaaaatattaaaccaacaaatgcttttagttccccccatctatcttttctggtcaattccccgctagtcttatttccaaggagagggatgcttagtgattgtctcaaaataacacagatagatggccccaacgaaagatagcttatttctccaataatcttgatatgaaattttggtataattttttaaaattctagataaaacataatatttttatgcataatgaattcagaaatatgtaaggtgagtaacagagtaaaattgaaaatccaagcagtagctgtaagctggcacttcagctgcctcaaggaggaaagagattgtggaaaaagtcagtctttcactcagtagccaagggtttgggttaaaaagttctacgattatgaaaaatttcaagcctatacaaaaacaatgaaaatagcataataggccacctcatacccattactaaacttccacatggcaaaatatgttcatctctacgttttctcaattcctaacatgccttccaggattattgtgaaacaaaaaccagggaacaatacaatttcaactataaggttcttcactgggcgtatgttaactatgagggctttaaaacataaatataataaaatataactatcttacccaaaattactaacatccagttaggtttcagatttgaggaatttaaagtttaacaatcatgtgcagtcagatgccctatgtttgtggattgggagaattaatattgttaaaatgtccatactacccaaagcaatctacagattcaatacaatccccatcaaaattccatggtaatctttcacaaaaatagagcacacatggggaaaggacagtctctgcaatagatgctgttaggaaaaccagctattcactgcaaaagaatggcactggacccttatctcaccccatatacaagaatcgactaaaaatggagtatagtctgaaatgtaagatctgaaactataaaataattcaaagaaaaacttagaggaaaagctgcatgatattggctgaacaatgatttttttgaatatgacaccaaaaagcacaggaaaccaaagcaaaaatacacaaatggggtttcatcaaactagaaagcttccgcactgcaaaggaaacaatttaacagggcagaaagacaaccatagatagagaaaaatatttgcaaattgtatgctgataaggggttaatattcaaaatatggcaggaattcaactccatagcaggaaaacaatcctgtgaaaaaatgggcaaatgatctgagtagacatatctaaaaagaagacatacaaatggccaaaaataaaagaaaaaatgtgcaacatcgttaatcatcagagaaatgcaaatagaaaccaaaatgagctatacctcacacaagttaaaatggctattatattttcagtttattttataatgccaaaattatattaaacgtatttttaaaaactggtttttgaaatatttatcttttatatacttgcagctactgtaaattattttattctggagaacctaaacagacataaaaaacaatgtaaagaattgacagtgatcaatatcttcttttacctccctttatcataatttgttttccagaaatatttaaaagtaagttttgacatcctcttacttctgcctcaaatacttcagtgtgcatatctgaaatacaaggattgtttttctacataactagcttggcattatcatgctttaaaaaattattgataaaagatttatcagtatttaatacccaatcttatatatatcttttaattttccccatgctatcttttcaatcttagtttctccatttaaaacacaaacaagcccttacattgttaggtacacccacagccatgagctcatccagtcatcccctctaggccccttcagtggacagttacttattaaaactgaggtgagcattctgattcgaatctggtttcagtgtttttatttaattttcttgagttgattctttcatctttactccctcatactatatgtcttgtttttttttaattccctggctcatttaaagttttcctttttatctcttgttttgatcaacttgattgggacatgcttcagtgtagctattttcatttttcttgtgcttaagctttattgagattcttggatctatgaatttaaaggtttcaccaaatcaaacatttcttagcctttaaaaaaagtccctgttccctcttttactctaggcattccaattaagtgcatagtgactggagtgcctgacggagatgattttcagtgaaagactttgagagccttattaggcacaccaaccagtcatccatttgaataaagtatattgggaggtatagatggagatctgaatctcatgaaagagtttcacactttttgctatttcctgaaagtgtcttatcatttctaaaatcatgctcttctttatgttatttcatgaatctgaaatgatctatatcaccccttcctttaccccatgtcgaaatgtaaatgataattataggacaatttcaaattttatttcttttaaaagatttgtgtaatctccccagttaaatgtgacctcttccaactctgcatttggcttatgcctcttttgagcacttttactttacctagtgttgtaagcactggtgaacttttctgtctactaggtgatcattaccttgagagcaagacaatgtgttacagtttttacgccccttatggtactggttctaactatagtgttttgatagattgacagcattaaactcattgattataatttatttattaaataattcatcaaaaaattaattactaaatattgcgaatggattgccttattttaaaaaatgaatttaaaaagtcatttaactctgttataatattcttgtatatatattatttataatttctgaaatgcaagataagggatagagctgcagtggtcactgaggaatgttaatttatcttcagtttgttatgtctatggtgcagcgttcaatgcaattcaattttatttcccatatgttggctacggaaaaggaacaatatcattgctttactggagctaatgggagataatttatatgttgatatgagtaactacttttaaatttacttcataaataccttagtagcattcaaattttgtatgaactttattggcattccccacaaattatatagtgtatagtaaaagaaataaaaaataactgtattgatcatattatgcaacattgttgagaactatttaagagtagataaaaaataaaatgttagatataatgaactaatactataggtagtgaaaatgatagtggagaatcatattgaaatgttgagtggaatgacaaaatgcagattgcttcaataaagcagaaaacctgcagtgtagaactaaaatgaagcatacttcaagtatgtagtgattctaagaatgttttctttctcttggacacttatagtgaatatgccttcctaacaatctttcattcaaaaccattgaaaagaaaaacatactaatactaaggatgcaaaccatcaaagctctgctattgttattcccaccatgaacacctgcactgcaatcaagcacaattcacagatgtgagctgaaagtgtgctgataagcacatgtctacctttcagattttcattgaataaatactacctggaagttcagaaaagtggaaattgaatgtgagaagacttcactcaaaaaagaaaaatctctcaaatgtttttccccattttttgattcatatcacatttcagttgcttttcaagaaaccaacttttaaaattctacttttttctacagacatcatgtgacatggtaatttaattaacatcattattctttcatttatatttaatcttatctctcagtcttgtcactgcaagtgatcaattcaaaacatttaaaaacaatgaggtaaaatacaataaacttgtacagattttcctagcttacagaatttggtaaacacggtagaatccatgatgatgccagagcacatttgttagaaaaaaaagtttcagtttgatcatgaaagttgggtgcatattctccatctcctatgatgtcataccgtgtgaccacaatcatgtctacttaattcattttggatgttttgatgtacttgaatttagaacacgtctgtcggaaagaggaattagtgcctttactaatgttaccattttaaaatatgacaaaacctaattaagagtactgcaagttattgaaacattctttatgtggctttttgtttggtcactctattatatagcaaatctgtccaaagaatggaacttataaagaaattttaaaataatttcattttctgctgatggcaacctttttatgacctaggccatatgacaaagaatacacttaataattcagcaaatgatgagaaactaatatgttccaagcagtccagttagtactaaggatgtaattctaatctagataagtatacagttgattgcagagagatatgtacatagataatacaatgagaacttgtaaacacaataagagtatgcaatcaacaaatacatattgaacaaccactatgtcccaagcactgtgctgaaatttacatacgccaaaattccagtaatagtggaacaatatttctactggaaaatgtttaaaaaaatttatagagatagtacttaatctgcattttgaagataaatatgtttttaaatgaagatgagttcaagatttcactgctaaagaagcaatgattataaaggtctaagctgaatctagatttaaaaagtagtgagtgattgtcactgaagcccaagataaatggggaggagaaggaaaagctattggaggtgcttttgataaatatctggtagattccttagggggattatttcctttaagagaaatttggtaatctcattagccttttctgttctgggagggtaagcttcaacccagcccatagaggtctctactagtattagcaaaaacttgtatcctttgcaagctggcatgtaggtgaagtctaattgccaggtgacatagtttgtccagaacaatactgattatatgactatttctgaaatcatgattaacagtgtcccttttcactcccaaaagtttctttggtctgaagataaagtgcaaggttattttctatagaaaagttaacttacagagttctacacatcagccctttagcaacagtaaacagcagaagactctaagtggaaaagtaatgcacatgcctatccttaaagataatcctggcagcaatgtgaagaatagtcaggaatgagactgaaacaggatgatggtgtatgaaacgtgttagcacaaacagaaacaaaggagtttgaattagagcaatgcaagtgggaaggagaggaatcctaccataggaagaatttggtctttttcatgtcttctctggaaaagagctagaacacattcttactttccttttcttctctgtgtccttatgacatcgtttgcctattcatgacatcttgaactcatcttcatttaacaacatatttacctttcaaaatgcagattaagtactatctctatgacatcacttattgtctgagttgtttttttgtttgtttgttttgagacagagtctcgctctgtcgcccaggcttgagtgcagtggcgcaatctctgctcactgcaagctccgcctcccgggttcacgccattctcctgcctcagcatccccagtagctgggactacaggcgctcgccaccacgcccggctaattttttgtatttttagtagacacggggtttcaccatgttagccaggaaggtctcgatctcctgacctcgtgatccgcccgccttgacctcccaaagtgctgggattacaggcgtgagccaccgagcccagccacttattgtctgagttgtaattactacaggcttgtcttgctccctggacttgagagtaggaactgtctcatgtcacttttgctagtctgttcttgcagctgttctcaacatgtgcacggcaatctacaagtatgtgtaaaagaatgtttgaaggtaattatacaattgtgccattgtggaaagcattggatacaatgcctaactgcataaaaagcatcggtatttctttaacttgagaacacatactgacatgctcctcgtggcctgaatcttgtttacctccctaaagctccatctgttgaattttccaactcattttctccagggaaagaaagataatgcctgattcattgccctccatcacttcacagcagagaactaatctctcaattactcacaatacaaatggcgctgtgtgactcccacggtaagactctgccctatttttctccaaaggatcttaatgggggacaaagatctgtgcttccaataccactgggaaaatttccttaagtagatttgagaaactgaagcttttctgtcaattcctgaattgtgttatctgtggaaatttagactatagagccatgtatatcagttctaaagtgttgaaatacacattctatatatgtatatgcaacaatgtgtttacataaaaaataatacatgcacatccatcctatcatcaaccttctattttaatatacctctctttttgaggacttttcaaggtggtattacatatattttctatttcaattctataattcttacgttttatcaatagaatacatatatgtgttctacctgtgtatatatctacgtatgtatatttatatatatatgtatgtatatgtatatgtgtgtatatacacacagaacacatatacacatatatgtgagtatatatatctatgtatacagatatatatacatataatgtatttcttctatttgtttacctagtgttatagctcctataggaaagccaagacaaaggctcgattctatttatttaacgatttttggaaatgatttcatatttatagtagaaatacatacttacaaaagtacaaaaattagctggacatggtggtgcatgtctgtaatcccagctactcaggaggctgaggcaggagaatcgcttgaacctgggaggtggagatttcagtgagctgagatcatgctactgcactccagcctgggggacaaagcaagactccttctcaaaaataaataaataaataaacaaaaaggaatgctactgatttttgtatgttgatgttttatactacaactttactgaatttatcagttctaatagttttttagggaagtctttaggttgttccaaatataagattacatcctctgcaaacaaggataattagacatcttccttttcaatttgtatggcctttatatctttatcttgtctgattaatctagctaatacttccagtactacgttgaataatagcggtgaaagtgggcatccttgtcatgttccaaatctaagagaaaagacttttttcagtttttccccattcagtatgataccatctctgggcctgtcatatattacctttattatgttgaagtatgttgaattttatcaaatgctttttcaccatcagttgaaatgattatatggtttttgtccttcattctgttgatacaatgcttcatattaattgatttgcatatgtggaaccattcttgaatcccacatggttatgatgaatgatctctttaagatattgttgaatttggtttgctagtattttgttgaggatatttgcatcaatattcatcagcaatattggcctgaagttttctgtttttgatgtgtctttgtctgttttggtgtcagggtaatactgacctgtagaataagtttggaagtatttgctcttcctctgtgtttcagaacagtttgagtaggattggtgttagtcgttctttcaatgtttgatagggtttagcagtgaagacattgggttctggacttttctttactgggagactttttattaaggcttcaatctcattcttcgttattggtctgttcagggattgtatttcttcatgtttcaatcacgataggttgtatgtgtctaggaatctgttcatttcttttagatttcccaatttattggcacaaagttgcttatagaagccacaaatgatcttttgaatttctgccatatcaattgtaatgtttcatttttcatctgtgattttatttatttggatttttttctctttttttcatagttagtctgactacagatttgacaattttgtttatctttcaaaaaaccaactttttgttgaattgatcttttgtattgttttcttcatttcaatttcatttaattcttctctgatctttattattgtttttttttactacttttgtgtttggtgttctgttgacatttctagttctttaggatgcatcactgggctgtttatttaaagctcttcttcttttttaatgtaggcacttgtagctataaatttttatctttgaactgtatttgctgtatcccacaggttttggtatgttgtgtttccaataccatttgtttcgagaaattttccaattttcttctcaatttcttcattgacccactcatcattcaggatcatatcgtttcattttcgtgtgtttgtatagtttccaaaattctacttgttacttatttctaattttattccactgtgctcagagaacatacatgacattatttcattttgttaaatgttttaagacctgttttgtggcttaatatgtgatctatctttaagaatgatccacatgctgaggaaaaaaatatgtattttgtggctgttgggtgaaacgttctgtaacattacacgaaatatacctgatatacatataggtccttttgatttatagcacagattaagtctgaagtttctttgctgactttctgtctgaataatcagtccaatgttgaaagtgaggtgttgaagtatccagctattattgtgtccaggtctatctctctccttagctctaataatatttgctatatatatctgggtgctccaatgttgggtgcatatatatgaacaattgtggtatcctcttgctgaattgactcctttatcattatattaccttatttgtctctttctatagttttatcttgaaatctattttgtctgatataagtgtagcaactcctcctctttttttggttttaatttgcatggaacatatttttccatccctttattatcagtctatgtgtgtctttatatgtgaagtgtgtttcttgtaggcaacagattattgggtcttccctttttattcatttagccactctatgtcttttgactggagagtttagtccatttaaattcaatgttattattgataagtaaggacttacttctgccatttgttgttttcttgttttgtggtcttccttccttctttctttcctgtcttcttttactgaagctgactttctctggtagcttgatttaatttcttgcttttcaatatttgtatacttgttgtgtgcttgtagatttgaggttaaaatgaggcttgcaaataatatcttataacttattattttaaactaatgccagcttaacagtgattgtgtaaacatataagcaaaaagaaaactaatataaactgtacactttaactttgttcccccaatttttaagtttttgttgtttctatttacatcttattttactttttactgtctatgtcttaaaaatgtgttgtagttattatttttgatcagttcatcttttagtctttctacttaagagtagtttatacatcaaaattacagtgttataatattctttattttctgtgtacttacttttaccagtgagttttgtgctttcagattcagatgattttttattgcttattaacatcttttttttcagattggagaattgcctttagcatttcttcttttttttattattatactttaagttttagggtacatgtgcctttagcatttcttataggtcaggtctggtgttgataaaatccctcaggtttgtttgtctgggaaggtctttatttctctttcatgcttgaaagatattttcactggatatactattctaggaaaaaaggtgtttttttctttgtttgttttggtttgctttgttttgttcttcttcagcactttaagtataccatgtcagtctctcctgatctaaaaggcttccactgggaagtctgctgccagctatattggagctccattgtatgctatttgtttcttttctcttgctgcttttaggatcttctctgtgtccttgatctttgagagtttgattgttaaatgtcttaaggcagtcttttttgggttaaacctgctggtgttctataatcttcttgtatttgaatattgatatatttctctaggtttggaaagttctctgctcttattcctttgaataattgttctattcctatctctctttctactccctccttaatggcagtaactcttagacttgcccttttggggttattttctagatcttgtaggcatgcttcattgttttttattcttatttcttttgtctcttctaactatatattttcaaatagcctgtcttcaagctcactaattctttcttctgcttgatcaattctgctattaagatactttgctgtgaccaggcaaagtgactcatgcctgtaatcccagcattttgggaggccaaggaagcagattgcctgaggtcaggagtttgagaccagcctggctaacatggtaaaatcccatctctacttaaaatacaaaaataagccaggggtggtggcacatgcctgcacttccagccactcggggggctgaggcaggagaattgcttgaacctgggaaacggaggttgcaagattgcaccactgcactccagcctgggcaacagagcaagacttgtctggaaaaaaaaaaaaaaaagatactctgatacattcttcaatatgtcatttgcatttttcaactccaaaatttccactagattctttcacttatttcaatctctttgttaaatatatataatgggattctgaattccttctctgtgttttgttgaatttcctcaggttccctcaaaacagctattttgaattctctgtctgaaaggtcgtatatctctgtttctccaggattgctccctggtgacttatttacttcatttggtgaagtcttgttttcttggatgctgtggatgattgtaaatgttctttggtgtctgggcattaaagaattaggtatttattatagtcttctcagattgggcttgtttgtgcctgtccttcttgggaagacttacttgtaccctaagccaaataatgctgttgattttacagactcatagaggtactatgttggaggtcttggaaaagatccagaaaaattctctcaattaccagccagtgtcttggtgttttcctttattttctcagaaacaagcagagtctctttctccctgtgttgagccaccaggaactagggatgtggtgatgcaagcacctctgtggccaccaccactgggactgtgctgggtcagacctgaagccagcacagtacttagccttacccaaagcccttatcttcagggtggcaagatccccagtccctgaacatgtccagagatgctatctgggagccagggattggactcaaaactcaaaaactttaacaatttaccaggtgttctattctactacagctaagctggtgcttaaatcgaatactggggtttgaagaggaaaggcacaagtcttcccttagctattccagctagtgtctccttaggtaacatgtcaccctaacccacctgctctaagcccagcctagcactaggatttgcctagcaattgcagtctttgtatcctatactgcctttcaagtttacctaggaccccagagcccttcagcctatgatggcaaggcttgcagagaaacttccaactgctgggatgggccattcctctccagctagggctggtaaatattttccctccttgtgccggccctggctaatcccaatatggttttattctctgctgtagcagggcagcactgagtttgatgtaaagtccctcagttgctgtgctcttcctccccaagatgcacagattctgtctccacagtgcatggcattggcaatttatgccacagttgttggcattggcaatttatgactgtctcttcggccctcctcaatactctttccataatataaagtttaaaccaggtactgtgattgttcacatgattttcggttcttgtaatggtgcttttctgcatgtggttggttgttaaaatttggtattccagcatgtggtcggggtaggagggatgaacagtactgtgagcttctattctgccctcttgctctgcccccaaatctccttgttttggcttgcatttccctctttagttcctggtatattttgaacaacattcccttgtaggatatgccttttgaaaatattttttggcaatatttttccccaatatatggcttctcttctcatttccttgagagtgtcaattgtagagcagatatgtttaattttgctgaactctagcttatcaataatttctttcatgaactatgcctctggttatatatctaaaaagtcatcaccaaatgtaaggtcatttagattgtcttctgttattcctagaatttttgtaaacttgtgatttacatttaggtgtatgatcccttttgcattaattgtgtgtgtgtgcattttatacatatatatatatatatatatatatatatatatagacagagagagagagaatactgtgtgtgtaatacacacacacacacagacacagatagatcaatagaacagaataaataacccagaaatagacccaccaaatatatgcatatatacatatataaatatatatatgtatatcttgattactgtagttatatggcaagtcataaagttaggcagtgtcagtcaatccttcaactttgttctacaatattgtattgcccattgtgtatcttctgttttccaatcttaactttagaatcagtgtggtaatattcaaaatataactctctaaggcttctactggaattgtaataaatctataaataaaatagcaaagaattgacatcttgacaattgagtctatccataaatagaaaacaatactttattaatttagttgtttttaaattaatttcattcaagtttcatagtttttctaatatagatcttgaacatttttaaaaagatttatgctgaaatatttcatctttggggtgctaatgtaaatgatattgcatctttaatttcaaactgcactaggtcattcatggtatatagaaaagtgattaaaatttatatattaacttcatatcctgcaagcttgctatattacttattagttctaggagttattttgtcaattatagtattttctatgtacactatcaagcttgcaaacaaagaaaacttgttaaaacttgcttaaaaagcttgcaaacaaaacattcttcaaatcagtacaccttttatttccttttcacatagtattacattagctaggacttcctgtatgatttttaaaaggaatggtgataggaaacatctttgccttgttcctgatctcagtggaaaagcttttggttttctaccattatgtgtgatgtcagttattctgtaaatgttctttttcaagttcaggaggttttcctctatttctagcttgctgagagttttcttcatgaacagatgttaaattttatcatacttttttttgtgtacacatagataagatcatgtgattttttattagcttgtgaatatgataaattacaataattaattttaaaatgatgaaacagctttggagcctgaaatgaattccaagtggctgtagtgtatagttgtatacactgttggattttatttgctgtcattttgttcactgtctttgcctgtaattttctattcttgtaatgtctttatattgtttttatattagtgtaatacctgcctcaaatgagttggaaaatattttctccaattctgccttctggaaatgcttgtagaaaattggtataatttcttcctaaaatgtttggtagaattcatttggtagaagcgttttgcttcctgcttggaaaggttattaattattgcttcaatttcttttatagatataggactattcagaatgactgtttcttcttgtgtgagttctggcaaattgtatctttcaagaaatcagcccgtttcaccaacattgtcaaatttgtgggcagagagttgttattttatagtattttttgttattcctttaatttccatgtgatctatacttatgtctcctctttcatgtctgatattagtaatttgtgtcttgtctctttttttttattcctagttagcctagctactgttttactaattttattgatcttttccaagaatcagctctttaaaaaaattttctctattgattttttttttcattttcacaggcttttgctctaagtttattattttcttccagttacattgaatttcatttactcttatttttctaattttctaaagtggatactaatattattgattttgagctcacttttgttctgcaaatgcagtatatgtcctaaatttccttctaagcactgctatctctacatcccacacactttgaaaagtggcgtttttatttttatttactttgtttgaaatatttttaatatcttttgatctttcttttttgagccatgttttctttagaagagtgttgtttaatcctcaagtgttttgtgattttctagatatctttctgttattgatttctagtttagttccattgtagtgtgagagcatatattgtatgatttctgttcttttaaatattttaagttgtgttttatggcccagaatctggtctaactttgttaatgtcccatgtgagcttgagaagaatgttgtgaataccaattagatccacttgattgatggttaatattgagttcaactataagcttactgcctttatgtttcctgggtctgtccatctctggtagaggggtgtttaagttgcaaagataatagcgaattcacccttttctccttgcaggtctatccattttgccttacatattttgatactttgctgttagacacatacacactaaagactattaaatctttttagagagctaatccctttactatggttcagtactttactcctgttactttttcttgctttttagtctgctgtctctgaaataagtctttctaccccagctttcttttgatttgtataaacattgtatgtctttctgtatcctcttactttgaattgtgtgtatcttcatatttaagtgggtctattataaaaaacatatagttgatttttatatttttatccactctgacaacctgtgttttaattggtatgtttagaccattgacattatactggttattgataccattagataaatgtctataatatttattgttatttctattcattgcccttcttctttgtttcatttttgtcttccattctgtttctgcattttttatttcaattgcacattttatatgcttccatttactctccattcttaacatgtcagctccttattttttcacttatttttaaagtggttttagagtttgcaatatacatttacactgaatctaaagcaacttcaaataactacttctcttcacagatagttcaaataccttctaataacaaaatattcctaattcctctatctcatttcttttatctttgttgtcattcatttcacttatatataacctattattatgaaacacattgttgctattattattttaacaaacgttttgctgttagattgattaataataataaaaataaaagttttattctaccttcacttataccttttgtaattatttttctttatgcagatccgagtttctgatctatatcattttacttcactcttaagaacttcttttagcatattttgcaagacagggctattggcaacaaattctctgaacttttgttagactgagaaaattttagctttcacttttgaaggataattttgcaagattcagagtactaacttcatgcttttgtctgtcaactttaaatatttcactccactcttcttgcttacatggtgtattagttttttttgatgctgctgtaaagtaatacccgagactgggtaaaggataaaggtttaattgacctacagttctgcatggctgggaggcctcaggaaacttacaatggtggaaggggaaagagaagcaaacactttcttcacaaggcagcaggacagagagagcatgtgtgaaggaggtactgtcaaacacttataaaaccatcagatctcatgagaattcactcactatcatgagaacagcataggagaaaccacctcatgatccattcacctccctccctcagcatgtggggattacaggtccttccctagatgtgtggattttataatgtgaggtgagatttgggttgggacacagaaccaaacgatatcattctgcccatggcccctcccaaatctcatgtattttcacatttcaaaacacaatcataccttcccaacagtcccaaaaagtcttaacttatttcatcattaattcagaaatccaagttcaaattatcatctcagacaaggcaagtcccttctacctgtgaacctgtaaagtcaaaaacaagttaggtacttccaagacacaatgtgggtgtaagcattggataaatacttccattccaaatgggagaaattggccaaaacaaaagagctataagtcccatgtgagtctgaaatccagcagagcagtcattaagtcttaaagctccaaaataatcttttactccatgtctcacatccaggtcacactgatgtaaaagttgggctcccaccctgtggcactgcagggttcaacctccccgataccctcccctggctgctttcacagctggcattgtctgtctatggcttttccaggtacacagtgcaagctgtcattctggggtatggaggacagtggcccccttcttacagctccattaggcaggatttcagtggaaactatgtgtgggggctccaactccacatttttcttctgtattgccctagtagaggctttccatgagggctccacccctgcagcagacttctgcctggacatccgcgcattcccaaacatcctctgaaatctaggtggaggttcccaaacctcaattcttgacttctgtgtacctgcaggcaaaacaccacgtagaagcttccaagatttggcccttgcaccctctaaagcaacagcccaagttgtaccctgaccccttttagccacactagagctgtagtggctcaaatgcagggcacgagatcccaaggctacacacagcagccaggtcctgggcctggtccacaaaatcatttttcctcctagacttccatgcctgcaatgtgagaggctgccaccaagatctctgacaagccctcgagacatttttcccattgtcttagtgattagcatatggctcctccttacttatgcaaatttctgcagctggcttgaatttctccctagaaattttttttttctattgcatcgtcaggttgcaaattttccaaacttttatgctctgcttcctttttaaacataagttccaatttcagatcatctctttccagtaaaatttccacagatctctaaggcaggggcaatttgccaccagtctgtttgctacagcacagcaagagtgacatttgctccagttcccaagaagttccgcgtatccatttgagaccacctcagcctggacttcattgtccacatctaatatggtttggctgtgtccccacacaaatttcatcccataatccccaaatgtggtgggactcagttggaagtaattgaatcatgggggtggttaccctcatgctgttcctgtgatagtgagtgagttcacatgagatctgatgtttttataagggggtttttccccttttgcttggcacttctccttcctgctgccacatgagaaaggatctgtttgtttccccttccactgtgattatacattttctgaggcctccccagccttgctgaactgtgagtcaattaaagctcttttctttataaattaaccagtgtcaggtttgtctttatttgcagcatgagaacagactaatacaacatcatcatccgcattttggtcaacaccattcaaaaaatctctagaaagtttcaaactttctcacatcttcctaccttcttctcaccctccaaactgtttcaacctcttcctgttacccagttccaaagttgcttctacaatttcaggttatctttacagcagtaccccactatcccagtaccaatttactatattaatctgttttcacagtgctataaagaaatacctgagactgggtaattgataaaggaaagaggtttcattgactcacagttccacatggctggggaggcctcaggaaacttacaatcatggaagaaggggaagggggcacagtaaacttcttcacgaggtggcaggacagacagcatgtggggaggaggaactgacaaacacttataaaaccattcgatcttgtaagaactcactcactatcacaagaacagaataggaaaaactgcctccatgatccaaccacctccctcccttgacatgtgaggattaacaattcgagataagatttgggtggggacatagagctaaaccatatcatgtgatttctgaggagaaacaggatataattcttttttttgcttctctacaggtaatatttttctagctattttccaaaatgtgtttctatattttttattttctaaaatataaatatggtgcactaggtatttatcatgtgtgtgtgtatgtgcacatttgtacgtacatgctatataactgtcagggaaatcatcggctagtagaaattgaaatagcacacagacaggtgggcagacacatgtggtacgcttgttgtattttttactaagtgtgtctttacagcagcacaccttgtggggctggtgtaccctctaaagtaaagtgaagtgtgtctaggacatctgattttgactgagggaatcagaagaaaaatctctgatacagtttgcatgaacttgagaccaaaacgatctttaattagtgttccaagctagagaaacagccctgagtgaggaaaaggcatggtatttttggaaatttaaggagagctagcaagtctggaagaatcaaacaagagaagaaatcctgcagctgagaatcagatgatacagtgtccatggtcagaatttttccatttcagtctaaatttaccgagaagccattggcaatattcaagcatagtcttggcaggtgagtgcttcatctgggtacttatggacaatagactgaatgatgtggttaagagaagtatctgcatgagagatagcagtagcttgaatcacatggtgcttgctggtatagagaaggatactgaatcaaggtatagtttgaaggtacaatggacagatttgccaggagattctgtgagtgagagggaagatttctcaatttctttacgtcagaacttataatgagaacaactgggtagctgaagatgctataatctaaagtggagaagacagcagaaaaaagtgttcatttaaaatattttaattttcagaatttttcagaagtcagtcatgcctgagctaaggaaaaagatgcagatggcaaatttttgttttttaaaattatagtatcagcaaatggaatcacaaaggtgaatgtagaattctgaggccatgctgttaagtagttgcagatccataatttaattctaagcttctctgactctcaaatgcatgttcttgactattgagctgtggagctagacaaccccaaaatttttatgaaatatgaaaaatgttctgatctttccatctattcaaatgagctaccatgttgtaagcaccacatagtctgtttatgacatacatattattcctattcttttccccaatcctgcatgtgattgtcattattattcattttttccagaagaaaaaattgagttttggagagttaaaaacttattgggtcctcatttcttgaatggctttcctctacagtgtgccctcgtgtacatccatggcccccaccaggcaagaaaacagagtccccacttaggagaaaattattacttaagccttgtttttttttttaaaatgtgttttataattaatactaaaataaatttcactgaggtgtgaatcaagtttgtttgggaaataaaatattaaaatacatggaatcgtgtataatgtttgacaacatctgcatgcttacttaatcacatgatctccctgatggaatcagctcttaagttgagatctgacaccatcttatatagataatgtatgtcataggcatacatggctcagctactgaggcaatcttctctctgtaaaattaaaataaaagttttgccagcaattaatctccttagccgttagaatagattatacaccagtccttggagtgcaaggaagtgagcatgtgagagtgtttgaagacctggcactaaatgattacaatgtcaccaggagagagctcagttacaaaatagtacagttggagcagcttatttcttctcaagtacaattactttgttctcagaaccaatgtaatcattggagcacgtttatttcttctttgttctcacattgtgagtatgtgttagcatgtagcctaatgcaaatatggtaaaatatattatatttgaagctagctagcaatagtttgatatattttcagatatgaagatataaaaaacaaataaaaaacttttaaaaagtcattgctaactttgtaaaaacgtaatatatactcaagactcagcctgctgggctcaggttctggccctggccccatcacagaacagctgtgtgacttcgatacaataacttaacctctctgagactatgtatcataatttataaaatgggaagagtgaaagtgtctacctcacaggtttgccatagagattaaatgaattaaccattattgataaatgttaataatggtgtctaatacatattgaatgtttaagtgtttgtttgcaagtattttcctgacatttttgaaatatatgtgttttatatgttccctaaacttttgtatatcttcttacctcatttattagccacaatttgatcatctgaattcctagctgaataactggtaccatgtttataatacttcagcttctcctagtgtttcaaagctacctcctgccatattttgctatgaatgtactttcttatttcttattatgctggaaacagcattacctagcagtagcaaaacatttcttatggaagaggaacaaatatatttcttgttgagattgtagctgcaaaacttctctcgcttgagttcccatcatgagaatggcgttatcagagaaatacagaaccaaaatctttatgaggccaacgttgtttccaaacatttcttaacgttcccttgattgaccaaaataaactaactaataataaggaatcaaatcctccagaaaaaaataaaaatcaaattaaagaaggaattaagactactaaggtaattcttaggacaaatgaaatcaaattgagctctcattatctccattaaagtgccacatggatgcatacaatcttacatggataatgtacataatttagattcttgtcaaaaaagacactgcagcctctgcctcccgggttcaagcgattctcctgcttcagcctcccaagtagctgggattacaggcacccatcatcacgcctggctaatttttgtatttttagtagagatggggttttgccatgttggccaggctggtctagaactcctgacctcaggtattctgccctcctcggcctcccaaagtgccgggattacaggcctgagccaccgcgcctggccaggagcacatttttctaaatcaagcatgaagacaaaagtgcacatggcagcccccttgaattcagcctcttgccatgagccaagaatctatgtataccatgctggactcttgagttacagaactgaaagcaaataaagcaaagttgttttaagccagtaactttgtggtgatttgttatggcagcaaaaaactaacaaaaaccataacaaaagcaagctgccttcagctttctctgatgagtttctcccctgtaattgtcctgttctgcattgtttgcctgggattttgtcctcatttatatctctgctaaaaaaaaaaaaaaggaaatagcagccctcattgctcaaaccagtgtatggttttcactactcattttaccttatttctgtagcaattgaagactaacctgggagaacatgctgaaaggtaggaaataaaaacagcaacatagtgtcaaagtccagaaatgcccattgctgtgctatctgggcaaattactcaacctctttcaatcaaatttctttataaaataataaagaaaaatgagctttccttataagattgtgtggattaaatgggataatagactgaacaatatttctccaagcagcttaaaagccatttttcaagggtgtttttctaacctctaaatcttcgaggctatgctcactcaatgcacctcttctcctgcacttattgtaacttgaaaatatagttaattgtgggaatgtgttcatgcccaactcttctgctagattatacttacaaaggagactatttttgttcactgtaatattcctgtgtgtggtgcaggacctaaaaaatattaggtagtcaatatatatccgttaaataattgaacattaagaatgtgtctaggatatattaagtgttcaaacaatgttgatttccttccttacttgaccttgtcttgtttatcagcatttagggctgcattttgtgttgtttcttctccttgttctattccttctggtttcatgtgctttctctttttattagtttcatattgcagtcataacagataaccacaaacttggtggtttagaacacccacatatcatctcaccactctggtggtcagaagtctgagcatacaacatggctcaacagcatccactgctttgcttatcggaaaactgaaatcacacgtcagcagagcactgtttcctgttcaaggctccggagaaatatctgcttcctagttcaatcaacattttggcagttgtttgtggtaggaatacacattggttataggaatgaagttcccatgttcttggtggctatcgccagggcactgatcattgtacttagaagtctctttctgtctgtgttcatggcccctatatctcaaaaccagtatggttgaatcaaatccttctcacacttggaaaccatcagactgctctctctcatatccttaactccaatgggagggagttcctacttttaagggctcctgtgattagactgtgtccacttggatactccagggtaacaccaagaacactcttacaccaccgcatggcaaggcctctagctttctgacctctaatgccagctaagtcatagccactgccaattctatgcttttatgttttattattttattttattttattttattttattttattttattttatttatgttacccttatgggatcacatcacttgggggaaacaatttctacattagtcaaggtaagtcatgttatataggtatataacaatcacaaaattccagtgccttaaaacacaaaggtctttcagatgttctattcttcctgtgtcttccgaatccaccatctttgatgtacacctgtactttaacttcaggaagggtgagatgaattaagtattatgtgttgggtatagaattgggaatatgaattttatccacattccattggctaaaactcaggccatggtccctgcaaactgcaaagaggactgggaaatgtaatttctcttaatgttccaggggaaataaaaaagaatttggagaccatagagcattctcttcatcctgtagactctttccaattgaaaagatttctaaacatattcccttctatactctgaatctgtattcatagattttctctcaacatctagtcaattccccatgtttctgtgcactgcctgctgtttcttctttccataatgctctatccctgtttatgtgaattgagaggtattattcaattatcagtgccaattgttttgaggcactggtagaagatttatgaggttcttctagattgtctaaaccagaggtggtcttttttttccttatatttttaacaaaaacctatttatttacatgctgcatatcaaatgaaacatagttatagtttgtcttttcaaaatgtagttttcttagggcagaaattatgtctgtgaatgcccagcattagcgaagttccttacatatggtaaacccacactatgtttgtttgtttgaaggcttaatatgtaaatgaatgtcctaataaataacagatttattgaatgtatttgtcttagtaataataactcatgcttatcttgaccttgctgtgtgctaggcatgagttttccaaaatgtagaaactaaggcactgaacagtgaaataactccataaaatcatggcctaaggagtagtagagatgactttgaacccatagattgtggccattgagtttgtgttctttactactatatgtctgttaatttcagcattattaaagaaaataactttttatttctatatattatgtgtcagacattataatcattgctgttgctctttttatcttcaaaagttccgtacagaaaatgtattgatagtccccctggcttttttccctgcattgcatcagattagaaaaatgaggaatcaggctgcttgtttctgctcttacatgtaaatgacttggcagttgtcactgtcttctctgcatcaagaacaagtgaacaaactgtatagtgacaactcttcttctaatcacagagaaaaccaccacgcctaaaactggagaaacaagtgaatacagggaaccacagcttactaggagcagaaaccatcattggtgccaataaattacagagaaacttaaactataactgatgaattggtggttgctcaatgtggactagttggaagttaaatctcctagaggtcaagcctcaaggggaacactgctctttcatgagttttacctccaggagactcaccaggttatcactgtaacaatctgagaaaaatttctacccgtttcctgcaaggaaaggagaaaagcaaccatgtttaaatatacccagagcattctgttctgtttaacaaaggtctcccctcaagaaaaacctagtttattagaacccacctaacatggaagaagggaaataaccccttgaagacccctcaaactttcctgtctcacctatgggagatgaaagaaaagctgagatgtatttgttagggtcgcaacccatgggcacaggttcactgaaagactgagacctagtcagaaggttatggaatacttcctcctttctcacattttatcccacatcaacaaggctgtagcataataatagtgaaatatagttgaaaaatttatgaggatataactttatttaagaagtgtcttttaggccgggcgcagtggctcacgcctgtaatcccagcactttgggaggccaaggcgggcggatcatgaggtcaggagatcgagaccatcctagctaacacggtgaaaccccgtctctactaaaaatgcaaaaagttagccgggcttggtggcgggcgcctgtagtcccagctactcaggaggctgaggcaggagaatggcgtgaacctgggaggcggagcttgcagtgagccgagattgcgcctgcactccagactgggcgacagagcaagactctgtctcaaaaaaaataaataaataaaaataaataaataaaaataagtattttttgagtttgcatacaaactcaaatgcaaaaagggagacaaaaacaaggacactggaggaaatggaaacttccggcatctacagctgcagcaagcagtaaacacagcctaactcctggcaagacaaatgcaatagctcacactaatgatctactcacatcagtttcttttaccagggcatcatgtctggctttcaataaaaacccagaaggcacggtaaaaggcacataatacagtgtgaagagaaaaaactagcaacagaaccagaatcagatatggcagagatttttgaattaatgaattggtagtttaaactaactatattatgctaagaagtataatggaataaagttgacagcatgcaagaaaagataggtgatgtaagcagacagctgaaaactttaagaagataaccaaaagaaaatgctaaaaatcaaaaccattgtaatagaaatgaaaaagttacagtctttcatgaaattattaaactggatacagctaaggaaaaaaatagtgagcttgaagatacgtctatggaagctatctaaactaaaaattaaaaataaagactgaaaaaggaaacagaaccgtatacccaagaaatgtggaacaatttaaaaaggggtaacttatgtgtaatgggaataccagaagaagaagaaagaaaacatgtaggaacagaataaatatttaaaatgataatggctgagaattttccaaaactaatgacaggtaccaaacttcagatactggaatttcagagaaatcaaacagaatatacagaaactaaaagcaaaacaacacaaaatactatgcctaagaaatattttatagaagctgcagaaaatcaaagaagaaaataagccagagaaaaaaaatcaccttacttagagaggtataagtataggaattacattggacttctcttagaaaccatgcaaagaagaaacaagtggagtgaaataattaaaatgttgaaaatttcattaaaaaacacacccaactggaattctgtatcaagttaaattatccttcaaatgtaaagaaggaatgaaactcctcagtcaaacaaaaattggggaacatattttcagttcatcctccttgctagagctataaaagaaattcttcagagagaagaaaaatgatatgggtcagtaacttatgtatacattaaaaaagagaattaaaaaataaataaaaacaagatcttgtttatatttaatttagctaacagctcttctgtgaaataataataacaatggtctatatgctgattatgccttatggataagtaaaatgaattacagccatgttataagagataaggaaggtgaggttttgaatattctactataaaccacatgcattatccatgaagtgttttagtatagtagtcttatattagttttaaatgtatatttctaatattagggaaatcactaaagtaaattgaaaatataaataaaattgatatactaagagggaagtaaaaatggagtcataaaaagctcaattacaacctgagaaggcagaaaaagaggggaaaataataaagaaacaaataaaaagggcaacaaacgaaaagcaagtacatatgtagtagttattcatcctactatgtcaacaatgacttcaaatatgactgctctaaatatactcattaaaatgctctaaatatatccattaaaagacagactttctgtgtagataaaaataaacaagagtaaactatgtattgtgtacaagaaatccactttaaatataaggacacagataggttaaaagtaacaaaagaaacacagaaaaagagaagtatttagatacaaatccataaaaatacataaaggatctacactgtgaaatccacaaagctctgaagaaagacattaaagaagatataaataaattgagagatattccatatttatgggtgggaagaaatattgttaagatgttgatttttcctaaatttatatatagtttcaacacaatctcagtcaaaattccagcaaggtattttgtagatactaataaactgattctaaattccacatggaaagcaaaagcccagaatggctaacacaatagtgaagaagagcaaaacagaagagctgaagaactgacactatcttatcttaagagtttctataaagctacattaaccaaaacagtgtggtgttagcaaaagaatagacaaattgatcaagataacagaatagagaagtcagaaatagccctgcacaaatgtagtcaattgatcttgacaaaggagcaaagaccacaaagaaaggataatcttttcagcaagtagtgctgttaacaactggacatccacatgaaagaaatgaatataaatacatttcttacaatcctcacaaaaataaattcaaactgaatcacagaactaaaagcaaaacacagaatgatcagttttgataaattcctaagacaacatggcagaatatctagatgaacttaagtttggcaatgagtttatggatacaataccaaagcatgatctatgaaagaaagaagaaaactgaaaaattggacttccttaaaattaaaaacttaattttccctcactaatctattgattaaaagtagattaaaaatgatgcactctgtaagtctaggactttgtttttgtctgtacattatctctaaaatgtaaaaaatacttcttggtgcaaaataggtactaaaattgtttaatgacaatttgcagagttcaaagtaaagcacaaattgcttcacttgttcacacacaaaaaaattttacttttcaattgagacttaattcatctaatccaaacctccaaatgtgagatagttacaaatgaaaacaaagaggttaagattgtttgagttttacttaattcagctgcttttgttgttgtttggttgtatttttctggctacatagtagtttggccaactgtaggcaatgcagccttaaatagagaggtttagtaccaagcctccttaaagggatttatctctttccatatatattttttcctatagaaatatttaacccagtactccttttggaacattgatacatagtcagtactattaaaataggcaattaatattgtggagttcaaacatgggacaaataagagttggaggaatggtgactaacatattttttctctgcttgttccacaaatggtactttttcccccatctgcataatcagatttcaaatttaatgaatatttgctacagtcatttctatgtataatagtgagctaatatgataatatttattaatttattcaacaaatatttatgaaagtgtcctactgtttgctactcctttgaatacctaatgatgatagatgaaggaaatgaaattaggggaagattgacatgagtcataagacgtgtggctgaaaataaattttaataggaggaaagaaaaaattacccaactggggagaaaacattgtagtaaaaaatgtaatcatttaattctgtttcccaaatgaaatggactttaattcactacagggcaactaatattagtagggttaaggggaaccattagtggtgccagtttgtaggtgacagtagtcacctttgccttgtaaacttaactgatattgagagtcttaatagccataggaacatgacaagataattatcactgaagaataataacaagctaaatgcagataaagttaactttttattcattttgaactatgccagaaaatagttaaatagatgaccattttccaaaaccaaattttgtatgattgcctatttccatattttcagattaaatttctattccaaatattgtgcttttcatcatcatttcatccaagccactcttatagtctggatggctgtaaaaatggcataatcactatgtgtacagtagcaattttgtcattacttgcagaatgacaataaatatgtaacttgtttttgcttcaaagaaaaaatagacctgtataaaaggcaatttttttccttctgctcattttagttcggcatgaagtagtttaaaagtttccaggataatatcatgcacccttttaacattacagatgccaccttctggaagttacaataaatacttaagcacagttgtgaaaacatgccctctttagcttataaaatacttataggtagatataggcaaattcacctgacatcatcattgtgttttgcatgaacaataattgactccttacttctatactacgttttaaagacaagaaatgttcgtggtgaaccacagactaattatactctttgcattgcaaaaatagttctttaaacataaatcaatagattaaaaaaatgttttgctaagtaaggcaagcaagaaatatatttagaaagaagtattttggcttcaagtatttaaaacacatctattgtgttaacctgccaatgactcaatcatgttacattctaggtttttaaaaatctgtcattcacattccccccagcaaaactgaagccatgtaggtaagaacagaaaactaagaagcttgttaatagagaggactactcttcaaataagttaaaaataactttgcaagaaaaaaaggatcaccatagtagtatttatataaatttatttaatgcttttgttttgcctgtgagtctgggcatttagaagtcctaacatgttaaagtggaaagggagagcagtctcatctggtctaattccttctttccaaacctgaagcaaaggagttctagagatatggggccatctgcctggagctcactgacaaatccaccagtatcataattctgtttcaagtcaaaatcctcttttaaagaaaccacctgggattttactcccaggaaacaaaattgggatcaaaaccagaaaacaaacagagatacacaaatcaaaacaaaattttgtcactgaaatttttcctgcttcactgtttaatccccagtacttcgtgatggatttatgtcgctcataggaattgcacccggtcagacctgaacaagcttaacctcccagtgagtatacagctttcaaacccacactaaaaagtggggaaaataggtaagaacgaccatcagcattgattcaatagattacatggcattaattacaaagtagtttataaaccaaacactaaatggaagacgtttatatccttaccattagtgatttctgtgtcagaggactcacttgagtttataaaactgtattttaaggctggaatcctaaagtaagatatttctgtaagaacaatcagttagtgtcatagatattagtgtggttgaaagcaattagcaattgatttattttaattataaaaaaattaaaagatcacaaatacaaacaaaacaaagccaagcaaatcaatcttaacataaatattaatgatgtattggatttttaataaagaaatgtaaatagtgaacaaatagcaagctattagatttggaaagataagatttgggaaatgatttattgtagtgtattttatttgtagttgcatcagaaattacattaatcattgattaaattacatttatgattcttacgtgatcaccatatccatttaagagtgagcctattagataaaagccaaagcaattatcttactgattttttgaaataaaaaaatagtaataactcagaaaaaatgagatgcacatgttcttccagcatattttccaggcttaatagagttaaaatacaggccttaatattatcacaatagtgatgaatgtgcctgcttcccaggctagacaatttaggaataagatggctggtgttagtcatctgatcaggtagttaactccatcctcagctggcttttctctttactgacagactgtcacaatgtccattaacaatttcccaaaagcagcatggaaattgataccaagaacactgcaccttcagcctaagaaggtttagatttgagggtattgttttattagtaatccattattcaactgagttatagtcaattcatttttttctctgaatcctgatatataccatttttatatataccttatatatacaccatttttgaaagaaagcaaagcaacttactatcccagttaaaatggctttgttaaaaattacacaaaaaaatagcggcttaaaacaacgagaagatttatttagctcagagatctccagctggagcaaggctcatagaagatagcttgtttctgctccatggttggtagctggggctggtgcaaggctgccctgggaggcaggcagcctcacatctgcctcactgtttttcagggattccacacactccatccagtttcaagaggaatagaaataaactccatgtcttgatggggaatggaaaggcactggaagagcacatggaaacagaaatattactgtggtcatttctggatgatataatttaccacatctgccctctggccactacaacttaatggcagtcttcccacttgcaacactcactcatctgctcttcaaaatttcatctcattattgctcaaggcgaagatccagcacagatgcaggtgtggccaaggcttctcaaaaggcttctcacattggaattcttgagtactgcccctctggtgctgaaagaagctatgagctgaattgcatttcaccaaaattcatacatcacagccctaacccctagtacctcagactgtgactgtattacaagatacggcctttcaaggtgtgattaagattaaatgaggttcttaaagtgggccctaatccaatcagagtggtgtctgacctgaggaaatttggacatacaaaagaatagcaggggtgcacaaacccagggacaggccatgtgaggacacagggagaagcaagccaaggggaggccttgatagaaaccagacctgctgataccttaatcttggacttctagcctccagaactctgagacaatcaatttctgttggttgagccacccagcctgtgttacttttctaatgacagcccagaaaaagaatacagatttgaatcaaagagataagttatccccttctcttctgtaccttttatacaatggtggaacaggcacagaatagacatgacaggccctcctgttcagtaacagggaatgctggagactcacagcaattactagcccatagatattctgaaagctggcaaggtgcatgtctattccttgcctgaggctctgttttagtgcctgcgagtggtccacctgcttcctggctctgccctctaggatcctggctctgccttctagaaccctactctgccctcttgaatctttactctgtcttctgcatttatggccctgccccataaggtcttggctctgcactctgaatcatatttccactgtgccttacctgggaagataaaacatgtaaaacatatgttcctggttcatagggaggtgggtgtattatgcatatgttaaatcaactgccataattgcattaatctccactttatgctcatgattttctaattgatttatcaagatcaaacaaaaaataagcaatgactatagacgtttatcaatttttcagtatattttataccagttttctttttaaaatttcagtgttacattgtgatattcttttatctataaaagtctaaaattcaaattctgaaataatgcttttcctccaagtattctttttggttaatattctcaacctctctttcattttgactgcatttatctgatatcattttcaatgcagttaattttaaccatccttgctttagtttgacagtattattttaccaaatctaatagtgtttaatttcattaactgggtttagttatctctatcggtattatgtgaatatttgatcttctttcattcatgtcttaatttattaacatattatctggcaggatgacgggccataatgaagcaaaatggtattccaactgcccaaatacctatgacttacaggcatacgtcattttattgtgtttcactttattgcatttcaaagatgtttccttatttataaatcaaaggtttgtgacaacagtgcatcaagcaagttaatcaacaccattttcccaacagcatgtgctcatttcctgtctttgtaattgtcatgatatttcaaactatttcgttattattatatctgttatggggatctggaatccgtgatctttgatgttactggtgggattttttcaagtgccacaaactgtgcccgtatcagatggcaaacttaattgattcatgtagtgtgtctgctccaccaaccagccattcctctgtcttgctttctctcctggggcctccgtattccctgagacccaacaatattaaaattaagccaattaataactccacaatggcctcctagtgttcacgttaaaggaagccacgtttctccctttaaatcaaaagctagaaataattaagcttaatgagaaaggcatgtgaaaagctgaaataagctgaaagctaggcctcttgtgccaaacaacaaagttgtgaatgcaaagagaaagattttgaaggaaattaaaaatacttctccagtgaacacacaagaatcttaagaaaatggaagaaccttattgtggatatggagaaagcattagtgatctgtgtagaagatcaaaacagctacaacattcccttaagccaaaacctaattcacagcaaggccctaactctcttcagtaaagagaaggtatggctgaaggccgagagaggtatggaagctgcagaagagaaggttgaagtgagcagaagctggtcatgaggtttaaggaaagaagtcatcttcacaacataaaagtgcagggtaaagcagcaaatgctgatgtagaagctgcagcaagttatccagaagatctaaataagatcattgatgaaggtgggtacaataaataacagattttcaatgtaggcaaaacagccttaaattagaagatgccatttaggactttctcaaatagagaggagaagctaatatctggcttcaaagcttcaaaagacacaggctgactctcttgttaggagctaatgcagcttgtgacttcagttaaaaccaatgcttgtttaccattttttaaatcctagggctcttaagaatcatgctaagtcaactctgcctgtgctcaagaaatgaaaaaacaaatcctgagtagcagcacatttgtttgtagcattatttactgaatatcggaagcccactatttagacccattgctcaaaaataaaacaaaacaaaacattactttcaaaatattactgctcattgacaatgaacttgatcacccaaaagctctgatggaaacctgcaacaggattagcattgttttcatgcctgctaacacagtatctattccgcagtccattagaccaatgagtagttttatctttcaagtccaattatttatgaaatacatttattaatgctacagctgccaagataatgattcctccaatggatctgggaaaagtaagttgaaaaccttctgaaaaggattcaccattctagatgccattaagaacatttatctttttatctcctgagctattctagtggttgatccatagtaggtgttcaactaatatttactcctcattcattcattgcaagaaagtatgacgttatgagtctttcaaggaactttcaattcaattgcatgggtaagacatacgtacttaaatattcacatatatactttaaatagagttgtggggaaataacaaatttccgggtttcccagtgggcctgttaagagcccagccctcatgagtcatgaaaatatatatgatataatgttacaggatgtttgctttcacttccccaagaaacatttttacatactgtaaggttgagatctatagccaatgtttctttaatgatgcagttaattgctctgattgaaaaggatgataaaacttccttcatctccccaaaagccaactgagtacatcctgggataggtacctaggttagttaccaaggaggcagtgagactggagtcttatctctctaagtatttgcatttccaaaagaaatagcaactcagagaacccagagacatctccatgccttacaggtcagaaatgggaatgaggggtggttgagtggttatctggcccttggaaggcatattttcattccagaatgtgaaggtaggatcccaggatgctcctcatcccatctcaacagtgcaactggattctgtccctgcacccacccccactacccgctcctttctggagttggagggaaatgactaatgtatgttatatgtctctctcttacatgtgaatagagaaaatccattttctccatgacttgtgtatagctttccagctactcatataagtcatttgacctggctttaatttggtcaccgcaaggagtaaggtctgaggaaagcaggaccaatgcacttaatatttaatgtaggatgataaatcagaaatcccttccttgattcagaatactttctatgttcattcagaataaaactaataaagatgactatttaaaaccttgcaagcatatgacccataatgaatgtgacaagtaaagtataataacactgtatagacttaagacaagctgttcttacactgatttttccccttctagggaaggaatgtaaacagaaaaggcaaatgctttgtatttccatcatcatgtctattttatggacacaaggtctagtttaagttttgcctttcaataaccctgctgggctgggactttgtaagaagacatttcagtatatactcatacatgcatatgattacaacagcctaccctgtagattttattctaatttaaatctcataataaggattgcttaactgttataagtatgacgtgaaagaagacattttgtatcttcaagaatatgaagaatccccaacattaagaggtttactggccactaagtcaatggacgtactatttgtcttaaccagccaaatatcttactatatgatgaatacattgtccctaggtttcatatgtgaaaagttcacttttgttagaagaataagaaaatattttatgtattcaacacttaacaaattgtctgtggggacctatcatgttttgggaattgtgctaggtgctaagtgatgggagtctacacaggggtaagacataattctgcttcaaagattccatagtctagtaggacaaatttgcaaggaaagttagttttttaatctatatattttctttttttaattatactttaagttctagggtacatgtgcacaatgtgcaggtttgttacagaggtatacatgatctatatattttctatgtttttttaatctctccttattttttcagtgaaattaattttgttgaaaccagacctgtttggcagagtttctcagtttggattttgctagctgcacctctatgttattcttttttttacatatttacattgtctttgtatgttgtgtaaatgagtattcagttctagaggtccagtgagattcaggtctagtgtatgcttgagttttggaaaggcactttgctgtgatgctatgggattctttcataaggcatgccatgttcccttgtccccttgagaagtgacagtgtgctggcagccctcgcagccctcacttgctctcagcacctcctctgcctgggctcccactttggcggcacttgaggagcccttcagccaactgctgcactgtgggagcccctttctgggctggccaaggtaggagccggctccctcagtttgcagggaggtgtggagtgagaggcgcgagccggaaccagggctgcaccgcgtgcttatgggccagctggagttctgggtgggcgtgggcttggcggccccacactcagagcggccagccaggcctgccggccgggcaatgaggggcttagcaccctggccagcggctgcagagggtgcattgggtcccccagcagcgccggctcacgggcgctgtgctcgatttctcgctggtccttagctgcctcctcagggtcagggctctggacctgcagcccgccatgcctgagcctccctgcccccaccccgtgggctcctgtgcagcccgagcctccctgacgagtgccgccccctgctccaccggagcccagtcccaccgaccacccaagggctgaggagtgtgggcgcactgcaggggactggcaggcagctccacctgtggccctggtgcgggatccactgggtgaagccagctgggctcctgagtctggtggggacttcaagaacctttatgtctagctaagggattgtaaatacaccaatgggcactctgtatctagttcaaagtttgcaaacacaccaatcagcaccctgtgtctagctcagggtttgtgaatgcaccaatccacactctatatctagctactctggtggggacttggagaacctttatgtctagctaagggattgtaaatacaccaatcggcactctgtatctagctcaaggtttgtaaacacaccaatcagcaccctgtgtctagctcagggtttgtgaatgcaccaatccacactctgtatctagctactctggtggggacttggagaacctttatgtcaacactctgtatctagctaatctagcagggatgtgaagaacttttgtgtctagctcagggattgtaaacgcaccaatcagcaccctgtcaaaacggaccaatcagctctctgtaaaatggaccaatcagcaggatgtgggtggggccagataagagaatgaaagcaggccgcccaaaccagcagtggcaacccgtaggtccccttggaggctgtggaagctttgttctttcgctctttgcaataaatcttgttggtgctcactctttgggtccacactgcctttaagaactgtaacactcactgcgagggtctgcagcttcattcttgaagtcagtgagaccaagaacccaccaattccggacacacccttacatggtgttggcaggtattggtgatgactacctagacccatttcttattaaggatgcctgtgttgctcttctgattttgtcagttgttctcgtgtattcagtagaattagggtgttggagtttcttctcaagttgtgggagtttcagtgcaaaactggcaaagtcccgaaaaaccaggacaagttgggtactttgatggaacacttctacacacagaacgtcccttcactcaccatttggctacacaggtgtacagtttatacaggaaaggcgctcaagtagttttgacagaaatgatgaatgctacccttggagctttctagataatttgcctttagaaacattgtgtttatctcatttgattaatgtactttctttttatttttacatttttgcttttgatcatgtataatttcctaatggactttagtcaagcattcattgagatgttcttgaaataaataggctactacatggaaatatcacagtaaaacacacatgctggagtaaaaaactgaagagaaaatagtaaaaataagaaaaatatcaacaattctaaaactgcattacaattttaaaactgaggagttacaaagagcagagaacagctgaaagtttccttttcaatatcaggatatgcctggtctgaaaactctggaaaataaattctggagtaattggctgattaaggagattcttaaaaagttgtggctaaagtttgggaagttacttgatgatctttggtaactgggaaataaaactgaatttctgctgaattgggaaaaaatattggttcatatgaattaaaaataaatattgagaacctacaagttaaaagtactgtggtccttgagggaggagaggaaaaggaggaacatatcctgccatagagattttactgcttgtaattcagttgaatattaaaaagatggcacatgaagcataaccatgcttttctttgcaagtgagagtcatgtactcggagaactttgatctgaaacagacttcagtgatcttatttctagagatctcattttaggtattgtgaatcctatacccagaaaggtagacctaccgaaattaactgttaagggtaagtaaaattagataattagcttaagactggaaagcaattttcagaacagagttgaactaatgtgtccctgttttaattgattcttgaggaagggaactttaagtgctttctttgaactcctgggatcccccaggaagcacagttattcaaaacatctgacatcctccttatggtttttggttcgttctttctctttttttttttggacgtagtttcactcttgttgcccaggctggagtgcaatgaagcagtctcggctcactgcaacctccacctcccaggtacaagagattctcctgtcttagcctcccaagtagatcagattacaggcatgcgccaccacacctggctaatttttttatatttagtagaggcgggttttcaccatgttagtcaggctggtcatgaactcctgacctcaggtgatccacccgcctcagctttccaaagtgccaggattacaggtgtataccaggcttttggtcctttctgttctggtaattattcagtatagaagttaagacagctattaaacattttcagaagcagttgaaattctcttgccttgtcctacaatatttaggcttctcagaatgcctttattaaaagaacatttttcaaccattttggaagacagtgtgtcaattccttagggatctagaactagaaataccatttgacccagccatcccattactgggtatatacccaaaggattataaatcatgctgctatagagacacacacacacgtatgtttattgcagcactattcacaatagcaaagacttggaaccaaccctaatgtccctcaatgatagactggattaagaaaatgtggcacatatacaccatggaatactatgcagccataaaaagtgatgagttcatgtcctttgtagggacatggataaagctggaaaccatcattctgagcaaactatcgcaaggacaaaaaaccaaacgccagatgttctcactcatgggtgggaattgatcaatgagaacacatggacacaggaaggggaacatcacacactggggcctgtcatgaggtggggggaggggggagggatagcattaggagatatacctattgtaaatgacgagttaatgggtgcagcacaccaacatggcgcatgtatacatgtgtaacaaacctgaacgtagtgcacatgtaccctagaacttaaagtataataataaaaaaaagaacacttttagcattatcctactcactaaaattagcattgcaaatgtgcaggaatattttagtcttttttttcacaaatgcagaactcaccaatatcatgaaaaataagcatgccaccttgatgataccttgattcaagtcaatattccacttttatgagatatgacaagtgagtttgggctttgctccatacaattcataagtcacatacgtaatgagcatttatttgagctacgttgagcctgtcctgtgtgtggtgtgcttttatgttgtttccccacaatgggccaaggccagaaaccatttcttttcattcatacaaggtcaagttcaaccacaaaacccacactcattatggtagcaggaatggtgctttaaataaaaatgtgaaagagtgaagaattgatcaacgaagactgcaggccatccaggaaggcaagggtgaaggatttattcttcagcaacaaatcacatgcttctaagtgttcagtattttaactggtctcaaaagaatctcatggtgtttcaaaaggactaattgatagtttgtacctggctctcaggtgaggaagagacatgagccctcagcagggagtttccctatctagaaagggcagaccagtgaactattcacttgattatctccaaagcaggactttccatttcagagagctctgtgccttcttgtccatatccagaaagctcagccagcctgttctttctgcattcctgctgatggaaaccccagttgttctttattagctgttactaaaagtcttgactttcccttcatcacaaaggtgtaaaagttacaaacaattctttatgtctggagcaaatagtcacagatctacctttttattaaaaggtgctattgactctgtgcaaactaaagcatggtcaatctttctttaaattagagtctatcaaaaatctttgcaacatcatcacatagagttggaaatactctatgtaaagtatttttttccattttttgtactagattttaggccttttttggtatgggataacattttctatatattgtattatcattgaatcttgcgtgtagtagttaaaattaattagctacaattatgtattgtttcatgttgccctaaaagcaggaaaatcttacatcctgagagctgacattattgtctcttctgttatattagttttttttattgtcttataacaaattaccacaaatgtaatggcttaaaacagcatgtgttattctctctcagtttccacgtgtaaggagtccaagcacagctcaggtgggtctgcaggtcaggatctcacacggctgcagtcaagatgtcagccaggctgtgcttctttctggagcctgggtcttcttccaggctcacgtagctaaggcagaactcagctgcttgcagtggctggactgaattccccattttctttctaactaaaagtaataaaattaaaggtgaaataggcatacagaactgtgtcatctgactgtcttaaattagagcacaaatttgatactactaaatttcctgaaagctgaaggatatagggaaatgtagttagatttgagatgcacgtgtcttttaagaaaagaaaactcaccatccttgagaagcgtgcattgtttcagtcaaggaagcctgagttcggggaggtgtggaaggctattttaaatgcaagtctgtttacttttcactcctacactatttccttaaaacattctgcctgtcagagaattgtagttcaaatattttattttacaaataaagcaactgagaaaaaattaagccaagcagctatgtagtgaaacacttggaaattaaataattaattaattaaataaattaaatagtcattcactgattttttcattaattaaattgccacctccaatcgaaatgacaggcatatatttctaatttatgatatactatgaccagatgttatttactgaaaaatagaaaattgagatttgtaagatctcctaatgttctcctaccacccctgcctaaatttgataattatgttagtatttttgggtgaaatggcacttttaagttgtgaacttctttatatattcaacatgctttactatagaaaggatacatgaaaggcgaaattgatgaaccttttcaggttcaaaaaatatttttgttctgccttaacatttgaatgattggttgaaaatgttttgctccagaactttgaagatgttgtctcagtatcttctgtcatcagttgctgctgctgagaaatgtgatgctcaaaattttaaaatttatgcaagaatcagctgtgggatttgacctaagtctgtgagattcctatggtataagaggaaagaggatttcattttaagacaataaaaccctcatttttagcttcaactatcccaacagtacatttaatctgttcattgagaaagcttctgattctttgctgtgagcttaccgtggcttttagactgagctgattccagtctctgtgtgtgactgattgttctgagcaccagatccttctgagtggcagggagttcgttcacaacaccccatgtaatattgtcacagctcatagtaggctctggctttttctgctgcccaaatcctgtacttcctttttttgtttgtttttgttttttgtctgtctttcagcattttggggatggcccttgcaattctgattttccatccatgtgcagttttaactcggtgggtttgtttttttcaatacatttatgtcagtggggtctatagagggatagaagtcaaatatgtactgagttcaccatcttgacaggagccattcaagtcatttttgccaaacgacttgattcagcttcccagggaaggggttcaagcctctcttaacctgggtttcccatctcccttcaggattcctaatagagaagtatgagtcagggtgcctcacagtactgttgtggacagaaccagggatttagggcccaaaggcaaggttcaatgttgccatagaaataaatggcagtgttctattgagcaaatgctctatactctttgtcttagtccatttgtgctgctataacaaaatatctgaaactaggtaaattgtaaaggacagaaatttatttcatacagttctggagtctgggaagcccaagatcaagatgccggcatccgctgtctggtaaggaagggccttcttgctctgtcctcccatggcagaaagtggaaaggcaaaaagggacaatctctctttttcaagtcctttttttaagggcctctaatcccattcatgaaggaggaaggaggaaccctcatgacctaattacctcttaaaggccccacctcccattatatgggccattcagtttcaacacctgaatttcagagggtacccattcaaaccatagcattttttagtctgattctttatcttcataatgtagaaataactcattgggattcatggagacagattgtacagtgctggactcactgctgcttctcaaaaatccaacaacctcagcgtgacttttgggcctcaatgagctggacatgggttctgtttttccagtcttagggaatgcgtaactggaagggcttcacacttgtgttatatccaaaattgcctttgggccttagcacatgaactttttttctctccctggttggccttccctccgtggtttgcctgagaaactgcccttccttcaggagctggcttcacctccctcctgctcatttcccacgtcagccatactccttggtgtggagttgctccttcccctcagtcaccagggctctgcaaatgaggttgtgcttctccctggggtctccccctccacgactctcagagggcagcagtccagtcttctacatccctgtattcccacagtggggactatcctgccatgtagaagttaatcaacaattgccaagtccaactggatggaaacaaaagaacaggtttacacattgtttctgcgacgtgctttacagtatggttttattatgccactgaggtgatatgaattataaaagcagcagacacagttccaaattaagttcaaaatcacattctaaaatcaatacaagtgtccttggcatgtgggaattattatcactactcttcctgttaccaagatgaatagattttatattatattaacatcattctctgtgcagtaagactggacttcaaaggaaatggaccagccttgatactgaagcaggtttaatgttgtcagcttttgattatccttgtcagcacattcatgtttatctgttttccagaatgactttctcatgtcacctagaatatttctcagtagactgataactgcttagtggtgtgcctttaaagaatataaagtaattttatcttgtgttactttacaaatgatgaaataagcttcataagaaaaaaatactcatgggaggaaatctaatgtcacctgtaaataactgctagatgatcctggccagcatttcttgtcaataatccagatgacagatatttgattgtgtctccgttgagtgcatatgtaattagaagttttatttgttttccctttttgtgtttttttttactatttccttcttattttttaaaaatccaagtcccagcttatccataaagtccctttccagccactctgacataatgtgaatctcttccaaatattgattgtgtcccaccatgtggcaggctctgtgctgggtgctaggaatactgtgctgaacagctgggagcaaggtttctctcgggaacccataggctcttttcagaagcaccttgaactttatcggagtgaaaggtaaagaaacatcaaatagttttgccatacaaatgtactcctggatagttttcagtttgtttgcaagaacgctcacactcctacatctgctcagtattcattagagtaagtttttgtttttaacttcattaactaatggaggatacaagcaaaggtcaggaccaatgagttccatgtgtcctcaggaaaccctgaaggacagcatatgggaaccagtttgatatttggccttgacacactaaaggagaaaatcacataaagtgggatggatggccttggacacaattagtccaggaccgcagttatatttcaatatttcagataagtttgcaatggtttagaccttgaacaattttgactcaataacactatgcacaactttcataacaatttcatttcaagaagtgtctaatgattatctggataattttcataactataaattaccaaatgactgatgaaagtattaaaaaaatttacttttaacagtacagggattaatgctgtaatttttttacagatttcaaatgtagccaataaattagaatcttgtactaagaaaaattaccactttcaatgcagatatggtaatgttttaaggcttgatgaactattcaagttcagaccatcatcaagtgtgacaataaaacactttcatacttgaaattgtcatttcttattgttccatgtaagttaacgcacggtttgatactcctttgtttctcaatgttatgggagacatgcatactggtattctgtgcctgaaaatatggccttgctggcacctagttgctgatcatctaaagacaaatcatactgtgtggcaatgacaggcgacagcaaatgtttctgccttccagaaccagaatattctctgtctccttgtgcctttgctgtcataactgaagctgtcaaccagttctttccttaggtagatgcacataaaaatttcccaaaataggcatgccatttattctgctttgtgctcagtcttcctctgagttcagctccttagtccacaaaaccactccccatgtgacagggtctccacatttaccacatttatgccttatagacttctcagcccacaggcttcactctgtaccctgctgtattcaccagcatgtatttgacatctgaaccaaggctggaatttatcttgctctatacagtctactttctgggactgcccattgtaaaccgctggcatttaagtgtcctgaatttgctggccttgcactataaaacaatataaccctggcttagctccaatttttgcatctctgttttccttgttgttcccaatgtgataatatttttcaataaaatttgctttgagcaagttttgtatcagtgatagcagtaacagtttgaatcttaaggagattttggaaatctgtctaaaatatgccactgacttgacagtgaaaataaatgaaagatactttaaatgcgtgaaagaaattctagttgtctatcagcttctctcaatctcaactctttaaaaatcatctttcagcacaatgtggataaattttaaggtagaaaactttaaggataaagattaatactatttcaaagtatttttctggttctgctttctgtttgcatctttcaatacttatttcacatttaagcttctagttttccattctctttttattttttcactgtgatgcctttctttcttttttccacatgagtgtgttacagatttttctaaccacattagtgcacaactaacttactaaaatcttcatgttaaaaagaaaagaacaagtttcttagaaatgcaggcctttctgtagaagagtgaggataaattaatgagtgactcaattctaattttcagtgaatgggataatcaacacctcttattaactggtctaacagttcatgcagacccacacgagatcagatagatcatcatcactacaaatcattgtgttcctatgatcaaactaaatagtgcttcctaggatcaaactaaattaggcaacaaacttcgcagtgaattacatgtacaaatgggagtgacaatgaaacccacccccatttccaaaatattttcttgatgactagtagtcatgtggattgctcagcatgtattgataatccagttctctatcaacatctggcagatcatgtgttttaaaaatgtttttctttttgggttttcttttgtcttggggaactgtagttataagtcttgccattgtgacctcctagaaagtgtgggtgggttatcactaatatcttctaacacatttaaatacaaccatgcatcacttaaggacagggatacattctgagaaatgtgtcattaggggatcttgctgttgtgccaatatcagtgtatttaccacatacttgggagttataaactatgacacacctacactacatgggatagcctattggtcttaggctacatgcctccacagcacattactatattaaaacttgcaggcaattgtaacagcacagtatttatatctccaaacatatctaaacatggaaaaggtacagtaaaagtatggcataaaagataaaaaatggtacacctatatagagcacttatgatgaatggagcttgcaggactataatttcagtatagaagttgctgtgcacgagtcagtgagtgagtggtaagtgaatatgaaggcctaggacattactatacactactgtagacttttaaatgctggacacaggctacacaaatttatttttaaaatttctttaataaaaaccttatcttactgtaatttttcacttaaacttttaatgatttgctgttttttaactcttttgtaatagcttttagcttaaaacacaaacatttacaactgtacaaaaatattttctttcatatatccttgttctataagcttttttctattttattttttgaattttaacttttttgctttttaaaatagtttgttggaaactaatacccaaagacacatgctagcctaggcctgcacagggtcagaatcatcaatatcactgtcttccacctcctcttgtcccactggaaagtcttcaggggcattaacagccatggaactctcatctcccatggtaatgatgccttcttctgaatacctctggaaggatgtgcctgaagctcttcttgaggaggagtcacatttttagaaatatgtccatgatggtttgcttctttttttcattatagacttgtttataaacaggtaaagcatcataagcattcctctgtattaatgaaaacctttagatgttgggatctatggtttcaaaccttttgtttgcttgtttgtttagagataggatctctctaggctgcccagacgggactcaaagtcgctgggattacaggtgcatgccacaacacccagctcaaacattctaaggagcatcttgaggtctgcagaatcttctgctaaacccttcattgtgaattttttttgggggaggtcactgggcaatagaaatttttcagttcctttataatcttacgggaccacttaacatgaacctaggagttataagctattacacatctaggctacatgagatagtctattgttcttaggctacacacctgtacagcacattactatactaaaacttgaaggtaattgcaacactatagtaagtatttgtatctccaaacatatttcagcatagaaaaatacagtaaaagtgtagtaaaaatatgatacaaaagattaaaaatggcacacctatatagagcactcatgctgagcagagtttgcaggactagaagtggcaatggatgagtcagtgagtgaacatctctatgtagcacctgtctgtgatactttcttgttttcttatttacccccaaatgtgcttcctgccctatgtttccagtgtctttccaattatatttgtatagaaaatcacctcaggactatggattttgtaagccagggaagggcttgctacattttattgtcccctcattgagttcacttctcattctgaccaatgctggatgtcacagtcttgactaattagacccttgactgagaatgaagataaccagtatatcttccagtgcggtaccaaagaaggggacagtagcagtaaacatatacacaaaacaaaacagtgaaattatgttcaataaactaacgctgtagctttgacctggaaaatgaattttttgaggagtaagtcttctaatgagggaagggagaagtattggacacttcaaagaatacttctttaatatctaaagttgattttcctctcatccacttgtaacatgcttcattataaagatagtcttttttttttactaaaaatatataggaatgatttagcactctaattttcttcagatgagcaaactaaatccctttaaaattattccaccaagatcacatagatattaagtagtcactgtaaggctagaatttagtattctctttccctggttatttttactatatggaagctacttatgtttattaggattttaggttagagtcttatgtatagcaggtgataatttatatcaggtgctatgctttgttatatatggtgagttttatgggaagtatactttactctgggtgttaaataaggcttcacaaagacacataagattgatataaatttaaaatgtgaaagcaaaacatgaatgggccatataactatcactgaaatctactgaagatctcatcttccttagtaaacacagacaactgaattgccaatagatgattgccctgtgggaagagaaaggatggaaaatgaaactcatggcctcttcctttctttagccctatcaggacatagcagaacttaaaaaaaagaaagaaattcttattttgtttgttttatatttatttttaaggctaaataatggtctttttttcaaccccagtggtaaagcctagagaaacttctaaccagatttagcgactaaatcatcgacactttagtcaatcttttacctagtcactcaaccaatatttatgaagaaactatcaagtgccaagcatttttccaggagcggaaaataaacaagtatgatccctgccttacctgaatttacatcccctctccataactctttttttgatagtgcaaaggtggtgaatctgggaggtaacagttgtggcctatgtgcaggtagtggcagtggtggccgaaggtgcagagcggggttagagcctgcaagctgatctagggaactgctggtcattgcaatcaggcttttgcctttacaattggactttgtccctgaagcttgtgttggggaaaatcacttcagggtgtgtgtatgtgtgtgtgtgtgtaataacttttagatcctcagttgtgaagtgactagtgaggaaacgagaaattcacagaattgtaagacatattggattttgattatgcataaatattaagcatgtgacatctttttttattagattgaatacaaacacttttttttctgtaagaggacttgcaagttatatgctattatatgtttaagaagatgcagccattttaagagtttttgtaggtctaaataaactcaactgtctctggatacaattcctttggtaagagagatttggagaatctctcataggcatttgaatactggtctacccaaggatagccttctctctaaaggttcacaggactcagaaaaacagtttacctattagattactggcttaacataaaagggtgcaactcagaaaagccagatggcagagatacacgcctcaggcatggaggaaggggtttggagcttcatgccctgcccatatgcaccaatccctgaggccctccctatgacaccaacctggaagctctcagaatccctttgattagggatttttagggaagttccattacatagacaatagatcatatcatcggccattggtgattaattcagtctccagtccctcttgccttcctagaggttggggaattggggttgaaagttccagtcccttaatccatagttcccctggcaagccacacccgctgcttagaggttttctgaaagccactgcaataacataaactcaggtgtggttgaaaggcacttgtcatgaatgatgaaagacactcctttcacctttatcactcttatcacttagcaaattacaagggttttaggcagtctacccaggaacctgggactaagaccaaatacggatttctatgacatcgtaatttcacacacttactgtcatgggctctttttctttctttttctttcatgacggtttatgtatattctgggaataaatagagaaatgggtgagaacaactttagtttatgtgtttttctttaggattctatatcgtatatcttaaaatgcttatatcatagcattttctctgagacataacaccattgcattaattacagcacctctcattattatattggctgtaaaaagggttaatatgaataattcattcatattcaagatcaatacctccatctgctttcctataggccttgaattttcataaaaaatatttaaaaatacattatattcaattatattttactcagcatttttaggtcagcaaactatttcttgttcttttttattgcagtaatcatttaaatcagtttttgacttcttacaaatcacaaaaattaatagtaattatgtgttttggaaaaagctgagtttaaaataatataattttattttttcaaacagaaaaaatcatttaaggctttttgcaaaaccataacaaatgttctttttactactgctactattacaaatgcttccactatccattctcataatttctatttattaagcagttattttgtccttgtgctgagtaccttacatatactacaaatctacttgatttctcaaattttagagttcatgtgagagtcaattaatttccataagtttaattgcttctatatgagtagtcagagaaaaattcgagtggaaaaacaagagatcaaaaagacatctaaaactagatttctagaagttgtattcattgatttttctcttcaatgtctttaatttttgatggtgtcattgtagcttgtgtacaaagagacatggtgagataattactgaaatagacctctaaggcaaaagcaaaccaaatgcagagtgaaaacatggttagatgaatttacttttatgtttgtcatttattaatatagcttttaactccacgtaatatacaaatatgtttatttgaatttgaatatatatacattgactatatgtatttataaactttccctttgaaatttgctagtcaaataataagaaaatttctgatatatctgatctaaagtatttaggaaagaattgtataaaatcaaagattttttttaaatcttgcagaaataaatgtataaatgtttttgttttaattatatctagactatgagcttaggagaatggatacagcaaattgaaattcagttctttggccaatttcctttaaaatttattgtgttcttattacaatagactgattattttatggtatcttcttaattataagtgttgattaagaactcttataaccacaaattacgagtggtaaagacaattgttcttgcttattcattttaaaatgcataaaatattttaaaagcttattagtctgtaattgctaacataaattattttgaaagctttattttgcaaaatgttgcaaaactgcatctagattggattctgggcagctgacataaaagcaattttctaaccatttcctacttttctaaaataaccagttgactgtattttaaacacccaaattaattggcatgcctattattttctaacaaacaatttatcacctgagtatttgaggaatatagaacttttatcatgctatattgaaaatatccagtgaacaagagaatgagaactagagtccatccaaagcatgaaacattgggatctgtgtaataaagtcaacgcacaactataacattgccaagacatgcttgtaggacctctgcatgttagagccagaaaggaacatagctcaatgcttgcagatgactaaatcaatcagtatcaggaactactacatggttgcgcccaagatcacagagtgagtcagcacagaactgcatctttacccaatagcctttttactacgctgtgcagttacgtttaaattggtatttttcaaagtgtagtccttgactatctttatcagaaatcataaccatgtccatgaccatcttaatcagaaattcataacaagcccctttcaaccataaccatgttcatgaaaaattcataatcctgagtttttccctaaatttactgaatcagattgaggtttgggaatgtataatagggatctacattgaaaataagcactatgtaattgattcttccgtactggtttttaaataataatatatgtctatatgattttatatatatattattttgtaataatataggcctatattattttatatatattttatataatatataatatacttactatttgcatatatatgtgaatacatatattttatatataatatagtattatttaagaaccaatatggaagatataatactataataaaatatattatatataatatatataccattatatagtataggcctatattatatatattatagtattttatcttccatattggttcttaaataatactatataatatagtataggtctatactatataatatataatatagtatactataaggacgcaaatagtaaggagtagtaaaatacagatttaaggaatcatctgttttgtctgcatcattggtaagactaacaccatcaaagagatctcaacagcaatagcatggagtcctagaacccaccccagagttgatgataattgttctgatgtgagcataggtgattctaagagaatatttggaaaacattcatttatataatagagtgttgtttcctttaccaagtagatcagcttggtatttaaaattcatagttcatttcttacatgtattctttaaatgttagaaatttgaaactttgattttagtctcttgaccaccaagaagtctaccaaagtctatgacatttcctagttcacaatattagaaagaaaatagtcatataattcattaaattcccacagtaaaattagctaacaccagattaattttatttaattctatgttagaatgctgaattgcagccactaacaaaatatatacattagattttaaccctgcatataaaatttattattttttattttttatgttagtgagagaaatatgtgtttacttacatagtctttcagaatattactatttttgataatgactcagttgaaaatacagcaaaatgtacttactttaacaactgattatactaatgtagaatcatttccaattcttatttgttacattttgctaaagtataaactcattcaatcatgaaactgtatcaggatataatatctagtaattacctgtgattgttaattttttgtgtccacttgaatgtgccactgggtgctcaaatatacttggtcaaccattgtattgtatacacacacacacacacgcacacatgcaccctactggttttgcttctctggaaactcctgagcaacactgcactgattttggtaccaggaagtggactgctgctataactaatacctaaaaatgtggacctggcttggccttggcttgggaactgggcaatagggtagaggttggctgagttttgaggtacagactagaaaaagcccgaatttctacgaagggactattggtagaaacgtggacattaaaggcaattctggtaagggatcgggaggaaaagaggagagctgtagagagggcttcactcttcttagaaaataaataatcatgaataatcaaaatagaatgtttgtggaaatatagacgttaaatattctgagaaggtctcagatggaaatgagaacaggccactgtaagctggaggaaaaatggttcttgttatatagtggcaaatatcttggttgcattttgttccaatgttttgagaaaaatagcacttataagtgatacacttggctatttaccagatacaatttttaagcaaagtgttgaaagtatggcttgggtcctccttaaggcaatacaataggaaaaatatggattaaagaaggatttgttaagcaaaaagacccaggacaaggagatttagaaatttctcagcttatctataatgcaaaaactggagaagtctgttctggagacaacactaagagtgcaactgaatcaccctttgctaaagagataatgggggtgacccatcagcttaatcagccatatcagcagaagccaggaacagcaaatggattacaccatcaaagatccggcccgtttgaactgaagaggatagggggagcaggacagattaaggaaaagctgtcagacttcttggattctataggaccgtctggtcctatagaatccatagagctgttaaccaaatggttggggttgtcctacaccctccttaacaggatatggaaacaaagaggttcttcttcagacttcagatttaatgaaattgcccttgctaggttttctgctttcatgggaatcatcacttccttttttaatttagatttttccattttgaaaagaaaatatctatcctatgcctctcccattattgtattttggagacacataacttgtccgtttcacaggctcagcgctggaggggaattttggctcatgatgaattgtacctcaagtctcattcatatcttagttagatgattttagtatgagactttggcctttaacctttagagttaatgctggaataagttaagaatttgggggctactggaatgggatgaatgtattttgcatgtgataagaacatggatttgggggaaccaagggaagaattctatgagctgaactgtgatgtccttccaaaatgcatatattgaagccctaacccctaatgtgactgtatttcatggtagggactttgggaggtatcaaagtgaaatgatgccataagaatagcatcttcatttcataatattggtgtcctttaagaaaagaaaaagaggctgggcacggtggctaacgcctgtaatcccagcaacttgggaggccaaggcaggtggatcacatgaggttgagagttcgagacgagcctgaccaacatggggaaaccccatctctactgaaaatacaaaattagccaggggtggtagtgcatgcctgtaatcccagctacttgggaggctgaggcaggaaaatcgcttgaacccaggaggcagaggttgcagtgagctaagattgcatcattgcaccccagcctgggcaacaagagcaaaactccgtcccaaaaagaaaaaaaaaaaagaaaagaaacagaaaccagagctagctcattatctaccaagtgaggacacagccagaaggttgctgtctgcaagccaggaagagagaccacaccagaaaccaaagcccactggaacttgatcttggacttccagcctccagaactgtgagtgatacatttttgttgttttcttcacccagtttatggtatttattatggcagcccaaactgactcgatgccaagtgtcattctagggaaagagacttttaagaatgaattttctgagttggttctgaagtatctggaattggctctttaatctgattgggtttaaagatgccaatgactctatttctaatattccatggtgtctatattccatggtgtgatctggccatagagatatgcagaatatcaccattggacactcctaatcaaccatttataagaagcaaggatctgagtactatgtatatacatttgagcatttttggcaaactaatgaatataatgagattggctggcagctcctaactcactgcacaaagtgagaaaataaaaggatgagttcaggaattcaaattccaagctcaagggctacataaatgacatgaaagattctgggcgtgctatgaaggagctcttttttcctgtagccataaggctgagattgttaaaaatcaggtgcagaataccactctgcgactggctgaatcaaaatgcaacttgaactcccagcctgttgaactatctgctacagtgagggcattgattggtaaggaatgggatcttgaaagtcagaatgggaacgaccctgtgggaagaccctgatgagtatgggcacaatgagccagtaaattggaatgactcatttttgccagtagaggaggcttctccattttcagtggagagtaggagcagcgctccattttcagggcttcagtgggagcagcctccccacctgcaatgatagtagtctcctcgccctttcacccctgtctgaaggacttaaccttacattgcctgaaaaacctataatggcctccccaaaggcagttactaggcaaggtaatgccatttctctccagagccatccccacctccgctcctttcttccagacctataactagacccaagtcccagaagtcccctgaaggtgaagtacaaagtatgacccatgaggaggtgcactacactccacaagcacttgaattttctaatttatacaagcagaattccgaggaatatatatgtgaatggatactaagagtatggattaagaatgaaaggaaaataaaagttggatcaggccgaatttattgctatgatctccctaagctgagattctattagggaggattttaataatttgtttaataggataataattttttgataggataattgaaacatgaacttaaatgtggcctaatgtgaccaagttagaaatgctagactggcctttggaggcttctataggtgaaccacagcatgggtctttatgattttggagaaaagcccagccattcactcaagataactattttcttttgagaatcagctattggcctactactggatctcagaaaagactgaatgcttaaccattggtcaccacgttattatgtggcgtgagctgcccatcattaactggatgttatctgactcactaagccataaagtcgggtgtgcacagcagtactccatcatccaataaataagtcatcaggcctcagcaagccctgaaggcaaaaataagtcacatgaactagtggcccaaattcccatggaccccattccagctaccatggcttctccctcccagcatattcatatggctcctgccaagttcactgtgatcagttggcagggaaagagaagtctctaacctggtgtgcagatgattctgatgttgttgggtgaagtgttcagtatatgtttattaagtcacattggtgtagagtgttgttcagcccctttgttttcttattgattctctgtctcactgacctaccactactaaaaaggcaattttttaggtcttttactattattgtgttaatatctatttctaacataaattctgtcaaggttttattcatatatttgagtgctctaatgttagctgcctatatatttataattattacatcacatcttcctggtgaattgacccttttatcgttacatcatgtcctacttcgtgtcttctgaccatttttaacttaaaatcaattttgtgtaagtatagctacccctgctccctttggctaccatttgtctagagtatcttttcctatttttttactgtcaggcttatatcaaaaaataaatctcctgtagacggcatgtagttggatcttgttttttaatccattcagccactctgtcttttgattagggagtttaatccacttacatttacagtaattactaataggaaagaacttaccattgccatttcgttattgtttttgtgtgtcttatagttatttcattactttttatttctcaactcttttcatttttcatccttttttatttttcatttatagttatcttatcccatgtcaacttttcctctctagctgctttcatttgtgtttcattgatctttctctgtgtgtgtgtgtgtgtggtggcatgctttgattcctttgccattttattttatgcatcttctatagttattttttttcgggttaccatggatctaacataaaatatcttatataatatattttaaattgataacaacttaacttcaattacttacaaaacctactcctttacatctcttcctgtttcttgtccccatgtacataccatatattgttacgctagtgtctctgtggtagaagaagttctggtatttcctattctgccatcttcctgatactttgcatctttctttatttaaaatgggcaaatatgcattttaattattacttcctattatgtataagtcacatactcaagagatggtcataatttaactttatataattttattaaatgtctgctgtgtgtcaagctcattgagaagctctggggattccaagaaatgaaagatacagctctgacattatgtaacaggatgggatgacaaataggaagaaaaaatcattaaaatccagtgtaaggatttcaataatgaaactcagtacgcagtgcagtctgaatagttgtttgtctctgtggagtcagatagtatatcccaagaaactgcatgccgggttgaattttaggaagtagactggatttcgtatacaaaaaataacctcaccattttgaactgaagagtttccaagagacagttggtaaacaaaacacctgctttagaagttatctgtgttatactgaaaaatattttctgtgtctctccatctgtccaagcagtataactatatttaaacatttagctattctgcatgtatataactgcattttacccactgactaaagaaattatctacagagaacagagggaggcaaaaatcaccaatgtaagtaaaaatttttccatgtgttaattacaaatcattccaatgtagcacttggtaaattctgttttgtaaagttttaatttttgtttatttgcttcataaagataaacaaattgtaattctttttggttagtgattattaaactcccagatcctcttatttaaggaatgcaaatatgttttcacgaaatacagaagttaatttaatgttatgagctcaaatatggtaggtcactgtttaaattgttgagtaaatctcacttgttaagtctagtgatcaggattttttcaaacagctctccatattaatttttcaagtgtgacaagagaattctaaattaattcttggtgatgtgtaagattgtataatgttaccatgtgattaaatggatatacatacctttgtaaaagtttattaagtagtaaaaaatgtacaatatgtgcctcagtttcctcaacctcacaatagataactatttttcaggattgttctgatgacagggaaacagtagatgggaaactcatttaagaagtgcagagtttaatctcacatgacagcttatacttttcattatggttaaatgtatattggaagatatatttgaagatatcaatatacttgcagctaaatattattttttctctaaagtgagatgttcttaattccatatctgttcatggtgacaataactgtgaagtcacctgggctatgttaaggctgactccacacctgttcgcatgccttagcattgtttgatcaccaggcccttttgtccaaggctcccaccaacacctttactccactgtgaatcctcgttcctgggccattacaggaatcatctcactcctcttacagattctagtcctgggatctctgatgtagcctacacaatttttttttatggatttaaatttatcttccccaaaattcatatgttgaagctatgtattagtgttgaaatgcttagcttgttagaagacctattttgatggtgaaggaccctgaacaaaacacatagccaatggcattctgccacaattttcactgtcttttaggtgtttgtgacctctctgtttgctgttaaaatcttaaattccctttaggcaaatcttcctggtgaattgacccttttagccttgctaatagtgtgatcaattgtagtttccttaatatgtaaacatccaattagttaaaatatcaaggttgctatttttggagtcctggaagaaagagcataataactaagtaaattctgtttaataaaactatataggcactttcgaatttagtcaatatcattcctgttactattttgtgaggtccagagactaatctcccttgcaggttgtaatgcatggtacatttttatatgggcagctcaactgttgtaaggcgcacaaaagatcttcattttctgtcctttctgttttcagcctcttcccagaccaggtacccagttcatagggacaattgggactgtagtaattagttagcttggtggtctttaaactttgctccgcagagctccaggcttcaagaagagtggcctaattttcactggaaaataaagtgaacttaagaaacctcagccttttttcatgcccaaatcaatgtgaactgctcagcatttatgtgtttttcatatttggcttctacacagcatttagatgaaacaaggcatctcatagctaaataaataaataaaattccctaggcaatttgatccttttttttagatcaaattggaagttggaaaactgttttaagttggaaacttgttttcacataaataaaaatgttttcatcgtgaagaaagaaagtcacaaactcactacctcaggcactgggaagtaaaattaaaaagtgaaggtgtaatgtgtcctggataaggaagaacttgctatccattaattgcagagtgaatgtctgccagagtaacatttaaacaacatgtgtctgcaggctagatttggtccttggtttgctgttggggatctctcctgtagaagattcttgaacatgcagggcaaaatagtgtgtttttaaacaacatcatttctgaaactctatgcatgctccttataaaatgagatgtttgcattactgacttttgtggacatagagccttgaatctatactctaatgtcatcagatggccttcaggcacatggttgggcacattagattctggtggatctggctggtgtgctggggcaatgggacatgcacaggaggacctgggggacaagctccagaactctacagagagccaagagtttgtacatggaacagatacgacttacagaggagccaagcagaagagacagtgattcagaagggctaaggtaaagaatcaagggcatggcagctgtgggaggggtgctgagcaattgtgagcatgagtgtgaatgaggtgagagtagatactccaggcagagggaaatgtttaggctgaatcacttaaaaaacatgtagtgtcaactttacaatcctagcctgtgcttgtttggggatattattcccatgtaaaaggagtcaggataagataagtcacaaaatcctctgataatacgatgaacatttggaattttatattactatgtggggaaaaatagtaaccctataggtccttggttggaattgacccccataacaaaagacagattaacaagagaaaaacaaacagaagtttattacatgtatgttttatatatgcatgggaggcacccagggaaggagtagctctgcaaggggagactttgagctccaggttatatagcaactttacgaagaacagtacatttttagagaagtgacaagaaaaaggaaaaggactttgaatctctatagatggcaattcaggggaaaggcaaataaatggtgaaggccggttagtaaaggtgttatctccaggctgaaagtctaaagatatttccagtgggtaaactttgttctcactggtagaaggagaaggcagggtatcttttgtctttgtaaatttacatcctacttttaggcaaatagagggagaaaaaagagctttcctgcgtctgctgcaccataattgtcttcagctcaacaaaccttcctatttgggggcaacatattctgatttccaacaactgtaactatacagattatacacatcctccacttcatatttataacaaaattggcaattactaaaacttgaaccagactcttgctattcagatttgaggtttacatgtcccagaatgggtaaaatattttcatatcatcttactgaggttttctttgcagcagtagtatttttcacttgcataatgataataattttgtgaaaaaaaatattacatctgcctattacctcatccttgaggaaaagtcagtgatgtatcattggataggaaaagggtattgagactcagatcgtttaagcaaatgattcagcaagtaagtaacccagccaatggtgaagcctcctgacttgcagcctgacacttaccatactgtgtcgtccactttcagagtcttcatcaaattgtatatattttttgcctgcttccatgaatcccaggacttcattttaatctatttcagaagtagattaaatatataatattatatatttaatattaataaattatatatatatatatatatatatatatagagagagagagagagagagagagagagaatagtgcttccccaagggtttgaaaacaatattaccttgccctgaagctctcctcatcttcaccttcttttgtcagttacacactttgatcagttgtcttgtgctctttacatgctgcatttagaacttcttttatcctcaagcctgaaagctaaaacttctggaaggtcaaaaggaagcagtgaaggattcaacctggcctgagtgttcccagactccggctcctgcctgggcatcatgagcccaggctcacaatgggtcggctttctgagtcagcttcataaaataataagcacatagaaaggaggctgctcttggggaattcgggaggtgtgtatttgaggagggtgagaaggacaattgaggtgaaattttgatgtaagtgagtttggctgaatttttgaaatggtaaaatctaggcactcaaaagcctgcaccttcataaattaaactttaggaaaggaagaaaaaaaatggaatgtgtagggacatgaatatttatacccatttatatatcctttgttggcttatttctgtgcacatgggaaagtttaacaacttcgtacataatttcaagttctttattcattttttagatttgaaggaggagaacaattttgcaaaatagggtattcttcagttttttggaaaacgttttatgtttcttaaaacatctcatttgttttttttctaattcactcttcactgtgtttgcagtacttttctggaaatgtattcatgaattttcagaattttttctcctctaagtgaagaatcaatggttgaaaagactttttttatagcatattatcaaatttgcataattaaaaataaatatacacacaaaaatgtcaaaaatctagctaaattgattggttaaaagcaattttatcatataaagcaaaatcacctaaagaattgacataattgcctaatattaatttaagaattataaaatcaacttagacatttgaagcccacataaaatatcaaaatgtccatgagactgcagttattttgatttttaaaaaaattgattttggaatgttcctcaggggtgaacagaaaatttcaaaacttcatgacaactttgtgaaaaagcagagtaggtataactggtcaaaactgagttaatatcaataataatgctatgggatgcttgaggtgtcgcttttccggatggaaacctctgtggctggtggcacctttgcccgagttttgctcaggtccactgggctcgttccgcccactcggcctggcaggctgtgcttggctcatgctaccagcctggatctcatgcctgccagggcaagtcatgcatgaagtggcaaggggtgtgtgagtgagcacggggttcggccactgcacgatcagacacaccaactgctgcagtggggagggtggctccaggtgctggcatgagcaacagctctctgtgaggctgtgtcttgtccaggtgcacttcaagcagctcccacaggtggcattgcagaacacagtggcacccagaagtttggagatgccaggaaccacagggccccaaagatggtgtcacagccctggctcagggagttcacagatctgggaatactgaagggccacagctcttccctccttctcttcgcctgcaacatgatgagcaaggggcatgtttcagccctgctggtgttacagctgttttagccctgccagttgatagatcctgagttcttgtgctgtgaccaggaaaaatgaggtgtgcagacaagtggagggtgagcaagacaaagaggagctttattgatagataggacagctcagaggaaagccacagcaggtagctcctttcttcaggcaggatatcccaatgagtgttcagctcttagcagagaaggtagctcctctctgctaggcaaatcatcctgatgagtgctcagctctcagcagagagggtagctcctctctgcagacaggttgtcccaagaagtgttcagttctcagcagagagggtagctcctctctgcagctggtcatcctggcacctgctcagctttggctgatcctagggcttttacgggcctcagaggggagaaagggcatgtgattagtccatgggagccataggtaggcccagaaaaggcaccacaagctcccactctggtcagcaggactgacagcctgtcccccagccttcaggccctccctgccctgaaggtggagccttaccagggtcttgccccctttcacccaggaacctgtctgcattctgcagctgttcatggagcccaggctgtaggtaccaaggggcacctgcaggctagtgaagaactgccctcaaccccacctcagcttcccttctgtgctagttggtgccccaagtctggaggcagctgaagtggcaaagggctggtgtggcagcattgccttgagcatgtgaacagctgggtgggcttcgacggcatctgggcttggccccgactttgctccgagatcagagtaagtgctcacagcagggagtagccaggcagcaggagtaggcacttcctagcctatgaaagcagggggggccttcatgggcccccagagatgccttggtttacagccacagccatggcttcacagctgcagttgggcagctgcagttgtgccgatggggggtcaggggcagggctccctcctgctccagggcccaggagcacagggatgtctggatccacagctatgcattgggtgactgcagcagcatgtggggagctcccaccccaactttgaaggggcagagctcccactttttcctggctcccaccactccatggagcatgcagccatggctgcacctctcttctgcagctgacctgatggcaactgccgctccagacagcctgctgctgccaacagtaataataataaatgttaaaagtgcataaaacatctcagtaatcccaaggactacagaaactctcttaaaaggactctttcacacaggtgaaagttacaaggtgcaagagcaacttcggaaaatgcctggcggccatccctgttctccagcatgtgttagctggtcacagggctgcccccttaaacaccacatttcccagtcccagcatggctagatgtgatcttgtaatgagagaatggaatgtgaatgggcttgatgtgtccagctcccattttctgcctggcaggagcttggacatgagggcagcaatgaactcttgtcagagcacacatgctgaggatggcagagaaattggagggatggagagtgggtcccacagattttgaaatcacctcgggacgtttacgtttggactcttacaagagaagcaaactgctctctgagttatgccactattatattgattttttaaaagaaaccagtatcctaactaacataaaaaggttaaagatgcttaaatagttgactccaaggtacatattgttaaatgaacaaaaaattcacacaaaatgaaactcaagtgactgtaaccattgttttaaatcctattgttgtaactgagtttggagagaggaccaattaatatttttccaacagtcaaggcataacctgaagatgtgaatgtgtgtggagagggtacacactgggtttcagtttgggacacacaaagagataggagataaattttgcatatttcattattttgcctagagcaaactctataaatagataacatttttctcttcagtaaactgaactgtcagagtaagcagaacattatagagactttttaacactcatcaagtaaagcattatggaaattatcaaaatcatttaaatccaaaatatttttgcaccaatacttcctattctgttttacataactacttagctctccatgggtgcagctggagaggtgcatatctttatcagtctcctgggcaatggagcatttgaagggaagcagtcttatgttttatattcagcatgcataaatttggctgtgtttgtctcattttattttccaggttttggttgcaaagatgaagtttaatcaacagctattgttgctgttcttatcataattgatgataataattctttttaatttctgagtgttagatttaatcataataggcaagatctctagacagaggccacatctgatgatgtgacagtcaggaaatgttcagcttcactttcacttttcttggtcaggaaccaggctgttaccattgtttgttaggtcagtgacgtaataatagtctagacaggcttccttaggctagagctttccatgctttgtggcttatcactgagctgtccatggagattctacatggatcaaagatgaggtaggggacattcatatattgtcattttttaaacattaaagatgatttcatcacattatatgcattgcagttctcatctccatattttaggtaataaagtttactgatgaaattttaaaaattattttcataggggctttttttttgcccctagaaaaacttatgctagataatgattaaccaataaacttatttttcttttatccatggatacagaaaagaagacatttataaactatgtaattgttcctgcatcatattttagtacaaatcaattacttttaaaaaatcatatacagaaagcattaaaaatttcatatctgaataagaaaaaaagtaatatgggaagatgaatgtgtctccagagaaaaataagttttgttgttggaaaaaaaatctaaagtttacattttaaataacagaattagttaacctattgtattagtcagggttctctagagggacagaactaataggatatgtgtgtgtgtgtgtgtgtgtgtgtgtgtgtgtgtatatatatatatatctcctattagttatatatatatatcctattagttatatatatatatatatatcctattagttatatatatataggatatatatatcctattagttatatatatatataggatatatatatcctattagttatatatatataggatatatatatcctattagttatatatataggatatatatatatatcctattagttctgtagctatatatataacatatatatatattatatatatatatatatgaaggggagtttattaagtattaactcacacaatcataacgtcccacaataggctgtctgcaaactgaggattaaagaaaccagtctgagtcccaaaaactgaagaacctggagtctgatgtctgagggcaggaagcatccagcacaggagaaagatgtaagctgggaggctaggccggcctcgtcttttcacatttctctgcctcctttttatattctagccatgctggcagctgatcagatggtgcccacccagattaagggtggttctgactttcccagcccagtgattcaaatgttaatcttggcaaaatcctcacagatgcacccaggatcaatactttgtatccctcaatccaataaagttgatactgagtattaaccatcatatctatgttactaataaaccagctacaaatgaagtgttttccttatagtttttatagtataacatagaaatatctagtatatattatattctggaacttatcatgttattaaatggctggcacttgttagttgtgtttaaaggattttcaggaatatctagaaatatgcgctactagagttatttggatacaagagacgaaatccaaatatgactagctcaaactataaaataattttttggaaaaatatggactgtttcaccaaagtgaagaagcaactgaccaactaggctttggaaagagcaggaagtagggtagctcacggaatccagataatgggactgattgacagtatttttttctagataatatcatcaaaataaactactttcaatatttcaatttttttaaaaaagaaatatgctcttttagtcaattattatcacaaaatattacacaataaaacaataaaatctcagtggcatacacaactgtatcagtcaggattctccggaccagctgaagcagtagaatatctatgtatgtgtacacatattttaagagacccatttaaagaaattggctcatgcaattgtgtgggctggcaagtccaaattctgtagggtaggctggcagaatggaaactcttgggcaggagttggtgctgcctactcgaaacagaatttctttatcagagaaacctcaatgtttgcttttagggcctttcagtgattgcatgaggaccacccacattattgggaataatctcctgtacttaaagccaactgatttcagatgttaaccacattaaaatacctccacagcaacacttagattaatgcgcaattaaataattgggcaccataacctattcaagttgacacataaaagtaaccatcacagctcaccctttgtcaacgtaacattcatatatatccccttaaacctactttagctccaaataaaaaccatcacaaagtcatccttctaacgaatatgatacaacagtcctttgtataatcaaaaacacactaattatttccctagaaggggatacaaaggccttgagtaatctccttgatatgctgtaatttaaatgctgtgatgtaaaattaactattattaataaatcttatgttagatgataagggaataaagaagggaagaaaacaaagataattgacatatattatacatatgtgtatacacacatatatatgtttgtaagtgtacatgcacatacagtcaagtttataacaaaatgagaaagaaataacaattacagtcctcatttttgcagctgatcatgtggtggtagttggtagtaataaccgcctttttccactacccattccttattccttgtgtcctcagcaaacacctcagctggtcatagttcttcacctggtaaggtaacccaaatcttcattcctgaagtgtctgggccattaatagtccctgcctgaacggggttattgcagttttccattggcatgaatcacaagcatggtaagacacacctaaggaacctcctgtgcatactcttcctgacctccaagctggagcagcccaatttccctctggaagtcagtatcaatcaccccagtcagaggagtaactcatttctttgcatgttgattcagaggcaatggagtccaaagtggctgggagtatctcaacttccaattcaatgaaatcattgttggatctcctaatagaaacattcttcactgtggaatgaagacctctaaaccagaagagaataaggtcgcaggtacaggaaacaaaagttttgctagtaagtagagagtaatactgagaggcactaccctcatttcctaaactcatgaattctggtaatgggagagacagcaccatatattgaacatatacagcttcctggagaactttgactcagccctgcaagaaaatgccacctggctgatgccataactgttttcaaaaggccattgcactgctctatcaagccaacttcaagatggtgggaaaatggtaagaccagcccagtgaaatttatgagcatggactcactgcttcacttcattttctgtgaggtgagtgccttgatcagaagaaatggtgtatggaatatgatgacagttaataaggcattctgtaaatccacaaatggcaattttagcaagaacgctgtgtataggaaaggcaaattcatatccaaaataaatgtctatttcaataagcacaacatgctgacctttccatgatgtaagtgtggcccaatacaataaacctgccatcaggtacctggcttatcactctggggaattatgccatactgggctcagtgttggtctatgctgctgacaaattgggcactcagcagtggctgtaaccatgttggccttggtgagtggaagtccatgttgcacctgcatattgtgcagaaccatctctaacccaagtcaacttttctcttcctccagtgaattgtggttaggaaactccccatgagaccataggtgtgggctaagagaaagaaggtaatggagcaagagtggaaaccatagataattgaagttctttctcttgtaaactatttgtgccttagggtctgcttgagcccgatcacttccatttgatgatgtgtacccctaattttatggcttggtctattggatgatacccagttcatgatgaacatctcaggtgacttggtgtcccatggttaatcattctgtatctactaatagccaatagcagaaaaagagctgtctcttaaaagggagttgttatccagagaagaaagcagggattagctcccaaattctgaggacttgtcctgtgattcacctacagggacatgccaaaggctctaaacagcatccctgtctgccactgccacttcacatgacagatattctgcgtcatatgttccaagtggtagagcggcttgcacagtagcctggacctgacgcagaatcttctcctgttctggaccccacttgaaatcagcagctttttgagtcacttctctaaagaggccatagtagtccacccaaatgaggaatatgttgcctccaaaactcaaataggcctcctaggcattgtccctcttttctggtcataagcaaggccaactgcaacaacctattctttaccttagaagggtatctcaactgacatcacaccactggacccccagaaactttgctgaggtagaaggtccttgaatttttgtcagatttatttcccactttctgacacacaaatgtcttgttaataagcctagaatagttcctaattctcacttactaggtccaattaacttaatgccatcactgtaatgagccactgtggaatcttgtggaaaggggaagtgattcaaaatccttgtgagctattgacatagggctgaagattgatacatctctgaggtaggacagtgagggtatattgctgtcctggccagctgaaagcaaactgcttctgatgggccttatggacaggaatggagaaaaagggatttggcaggtcaatagctgcatgccaggtaccaagggatatgttcatttgctcaagcaataaaaccacatctgctacagagcttcaattagagtcaccacctggctaagcttgtggtaatccattgtcagtctccaaaatccatctgtcttctgcataggccaagtaggtcagttgaattgggatatagtgggaatcacttctcctgaaacttttgagtcctcgatgatagtaataaagtctacaatatctcgaggaaagtggtattgttcttggtttgctattttacttgcaaaggtaagttaaaggtagttctaatggcatccatttggcctttcccatagcaacagctctcactccacatgtcagaaaaccaatgtggtgattctgctagttactgagcaagtcaattctaattacacactcagaaccaggggaaaaacatacaatgtgttcacagactaccttggccttaccctgagatggacttgagctaaaactccgctggttacttccacagcccctcttctgattggtggaccacagtggtgttttgtgtctccaggaattagtgtcatttcagaaccagtgtctggtagttgctgaaagatatggttttttcccttctttaattcatatttagttcacatttatttgccctggtaaaagattctgcaattctttgggggaggctgggagcaagattaacaacatacacctgtggtagggtatcagcgtccttctttatgtggcccgacttcctttctttattagttcatttgtattgctataaaggaatacctcaagcaggctaatttataaagaaaaggggcttactttgactcatggttctgcaggctgtgcaagaagcatgacaccagagtctacatatgctgaggtcccaggaagcttttagtcacagcagatggaaggggagccagcatgtcatgtggtaagagaggaagcaagagagaaagaagggaggttccagactcttttaaacagccaggtctggcatgaacttattactacagggaggacaccaaggcattcatgagtgatctgcctccataacacaaacactctccaccgggcccaccttccacactagggatcccatttcaacatgagatttggagtggacgaacattcaaaccttcatgcaaggggctctggttctacaaaccatttcaattctgggaactgagtgagagtctatgactctattctggtgattcatactagaattttcactcaacctagaattcatttgcttgtactgatcaaataaaaatttagtaggcttcctgtctattttgcttctagggacacatgatcaacttgccaacaccataggcctctccgagttaagctactctgattactgccttggccctgatttccattctcataaccatggcctctttgtctttgccacttgggccctgtcatcccaggatccaattactgccattgcatgtaaggattccagttcagtggcaatagttcctatggtaatttctgccctacagagaagagtgcccgaagagctctttaacagagccaccacacaaatttcttcctcagagtcaagtcgaaaggtgcattctctgggccctcccagggtcagtgaggggctcttgtatgataaatccactctaacattccagtactcttaagtcatctgttaacttcctctgcagtgtaccaaggcgatcctggcattttaatgtaatttattataagtcatttttttttggtccatgtttaaacccaagtcaactaaacaaactgtcagaatcctttctaacaccccaaatttacatccagaatttatgcttagtggggcaatatcaatcaatttgacctagtccaaatttatgtgccttccaacattatccaaaatcatgagtatccattccacacgtatttcccagaagtctgtctgtataaattgaaaaaatatgcaatgattttgaagtggaacacacgtttaatgggttaaactttgtatctcaccttttttcacctgttgccacttgagtgtacttatacctataaaagaaaagagggttggtggggttggatcctcaggagaatcagcattgtttttaggacaaccacctcagtgaaggctatcactctaccaccaaagaagactcagcagaacttaggggttcactgagctcagcttcatcacagacttcatatatgtcttccttccaatattcagggtcctgtttttcccaatcaacgtctgtgtttaacagaagaaactttgctaagctggggtttaatttgtaatgtaattcagtgactagcaggatgagactctgggtttagtgttcagaaatctcaggctcatggctataggagataagggtataatctaagacaggcatatgcattttcaggtcatatatgcagggcataggctagtaatttgaaatcctaggctcaccctttttctctctactttctataccatggttaagagcaaacaaccaatcttattgcactcattatttgacagaactgttctaagttatcaaatacttggtcactgagaaccttgccttatcaatacttgagtagtagtattcagtggtgatattgtgtgtatctctattgcctctttgtgccatggactaccagtgttcttgttaatactggaaatagagtctttactgcctttaaatctaattagattacagaatcaattcctgaaaccccaaaaccaagtcaaaaaactcattcttagaattctgtgcctttaaaaccactgttggtacccaaatctatatcagtcatggttctacagaggaatggaatcactgtgtatatgactaacatgaatgggattcagcaagtctaaaatctacatcagcccagcaggctggaaactctcatgcagaagctgatgatgcagtctggaggcagaatttcttctacagaggaaactcatgcttgcttctgaggctgttcaacttatttgatgagacccacccacattattgaaaatagtctccattatttaaagtgagttgattatatatatcatctgcaaagaaacttcacagcaccacctagattagtgtttgattaaatggctgggctctgtagcagctaaagctcaccaccacaaatatcaagcacttatttgacgcaggagtcttcaatgtgattgtggcagctctgtcctgggcagggatgtaagggtggttgggatgaatcttgcattctgtgggtcatataagaagtttggctctgtgtgtgtcactttaaggccaggccaacagggcagcagcttcttggggaaactgttctcgtgcaattgcagaagtgctagagggcacgggaagcatgtgaggcctgtagagaaactagcatatggtcatttctccccacccatagctggagtagacataagtaattttgataataagtgcagtctatatgaatgaacgtaaaataaactatgctgtagtggatacagttgtttcccacaggcctgtgggttagcatttcttatggctatacatgtatactgggattgcacaactgagcacatgaatgattggttattggaaactatgtttctcactgtcagagacttatccagtggaaatacttaatcgattgtatgacatgttcagtttctactaaaaatgaacaatctatttcctttcacagccaacaggccctggtgtgtgacgttccccttcctgtgtccaagtgttctcattgttggcttggttcgaagtctttgctattgtaaataatgccacaataaacatacgtgtgcatgtgtctttatagcagcatgatttataatcctttgggtatatacccagtaatgggatggctgggtcaaatggtatttctagttctagatccctgaggaattgacacactgtcttccacaatggttgaactagtttacagtcccaccaacactgtaaaagtgttcctatttctccacatcctctccagcacctgttgtttcctgactttttaatgatcgccattctaactggttcaagatgatatctcattgtggttttgattttcatttctctgatggccagtgatgatgagcattttttcatgtgccttttggctgcataaatgtcttcttttgagaagcatctgttcatatccttcgcccacttgttgatggggttgtttgtattttcttgtaaatttgtttgagttctttgtaggttctggatattagccctttgtcagatgagtagattgcaaaaattttctcccattctctaggttgtctgttcactctgatggtagtttcttttgctgtgcagaagctctttactttaattagatcccatttgtcaattttggcttttgttgccattgcttttggtgttttagatatgaagtccttgtccatgcctatgtcctgaatggtattgcctaggttttcttctagggtttttatagttttaggtctaacatttaagtctttaatccatcttgaattaatttttgtataaggtataaggaagggatccattttcagctttctacatatagctagccagttttcccaacaccatttattaaatagggaatcgtttccccattttttgtcaaagatcagatagttgtagatgtgtggtattatttctgagggctctgttctgatccattggtctatatctctgttttggtaccagtaccatgctgttttagttactgtaactttgtagtatagtttgaagtcaggtagcttgatgcctccagctttgttcttttggcttaggattgacttggcaatgctggctcttgtttgcttccatatgaacttcaaagtagtttttcccaaattctgtgaagaaattcattggtagcttgatagggatggcattgaatctataaattaccttgggcagaatggccattttcatgatattgattcttcctacccatgaacatggaatgtttttccatttgtttgtgtcctcttttatttcattgagcagtggtttgtagttctccttgaaaaggtcctccacatcccttgtaagttggattcctaggtattttattctctttgaagcaattgtgaatgggaattcactctttatttggctctctgtttgtctgttattggtgtataagaatgcttgtgatttttgcacattgattttgtatcctgaaactttgctaaagttgcttatcagcttcaggagattttgggccaagatgatggggttttctaaatatacaatcatgtcatctgcaaacagggacaatttgacttcctcttttccaaattgagtaccctttatttctttcttctgtctgattgccctggccagaacttccaacactgtgttgaataggagtggtgagagaggacatccctgtcttgtgccagttttcaaagggaatgcttccagtttttgcccattcagtatgatattggctgtggttttgtcatacataactcttattattttgagatatgtcccatcgatacctaatgtattgagagtctttagcgtgaaggactgttgaattttgtcgaaggtctttgctgcatttattgagataatcacgtggcttttgtctttggttctgtttatatgctggattacgtttattgatttgtgtatgttgaaccagccttgcctaccagggatgaagcccacttgatcatggtggataagcttttcgatgtgctgctggattcaatttgccagcattttattgaggatttttgcatcaatgttcatcaggagtattggtctaaaattctctttttttgttgtgtctctgccagactttgttatcaggatgatgctggcctcataaaatgagttagggaggattccctctttttctattgattggaatagtttcagaaggaatggtaccagctcctctttgtacctctggtagaattcggctgtgaatccatctgctcctggatttttttggttggtagactattaattattgcctcaatttcagagcctgttattggtctattcagagactcaacttctttctggtttagtcttgggagtgtgtatgtgttgagtaaaatggcattttacttctgagatcgtccccctccaaaaccccataaccacactataatagttaaaaagaacatcagaataatcccaatggaagaatatcttacaaattccttaccagcatgcttcaacactgctaaggtctttaaaaataagcaaagtctgagaaacagtcacagccaaaagaagcccaagggaaaaaggggactacatgtaatgacgtgccttggaagcaatcctagaactgaaaacagacagtaaggaaaactaggaaaacacagatgaagtttaaactttagatagtactaatgtatcagcaatggttcattaactgtaatcaatgtgacataatcatataagatgctaacagtagagaataatggaagtggagaactgtcagaagaaaaaattacaacaattgtagcaaaatgattggattggctttgattgtgatttatgaatcatggcagcatctcctttaaacatttagacaaggtgttctgatgagctgagccctggaggtgggatttatatgcagaaaggactgaagaaagaataaaagccaaaacatcgattattcattacaaagttactttccttttagggttaaagcagaggggacttatttaatgccagctaaaattggcctctttggctctttggctattattccctctcccaatgttttagaaaagtcaaataatcatcttgctttcagtttggtgatgtgaagctttagcaagagtaacttcattttgatatggtctagtagaacctgaggaactcaatccaaataagttatctcctatatattttatctaactgtatgtagaaattctttgtgcttatatatgaattacttttctgaacaaacaactgatattatcacctaatgttttgatgaaaaagaatagaagattagaattgaaaaaaggaagatgtgctaaaaatggtagaaagtatagatatagcacctgctcaaatgtgccatgttatgaaataattaaaattttaagatgtatgcattaaaattaaatacagcatatgaaacaaatatgaggttatatttagatggttcagtatcctcatgtctatttctctggttgctttttagtagcaagaaattgattccagacatctcttgtttttatataatcaatacatatcaaaattttccttcttttgtagtaaaagaataactttacatcacagttagagacaagaagatatttacaggttcttcaaataaaatgtttaagagcaattttgaaaaataattaagttagtaataaaaatttcattaatattaatgaggctcacaatccacaagatttatctaggggaaatatttaatagattatatgatgcatttggttactactgatgatggctaatctctttctttcaaagtcaatagtaataatctatcagttcagtgacagcatggtgatacctcctactctgttttgccacacttacctgataaagcattaattaatcttgtataattaaaaagaaatgccaaagaaagatataatagtttactcttccaaaggctgagatgagtaattttgaggagtacaaagtcttctattttggaattaatcattcatcttactttgacgtctcatttacttatccattatattttggctctgcattgctttgttttatagtgtctgggtgtcaactttccgtgacatatcttagtttggttaggtgtatcacgtaatgaaaacaaaacactccagaataattttacaaaaacatctatatgtatttaaatctacattcatcatttaggtattatagtgaccatagatgaatctattttagatattttatacattgatttttcttaatattattcactctgacaaatagcttgcttccttacatcatattgtgaataaaattttaagttccagagagaattattcatgcatgtagctttttaattaaaaagagagagattagtcaatcttttttcatgaggtaaccatatgaaaggcaacttttaattgctctttttgaagtttctttctcaattgcaaactcaggtttcacaatgcatgttgggaatgagcgagaagaggttgatctgatgatacatggagtctgaatgcctgctggcggggtggaaaggtgcctggaaatgcacactcaatcacactgaatgatggcaggatatttatacttcctaaaagctggggattaagacttttttcatctgttcattttcctctcttcagtataccctggagctcttgttccttacaagtggttgtaaacacagttttcccacaagttctgcttcacgatttcctccactatattagtgttctctcttacatgccatgctgtgcctaatggcttaccatttctgtgtcttttcagacgacatcctttgtggtgccacagcacatggatttcagaaccgcctgtgaggaggtgagtacagagctttctgcttttcaaacagggaaaacagaatataagcgggaaacacttggctccaatttatatagggaaattctgcttttggcagaaaatggagagaggaggatgggctctttttccttccagattacgttctccttctgcaaagatagaaaacctaactgtgcatggaaagccttggactttaactctttctttaggaagactggagcatattgaatataattgagttgctcctcttcaccaactctgcacatttcaggtagtggaagtgttggaaagaattcttttcacataaatggtaataaattagaagacatctaaggttcctttcagccctaaaattctatgattttatgattctgatagtatttaagtaattcaatattatttaagtattaatacacaagaatttagattctctgtagagctgtcatcacatttcagcacgagttaaagtggcacattagtatttcaaggatgataaacagtgttcaagtttacagttcaatagtgcatggatgtgggcccccagggaatacaaccattccatcttaggaagaaaaactaacttttttttttttttttactaaatatgtaacattcaaagtattgtgttttcattcttcaggcaaaatacaaatacttgcagcttaaaaatgttttatatttgtttaaaaggtttaaagcatttttttattgtatataaacaactcaacaaaaaccaaccataactgcttacctctggtagtgttaaaatcaaactagggaaagacttcagttcttaaccttgtgaagactgttactttagtgaaatgtcatgtgtttacagttcttgcatgaatttgtggaaagtaactccttattttcttctaaagcaattgaaaaaatatatatttaaaaatacttgtcactgttggtaagaagttcagaatataaatataaggtttttcagaaaactaataaattgcttttatatttctattcttatgtttctacttttaatgctttaagcataacattttaaacatatctctatgctaatactcatcaaattacaaggcagtttttttgtttacaaacctttctcatgtgctacactgaatactataaggtcagagtgtgtacattattcatctttttaacttagcacttattggttcatatatttttaaaaactgaattaatgttctagaagctttgtattttaaattttaattgtctaatttctgtttttttttttttttttaatggagtctcactctgtcgcccaggctggagtgcagtggcgcgatctcggctcactgcaagctctgcctcctgggttcatgccattctccagcctcagcctccgaagtagctgggactacaggtgcctgccaccacgccaggctaatttttttattttgtatttttgtattagagacgaggtttcaccgtgttagccaggaagatctcgatctcctgacctcgtgatccacccgactcggcctcccaaagtgctgggattacaggcgtgagccactgtgcccggcccatttctggttttaattgcatacttaattttaaaagtagcaagtcttctatttccattaatgtgcaaccttatgtcttgagtagtaaggcattcattgaaacccagtggatatttgtgtgaatgagatacttatgggacacatgacattcatatggtacagattggacagtggtcaaatactatttaacaaatggtttattttggatttcagaggctggaaagatttacaagagctttttgtaaacaaaattgttttgatgtactaatttgggatatttctcaaattctattaagatacagaagatttatttaattggtaatactgttattaccatactagctcttgtaaattagtaatccttagtactgaaaagagtgacaacctgttactgagataacaatatagaagaggaaattaaatcactcatgtgagatatagctaaatattgctgaagtcactatatgtgatgccaaaagacaatagtgatcaattttggggtaaatatttacttaatggaatccaagtgttcaggaaagtgaggactcatctttgaatagaatgatttcagaaggcttcaaagagaagggagtctggtgccaggactcgaataatggctagaatttagttaaggaaaaggccatgatcaaaagtaatccaggaatgggaacgtaaatgataagatgcagtttgaagcactttgcataaaagaacatttagtacactactgctacaatgcagtacagtataagacaaaacaaattaaatcgtatttggcacttgaaacatggaaatactgtggatacttgcaagaaaatttgcagtccattttattatctctgcctactttttgtagtttgtcatttcttatatctgatattgtgagtatatttcaaaattaatagaccttaaattttaaagtttcatgaaaatacattttgtacattttgaaagactagaatataaattaaaaaggccttaacttttaagtagaaaatggatgatattctacttttataaagatccaacctaggtcctatgtttaagaaactacaaattcttaataagtttaaatgtgagagaagttaaatgtgagatttgtttaaagagtaaacccatgcaaattcataaacattttcttgatttgcagaaagcatagctaattaataatttaaatatgttgccttttaggcaattaggaagtattgcttttcaataattcctttaagcaaatagtctccaatgtggattttgtaaaaagttccatctagaatcgtccatcagtcagagaagaagaatattttacttatatcatttttaaatgaatcatccctttaaaattatgtttggtgtatattttataaagtacaaaatacattcatacagtatctatatcacatgcattcctttatttatgtgcaatggtatgcaaagtcaacgaagtttggagacaaatgatgttacattaataaaaagaaagaagaagattcatgtctttagtttatattaaaatttgagaccaataattatgtaggtgattttcgatatctaaacaatttgggtccacagatctgtaaagactttgcaggtggggctgttttaggtttgcagcaccaacctgcagctgctcccatgattcggtctctcatttttagctcttaaagcacttcaggaaggagtggagatcaaacttcttcctctatcagacagtctcctagtagcgtggctttggggaagatcatcctgtaagttccagagtagtctcttactcgttttttctctctagtggtcattgcttcaatacaagaagaatagctgcttcaagattatgttgttcttttcaaaattatccacaccccattaggagattattgataaccataatgctctccagtgaaagatgccaatagccatgtcattgtatacaggacaactgggggtggcattcttaaataatctgtgtatgcgggatagcagagtgtgtggtgaagagcctagctgcctgtgttgaattctagccttttcttcctctaggtccctctgcacttgtctaatctgtaaaggcagatggttgcgttaatttttgttaagggagaaaaataaattaatacttcttgtcacacagtgagcactatataaataattattattaaacaacaaataaatgaaatatatgaccacatttcatgagtgaggatctcagtccagcaatgctgattctaatcaagacagtgccctgaaatggagtttatccttcttcttgcatctctcagaggagctctgaatctaatgcacctgtttattagttcccaacttccctgctcagtgcctgtttctgtcaacaataagtgtattttaactttcccatttattctccatcttctactctgctacaagaaatacatttagaacacataacagtgaacatattatctccttgctcacatttatgtatggcgtctcccttaccgtccaccatctgcccatcatacagggcgttagcacgcctggtcctctccagacatctctcctgcagcggcccctgctggaccacacaggctcagcggcgagcgcaccttcattttcttgcatcatcacgtggcatgcattttcacacttccatatctttactcatgtgttccctcttgattaaaatgacatttgttcctctaatgattgtttcctcaattaatttttttcaagacaaaccacacatatttcctatcctccataaactcccttccctcatgaatattaaattcccttccccatgttgctcccatatcagatgtcatattgtgttttattacatatgtactttcgaagtaaatacgaggccgagcgcggtggctcacgcctgtaatcccagcactttgggaggccgaggcgggtggatcacctgaggtcaggcgttcgagaccagcctggccaccatggtggtgaaaccccgtctctactaaaaatacaaaaaattagctgggtgtcatggcaggcacctgtaatcccagctacttgggaggtgaggcaggagaatcgctcgaacccaggaggcagagattgtagtgagccaagatcgctccactgcactccagcctggggcaacaagagcgaaactctgtctcaagaaaaaaataaaataacataaggtaaaatagttacgaatactatgaggccagggaatgttatctaattaatgtctgattctctgttaatgctgcacagtatttgcaaaattaataaatgtgtgggattttaaatgtatttccatgtgcaccagctgaattttcatggtagaacatgtgtaatatctgtaacctctggaaatgtattttaactgatctgttttagcacttcgtgtactgttttctccagcagctatttattggaatgtgtgtttgtgagtgtgtgtgtgtgtgtgtgcttctgtgatttattctaaaaaaaatccttctcattctttattttctgcaactcttgtcctttcagaacccaaaagcgagctcaaagactgtattctgttttccagacaactatctaataatttgtgaacattttacatagtatttaagtgaatgatagctttggccatatagaaattaaatgagaacaccctgatagctttgttttagctcctcaaactttccctggatgatctttagtatctctttgatgtgcaccaaaagtatatctctgggctttcagggaaaacccttctaacatcctgaagttcaaacagagcattatttgtgattatcagctattccattacacttctgggtgaaaaaatgtcctggaatatactgtactgaaaaatcaggaaatgtgctcatttatgatcacttggctttgatgtatcatttcatatttccactcctcagagtggcttcccccctcaaaaaggatgcatgtcggcccctctccaatatcctattgtaagcatgagtgactttgtgtaaaaacatagaaaaaatatgttctatattagggaaagtacaatctgcttgtgctgaaagatttttgtcctctagatatattcacttaaagtattctctagattagtcagcctggtttcatgagcacttgtgtgctaatgccatggatgaagaaaacttgctttccttcctcatgaaaaagcttctgtttttcctaaaaaagacatcataccttttacaaaataattctagaataatataagagtgtatatgatagagggcaaaagagtgtgcatcagcacacgagaacaaaagcagtttagagaaagagttatctttggaggctgcagtatataaatatattcccatcaatattacagcggattcttttaaagtagcagactcccagcaatagccatggaaatgtatattccaagagaaagtctggtattatttgcctgggatagcatgctccttaaatctaaggatagatttcacatgtaagtgatataatatgatatttgtctttctatgcctggcaatttttactttgcaaagtatcctccatccttatctatgttgttgcaagttaaataattttattccttttttatggctgaatagtgttccactgtgtataagtaccatattttccttatccattcatgtgttgatgggcatttaggttgatttcatatcttggctgttgtgaatagtgctacaataaacatgggagtgcagatgtccctttgacatactcatttcatttcctttggatatatacctagtaatggaattgctggatcagtttttaattttttaaggaatcttcatactgttttctttaagggatatactaatttacatttccactaacagtgtgtaagggttcacttttctccacatcttcaccagcatttgttattttttgtctttttgttagtcaccattctaacttgggtgaggtggtattacattgtggttttgaattgcattttccttatagtaagtgatgttggagttgagagtagaatagtggttaccacacactggggtgcatggaagggtcagaatcgggagatgttggagaacaggtacaatgttacagtcagatgggaggaataagctctgttactctagtgcacgctaggatgatcacagctaacagtaatgcattatatgtcacaaatagctggaagagagggttttgaatgttctcacaacacatatattattagtgtttaaagtgatgtatatgctaattatcatgatttgataattacacaatatatacatacatcaaaacctcacattgtttgccatgaatacttactatgtgctaaatttttaatttgaaattaattaattaattaactctgaggataaatgtatatccccatatatatattccactatcttaagaatgactcaataattattacaagaaaatgtcatttccaaagtggtcattattcctatggactttttggtgccgaataagagctaaagattatattctatctcaaaggaattaccttttgtgtctgtgacaagtgggaatgttaagtgcactttctagggagaatatttatattaatccaggttaatatatgtattctggataaatgacaagactcatggacttctttggtgattactaagataatagcacaagttcagaaatctttacagtctgttttcacaattacccaaagtatataaagcaaacacattggattaggcatcaaaaatcttgggtcttaaactaggctccaattttaattaactgtgttaatctgggtagtttatttcaccttgttacccttatttccttctaggtataaactgtgtgtgtgtgtgtgtatgtgagtgcgtgttcatgcaagtctgtgcatgtgtgtatgcatgcatgcatgtgtttgttggtgactaggaatgctgacatagtggagtttagagtaggctggggcagtgggaggggaaatggagaaataggagtgtgttccttctttttgaagtaatggaaatgttctaaaattgattacagtgatggttgcacaccattgagtatattaaaaatacatgaattgtacattttaaagggttgaattgtatggaatttgaattatatctcaataaagcaattattttttatttttagattataagtattacaaaaatcctcattattttaaaaatgtagtacatgtaccataatccttactccccacttctttgtgtgaattttgtgacattgttttcattatccgagtgttcactctacttgagatcattctcctttttttcccttgcacccacgttaagtattcaatttcaggctcatcagagtgtgttttcaccacctcttaaatgttattcaccatgttttgctgtaaactggccacaaaattacaacctataaactaagtataatttttcctctgtttgtttttttttttaatctgaagacaaagacaggaatttgtttgctgcaggatggtaaccaggagcctttcaaagtgcggctgcacctagccaaagacattttgatgatccaggaacaggatgtgatatgtgtgtctggtgagcctttctattctggtgtaagtagctttttcttctgttgaaattttttgtgtttgttttttgttaataaaaatgtttattcacagggcattttaaatatgtttttctttcagtgtctagtcaatggttctgcatggaatttttgcttacatcattaagtaatcagcggccctgtacgagaaccttgcctggggtccatgaacacatatttcgggcccatctccagcctgttgtctatgactcctagctgtcatcatatgatgggagtgacactgtattttctgattattctaccattttacatagagaattaattgagaactgtgcatggtgatggcttttgctctggtcttatctttcatgacctgggactactgagagtggtgccagggtggggcccaaccttcagcatcactgaatcaggagacgttaggcagcggtcactgaactcagcgtgagtggtgttcccctaggatagtgtctaaatgattctgtgggcctccctaatagaattatgcccaagtgctgtagcaaattcttttctccaatgctccaacccattgacacattacactgctcctaatctaacttcagaaagagccataaattacagtgcaaaactgattgctgtacctactcatgtcgaggcagcatagctatggaagacatccttagatgagattagattttattctgctaaaagacattatcataagacgagttctggagtttatcattcattgtataataatgctattaaaggcttctttttagcaatgttgccgtatgtgatctcagaagaaaattacagacagtagcatgtagtctgctccctgctttccccaaacatctgcaactatttagcatggagatttaatttgtaccttattaacagacttaccttggagtgtttagttggtggtgaataatgctgaacttgagctctcacatcacttcttactaacaccctatgggagtcacacaaggccctaaatcaataggcctttgccaactaaagataatggacattttgcagactgttaactattcttttgtcacagaccatttaaatcattctgaatcatgggcctggatgtcaaggctgattaaactgttcccatggggttgtcctttcttccctttggttaataatagagaagtgacatgagtcatataaccctctagaataaatatatcacactggtcccagatcaaaaaataaaatcagtaaaatttactactttgatactgaaataatattattgattttaaacttcacagtcaataatagctgatacacatagacctattctcttcttaaaagataattgtgcatataaataaagctcagagtgctaggaataatgaagagaattaaggagaaatatcctatggcattttcaacaaattcaaaaaagcatttgacaaaattcaacacccatttttacaaaacactttagcaagatatgaatagacaagaattttcttaatctgacaactgtcatctaattaaagcctctccctaatatgttagttaacattgaacattttctctgagattgaaagcaagtcaaggataataccttgcttaataatcaatgttgttcaccatgctcctacagcaagtcacaaacgatatataaagaacaaaaattatacaggaagaggcaaaatggctttacttgtagatttcatgatgatatgcatagaaaaccttaagaattctacaaaagatagaataacactaaaattaagcaaggttgctgagaataaggacaatagcccaagttaattgtgtttctaaaactacctacaagcaactagaaatgaaatgaaaatgcaatccacaataagtcagaaagacaatacactcaggaacatatttaacaaaagatgtatatgatctctaccctgaaaactacaaaaactatgttgaaggaaattaaaagatataaacaaataaatggagaaatacaacatgatcataaattaaaagctaagtattgataaactgtcacatctttctaaatattccaaaccagtcaaaaccccaaaatatttgtgtggatatgtacaagttgattccaaaatttacatggaaatataaaggacttacaataaccagaataatcttgaataaaaagaacaaagttggagtgtttattctacctgatttcagcgcttactataagattctaataataaatacaatgtaatgctgtaataaattcaggcatagcaatcagtggaacattctaaagagtccaaaaatagacccactcttatatggtcagttaagtttttttttttaactgtggtaaaatatacataatataaaatgtaccatcttaactatttttaagtataaagttcagtagcatttcgtgcattcattttgttgtgtaactatcaccactattcattgccagaattttcatcatgccatactgaaactctgtacgcattaaacagtaactctccatgctctcctcctcttaacccctggtaaccactgttctactttctgcctctacatttgactattctgggtagatcttgtaggtggaatcatacaatatctgaccatttgtggatgacttatttcaattatcataatgactttaaggatcatccatgttgaagcatatatcagaatttcattcccttcaaaggctgaataatattccattgtgtatttataccaccttttgtttatcttctcactcggtagtaaacattgaggttgtttccaccttggctttttgaaaaatgcctctaggaacatgggtgtacaaatatgtttgagtcaccactttcaattatttggtgtatatacccagaagtgaaattgctggataaaatagtaatactttgttcaactttttaagaaactgccgtactcttttccacagtagttgtaccattttccatttcaacaagcaaaatacaagggttccaagttctccacattcatgccaagcctgttgttttctgtgtttttgataatagctatccaaataagtgtgaggttgaatctcaccgtggttttcatttgcattctcctgtcaattaataatgtagagcatcattttatgtgcttattgtctacttgtgcgtcctctttgggtaagtgtctattcatatcctttgtctatttttgaattggattgtttgttttttggagcttagttgcaggaattcttaatgtattttagatactagtcccttatcagatatgtgatttgcaatattttctcccaaattgtggattgcctttttactctattagtatttttgatgcacaaaagtttttaattttaataaaatccatgtcaattttttcttctattggtcgtaccttttataccatctccaataaataattgccaaattcagtgtcatgaatcttttccactatattttcttctaagagtttacaatttttgctcttacttgtgcgtttggttatattttaagttaacttctgtacatagcattaggtaaagatccaacttcattctttagcatttggatatccagttcaaaatcatgtgccgtatatataagggggtatttgtggcctctctattctagtttattagtctatatatttgtctttatgccagtaacgcacagttatgccttttgtttgtttgtttttactgtagctttatagcaaattttgaaatcagctaatttgggttccttaagatctcaaataaattttggaatgaatttttctatttcttgaaaaaatatcattgcagtttttataaggatcatgttgaatctgtagatcacttttagtagtatggacatcttaataatagtaagttttctgatagatgaacataacatctttccatttatttatgggtactttgagttcttttagcaatgttttgttgttttcatgtacaagtctttcaaccccttgcttaagttaaaaccttagtacttgataatttttgatagtattgttaaaaattattttcttagtttacttttggattatttattgttagtgcacggaaatgtaatggatttttacattttgattttgtattctgctactttgctgaatttattagttctaatagtttattgcggaatgtttatggttttctacatataagattatgtcatctgtgattcaagataagtttacttattcctttcaaatttggatgactattatttctttctcctgccttattactctcgttaagatttccaatactatgctgaataaaagtggtaaaagcaggcattttttttcttattccagatcttaaaggaaaagcttcatttttgagtatgatatttgctgtgggtttttcatatactgcctttgttatgatgaggtagttgtctactattcctaggtggctgagtattgaggcagttttgaatgttatcatcgaaaggtattgaagtttgtcaaatgctttttctgaatcaattgagatgatcatgtgtgctttttaattttttttcttctgctctataactcgcttttcttacctgaaagtacttcctgggacccctgtcccgggaaggaattctatcttctaggtctgcatctgaggaaagccaatctacaacagagaaagtagcacactgtactttcagataaccagatattctttgagaaaaactccctttgtctgttttttaaaacctcccactggtaaaggcccgcagacgcctctgtattaaaagataccctctttaaacttgacctttcacagtgcactgtttgtgttgtattgccacaatacatagtccatgtgctcgctggacagggatcacctctcttatcagctaattatgagatgaatttgagacagtagggcagagataaacatccaactttggagagcagaaagtctcatctgagtattacaacaaatagagtgttaactctcagtctgcttaagtgagtggaaaggttaggagaatgttctaaggaaaggcagatgttagtctgaagaaccataggcaaggatgctattttgttatctagaagcaatgctctgaagtcctgggtggaaaatagaacagtcaggggcaggggactgaaaacaagattgctatcaggcagtttactcatgagggagaaaaatgaagctccactctgctgaaaaatcctgaggattatagaatgttgtagttttttctccaaccccacaatagggaggaagttgtttatattttcaggtctatcacattagctgaaagctgcttctaggattgtctttgcctgacacttttgacctgccttgctcaggctgaaagaaagtgttacagttcagtcaagctcctcttgcccacttcacagaaaaagccaatacaatgagacagccagtattgcattagatgaagagtttaatacttgcaaggcagtgaagcaaagaggacaggagatatttctcaaatctctctgcctggaaatttgaagactagcgttttaaggatagtttggtgggcaggcagctatggagtgggttgtactgactggttggatcagggcctaaatcacagtgctgccaaaactgtcctcaggcatttagttagctcctgggtggagtcactggtctgggtggcattagctggtctactagaatgcaaagtctgaaaaatatctcaaagaccaggctgaggtttcacaatagcagtgttacctagaggggcaactggggaagttacaaatcttcagaccactggctatgtgaatcctgagcagcaagcaattataaaaagcaagctaggaaacaatgcctaggtgctgtttatgcctatgtcttagcagaaatcaggtccctagcataattataatcttatggcctttcattagttttacaaaggcagtttcagtccccagtatggaaaagcttaactttgggaagcgactattatcatccttgctttaaagttccttgctttaaagttaaactataaactacatttttccattaaattgtaaagtaaatccctcccatagttattttggcttttgcacagaaataagcaaaggtagttagcttgtgaggttagacgcactagggagtcagttatgccagatttctctcattgttataattgtgcaaaagtggttccaaaagcccttgtggactgggactcagggatggcagtgggacaaggtctgggatagggagttagtggtaggcctgacaatttctctgtatctgcaccaaggcaggagagggtgccatcagccccaacattaacccactgaccatgaaggataaacagtgagatgtgagcccaggtaaaaggctcactctgagggagagggcacagaactgagcatttggagaagctccagtcaggcaaaatgttggtatctgaaaatcaaggattggcagatgggtcaaaacccaggcgtcatgccaagtaaccctcttagctccttgctctgaattcctggacatattgtagggcatagctcagttgcagaaacaagaattgagaattcgtggtaagtatgtaagggcagcctctgtgagagggcaggatataggatttggatagcaaagggacccctgggaaaaggctttgcttcacaaaatctctagaattaagagaggaaacaggtaatacagggtcagcgccagaaaaccacaggctgatgaacctgtagctgagctccagggctttatcagggtgagcttctaaagaaggtgacttaacaataacccctatcaaatggggcttaaacctgctcatcactccctgattagtgggtctgggagtttatagtagaagtcaagtagctcctcagaggcttcaggaggtgacgcagagaaaaaacactcttgacatatttagcacatctgactctaattttagttatgcagaaagtcctataaaatattgatcatttagaaacttgtgtcaacattttcacctacaagagacagctagagagttaaaactgaaatatccaacgcatttactgtgacttctatcagcaaaatactgctttcccccagtgccttttattaactacttttgaggaacattctgtgatttcttcagagattacacagttgaagttttagcattgagttcatatcagataaaacctgtttcatctgtgatcatttaaaaatagtatcaaaacgtaggcagcaattattcaggatctttagatgcagatagtaaagtgactgttgatcagaatgatgcatggccgttgtcagatagatgtgttaaagcttcagttaacatacaagaaagcaatcatcttcccctggtgctccaggggagctgaaatccaacattcagttcctgtcatccttctgaatggtttaccactctaagtcagagatatctgtggctgttctcatggtagtatacccttcaatgggccctgaaggaaaattaaatttagcctgtgctagttttaaatattgacgaaatatttttaaaaggtaaatgagggtaaaatcaatacaagatggctatctatttccccatagagacaccagtttcaaaggtgttgctagtaaaaagatacgaaaaccatgaagaatcatggagcttaaattccaaacatgacagaactgtcagataaatagcatcaatacaatcagtacctcagtgtaatgggcaccattagactttaaaatcaacagaacaacttcttccagtttccttgtggaataaaacacacaattagcaatcccacgagtgaaaccacaatttcctgaagatgactttaagagaactaatatctactattaaccttggaatttgtactggctttcacatgggtgtgacatgatgtaggatgtggctttttgaggttcattatctgtgaaaatgtgatccagagagagaatgtatctagactagtgcacctattatggatagattcttaataggtcatctgggaggcatggtgtgtgcaggcctagataggaacattgttttttctttttcccacatcacagagctactcactgaaatctgtcaacatggagattggagtctgtgtacacacacatgcacaaaatacacgttgtctatattttttaaacttttaaaaaaaactcttgtatgccaatgttatcatttatttgctgattttaatgagattgcattcttcttttatttaaaaatattgaatttacaaagaatatatatattcaaggtgtataatatgatgacttgatagatatatatacatacacattgtgtaatgatttttacagtaatgtaacacatctatcacctcccctgctatatattagaccctgagatcttgttcattttataactgaaagtttgtacctttttatcagcaccttctattcttccattcctcagcccctggaagccaccattctactttctgtttctgtggattggacttttttttagattatgcatgtgcgaggtcatacaacatttgtctttctgtgcctgacttatttcactaagcataatgtcctctgttcatttatgttatcacaaacggaagggttcccttctttcctctggctgcattatagtcaactgtgtatatatatgctttatccattcatctgttgatagacacttaggttgtattctataaaatttgacccattctaagtaaatacaactgatttttcaaaatgttttagaggtaaaagtggtcactgattactaacattgataaagaagctatcagtttaatcccgtttttacatttgattgtatgtttataaacttttcaatcagaagtattttatgtttgcgcttctccttgtttggcctttttgggtagactgacattccaaatgtgtgcaaataagactaagaaaaggaaggccgggtgcggtggctcacatctgtaatcccagcactttgggaggccgagatggccaaatcacgaggtcaggagatcgaggctatcctggctaacacggtgaaaccccttctctactaaaaatacaaaaaattagccaggcatggtggcgggcgcctgtagtgcccgctactcaggaggctgaggcaggagaatggcatgaacctgggaggcagagcttgcagtgagccgagatctctccactgcactccagcctgggtgacagagcaagactccatctcaaaaaaaaaaaataaaaagactccatctcaaaaaaaaaataaaataaaaacagaaggaggaagggaaacatttttcaggagtagaaaaatacttgcagatgggcaagtactgtttagagagttgtgattttataacagaaagataatacaaaggcctactcttgaaacctagagtgtccctgtcttttattattagagattgttaaattgaaaagacagtgctggaaaccccttctctctatttcttatgtgatgtttcttttttgccagtcagtagtcaccactagggacatttacgttcctaatttcccagggcttatgcggttccagatatggcagccctggaagaaaagattatggctccagtgaaaacattgtcaccggatcccctggtggtggccgcagtgggattagcccgagttggtcacagttgtagtcagcctgtggcaacaccatctcaggttccatagtctgggcagcagtccccagggactactgcctgtgtctcctttgattaggatagacagaacagatgcagttggaggtgttggtgttgttatttgaaggctcctccaaacgtagaagcaaatgaatgataatatttaccacaagaacaatggcacccacagaaggataccttattaacagagttaatttttttgtgaaatacattgctaggtataagattcatattaaggatatttatcttaacgtgttttgttaaacctagcattgttaaatccacttgttattgtgcatcttgttttattttacctttaaaataattttaatatgagattttctttatacatataaagcaaatttattgacaactctttaatacttagttttttcttacattttgtacctatttgtctttctgtggggcactaaaggtgactccttctttcttcttttcagttcataactctttctttgacagattgagtccattatttaaactattgaatttctgattcttattattatgtttttcacttctaaatgaatataatactatctgtcttatcgggtaattgtgaagatgaaacaagtgaatgcaagtaaaagagaatatggtctctggcacatagtaggagctcaacaaataatatctttattaacatgacacatgatacaatgtgggtgtgtatagacatggtgatacacagagtacagaggtctaggtcaggaactgctttccagaggatgtgattaaggtcccacctcttaaatagcaggtagaattttgcgggatatatgtaattttgcaagacatatgtaagtagcatttaaagcagacaaaaagtgtatgcaaaattaccaattaccaaactgttaaaaagcatgccataatcaaggatggtttagtcatgggacatgtttcctgcaggatacagttgggaaggatgtaaggtggggtgcaaagtgtattggtgggttgtggtgccatcaataaagggagcaatttaagtaggaaaatcaggttttagagcggtgtacaatggaagttgaattgagaccaaaaaagcttagaccatttagaaccaatgcaattttgtcatagactgatatcaagatggaaactaaaatcagttaattaaagcaatggtgcctggttccactggcttatcagttacattgctcacgtttgtgattttacagatttgtcatacttacaaaaagatatgtcattatttacacaaatgaatttttataacattaaatgtgagtgtaaagttcaagagggttatgatcaatcatgtgcccatcagcagcttaatgatagatagagatggatgatagatgcatagaggcatagatggatgacagatatagacagatgattgattcataggtatcaatagattaatttaacactgttcatttgtttttttcttcttccttaaaatggttgacagtttgatgtattttgtaatattttcatcccttagctctcatactgagttttggagtttgagaaagtctgccatctatctattttttctttgtaggaaaactgtctcttctttctgagtgttgaagatttcagaatccatgcccatccacgccccatggtaatctgctgtgtcactctgacatatctatctgaagatgtattttctttgcttgagagtcacaagaccggaatatgaaaatttatgtatttcttcaattctgaagaatttttagccattatctttgaagagcctcctctctattatctgtgttctttccttcagtaacatttggatggatgttagatcagctccctggattctccattttcttacgttttttcatattttgaacttgtctgccctctgtggactctaaaggcaactcctcccatcttcctttcagttcactatctctctctttggttacattgagtctatcatttaaactatttattgaatttctgattctggctattatgattttcacttctggaagttctattctatcctattttatatttgcctcatagtattttacatcacgattatacatttgatatctcctttctatcaatattaatcttgttagacaatcctatttatatgccgtatctgtaattgcaagatctgcagtctgtatagatctgactctgttatctgttctttgttctgctgctgatgcactcactaaattccatttcctcctgggatttctcactgtgggctcatggtcttggcactctataagtatccctcagtttggctctataatgtgttatgaagatagaatttacaattagttctttcaggtgaaggggctattagcaacccagatattctttaaactaaattctcagttggggatatgaggccacacaggtagagacaattcatcacacacccacctgtgggccaattcacaaaatctcagaaatggtttttaattccttcatccagatctgaggtcaagattggcaagtttctttactataatcctttgggtgataggaatggtttttcatactgacacactaagagagttttctatgcaggtgacggtgcctctcctgtcctgcttgggtccttccagtgatggccctgaatgtttgcctttgggtctctgctcgtacagacttcttacctgtgaatctttatacttcgtcatcattcctgacaaccgagacatttttcttctttccttattactctgactgcacgtttgacattatttttatttattttattcatcattttattgtgtgttgtcttggaaagggattttaagtatatctgactcaaaggagtgttagactcaagattagttgtgtgtgtgtgcatgtgtgtgcgtgtgtgggtgtgtttgtggaaaagctatcagatctgaagtgtacaggcctggcttctaatatcagtctccccatttgccaactttgtgaacctgtgtgacttcttgctttctctgaatcgttgttcgtatgagggaaaaacagagaccacctactatacatagttcactgtggcaaaattaaatgagattgcattgcctaggtgaccactagaggtgaacaataaagatggctgtcttcttcctttcatctggataattgtttctttctctaattcactttgtctaaaactttaaattattatcctggatgagtaatttgagctgcataaataatctttctgtgtaaaattagaaaacaaaacttctcaccttaaaagaaatttttcgtgagtgaacaaatgttgtttaaatgcaaaggagtttcattattattgctttaaaccaaggagttctgaaaatggcagtaatgtaaagcagcctagaggtattccaaagactacagtcttatgaagtttatattgtttctgcagaaaagcatttacattaagaaggtaatatttaaatgagattgaatataaactaataggctgaaatctatattgttctggaaatcagtaatcaggacacactagaaagtgaaatggaataggtaataacgtaaatataaggttaatgtaattgatgtaaatgtttacttatacctatacatgttaacataatatatcaaggagtaagatttttggttaaaatttctcatttttgtcaacaatatatttgaaatatactcttcccatgaaacagttcctcagttgttttagtagcacaagtagttttagtttaaaaaaatatatttttctcctctccaagccagtaaaagttcctctttcagtatattatataaaacttaaattatttttgtatttaatccacataattttgcatgatgcttgctatcatacatattgttaatttttactacatatgtggaaacggtaagatagccacctttttaaaaaaattaataataaatttataagtggaatgtgggtaaccaaagcccagagtttaaataagccttttaattttcagagcattaagaaggtagtgattgaaatttatatttgataaatggattgctgttaatgtatctaggcattgaagagacttaatacatgataacgatgggtgattatgatgagagagtaaaatggagaatgttctgagtgttcaaatattgagccacataggccatccacttttctttgtagcttaatatttttatttttacaatgtcaatgcttttatcttcatgttaattattttagattgtatcttttctctcttcatctgtgacagcagtctgtgcaatcttaaacaaaatgtcccaagtacaattaaacttgtataatcatcagtatggatattggtttttgcactgggcattcactcagtgataatctgtggtttgtgggatcatttgctcgcacactaaatattcctggattgccatggaggttataagcatagtcacacatgtgcacatgcatggaatggttctatagttcctcctgcttcattccattctaaaacactaagtctgttactttcctatacagtgggcttggatccacatagccaatatgtcaaatgtgtagtacaaaaagtgagaatctgagtgagaatttaaggccttcttacttaagagcataaattttgaaatatgtattaaacaatagtggtgatttatttttcttctttatggttttcaagactattattaatatatgagtttgcagattagctaaatattggaaatttgaggtgttactgtggcttgtattttattatacttagttcttggtaatttacagaatattttagatagattacttaaaatgtttgaagtgtatttgagacattttgtttatgactacttatattcatatcacatcattattttgctaatttgtctgtatcattgcctttttccataaatgaagactttgacatccatgtgatttaatgctaagatctgtccataatagagtgatagccgtgctgaactctatgtcatggatcccattaccctgcattagagcaatggagtcaagcagatagatacttgttctgttctatccatagcttaacacctgagtgactgtgacgatgattcactgtctttgcttcaaatgtcacataaagtaatacattcaagtgcactttggacactataaattgctatagtataggaggacttatttttacttgtacttgaaaaagtgttttaaagaagaaattctaggtggttttaaacccactggaaaatttggtaaaacaattgtaacttataaaaaatttatcttcaaagatatgtataacttcagtttgaaccgccatgatatacacttttctaagtgacatcaataaaatcaaagcaattgcttatatacacaagttggaacatctctgcgataaggagcatatgcagaattttgacactccttgaattttctactagttatgaagcacgtgccacattatcttactctgtagactgtatattctgagacttagcgatttataggagagaactgacttctatttcagagtctatcaaaaggcacctatgtgatcctcacactttactttctctagacgcaatatttgctttcttagcatgtagaattatacttatgaaatgtcgcccagttataatattccatggcttgcttctcttttttcttctaaatctcctctaacagtggagatgttatataattgcctgcaagtggctcacgtaagatataaataagagtgtgcttttctcacctttcatgaactactacatcacacttcattttcttgtccattcagtcccttgctcccttagatgacaatgtcgtatcaacttctctctccaagtgtatccaataacatctctcccattctcactccaaggtgatgcccttgcttcctccttcactgagaaaatgaagccgagaaaacaatgccccactgccatttatatctaccttcctggacttgtgaccttatgtgttttctccctttccattaccacagatgatctgtctttcctcctatctaaggtcaccatctagtcatacactaaattccacccttgcatgcatcttcaaagacatcgttccagcaatttcccactgcatttgatgattcccactgtatttgattgcatcatcaaatgctcattttccactagatcattctgaccagtgatcattctgatcattccaaccaagcaactataatttccccttcttcaaaagcaaaataaaaccaaactctctcttggcccgaaattctcctccagcatccactgcatttctctgcttcctcttccagagcaaagccattgaagtgattgtttctttgccatcatcccccaaattcagtaattcatccccactactccactgacatttctctcttcaacttcactagttatttcaacattgctcaatttaatggatatttctcattcctaattttacttgtgttttcaacaccactgacactcctttctcctacaaatattttcttacgggcttcttgggtaccctgcattcctcttttcctccaatctctaagcaacttagagatctctaagtctcagtcttcactgctgagtcttttcttcatttccatctataggcactttaatggtgcaaagcttagttctttacgttattctttttcttttactttttgcacttgctctttcagatgtcatccattctcatggctttaaaagtgactaagctccagcttatatcttaccctgtcctgttccctgcactccagattgagatagtgcaacaatttgtacaatatctgcagttggaggtccagtaggcattttcaacttaaacatgaagttttagttaaacttcatgtttaactaaaacataagcttaaacatgttaggcaaactaaactcttgattattccccaaattaattcccttcacaacgtttcctatcccaatagagtaaatggatatgtcatctttccagctgcattaggcagaatccctggaatctctcattactctactctttcattgaagccacatccaatcagtttaaaaaatcatgttagctttctgtcaaaaatatatccaggatatatccagtctttcttctggaaagtagggatagaactgtttttctctattatttgtactaggtaaaaattaaaaactatgactattatcttttaaaaaaaataccataaggctctgaaaggaacagggagaaagacaggttggcttgggattttaggatttgaggaagtcatagaaccatgttctctgatggatttttggcctcaaatatcccagattggttacaggagaagccagtaacctggaaatgacaataagcccaaccaaaacctttctttctagaaaaaaaaatgggcagcttaacaagaaaataaattcttccaaaataaatgctctactctaccaaaataccacacacacacacaaaagtgccctctttctatctccaatggcaatggccaagtggaaaacttagacttataccctcaccaggctgcactgatgttctccagctctgtctgccaaggtggtattagggaaatcataaatgggaacaaggactttcatctttatggagcaaggccaacaacaatcccccacaaactccacctcactgtggtatcagagaagattatctggttgtctgaaattcaaatctgtgcagcccagtgataaagaagccatcgcaaacaatggagtcggttgagacctctcagagagcagtaataaggctctcctcctcccctcaacaagggttgtatcagtggaggcttagtagggagctaaaattcccacctatcaccagcagaaacaagaaaattctcaccttgaatgagaagcaataattaacagatatcaaatctgaaatgatacagatattagaattatataatatgaatgttaaaatagcagtcataaaattgctatatattagttacaaacaccattgaaacaaatgagaaaatagaatatctcagccaaaaaaaattcaaaattattgaactaaacaatacaataattgaaataaaaactcaatggttgggcacaacagcacaatggacgggacagagaaaataaacagttaacttgagacagagagaacaataaaaattactcattctgaaaaaaaaacagggaaattggactgaaaaaaataagaagtgtctcagggacccatgaaaatgtgacagaagttctaacatgtatttgagcagagtcccctgagaagaaaaagagttcagactcagagtatttaaaaaacataaaggctgaaatttttcaaaattgtgcaaaaagtatgaatttatgtattctggaaatggagcaaacctcaaaaagcataaagtcaaacaaattcatgtcaatcacttcacaagcaaattctgaggactaaagacaaagaagaatacttcaaaagcaacaaaaaaggaataacagcaataggaagaaaacaatccaaatgacagtgtagttttcaccagaaacaatgaaggccagaaggaagtgaaacaatagttttaattgctgaaaggaaaaaaattgtcaatccaaaattctatatctgtgaaacacatcctccaggaatcaagagaaaatcaagacatcataagatataagaaatataagaaaagtatttcattaaaggaatggctacaaagatctctctcaacagagaggaaatggttaaagaaggaatcctgaaacatcacaaaggaagaaaactaataaaaataattaaaatatatgtaaatataatacattttccttttccccttaagttttttaaagtaagggtgatggttcaagccaaaattttaacattgcctaatgtgcttctcaatgtatatagagaaaatatttgtaacaactaaaaataggggaagataggccaggtgcagtagttcatgcctgtaatcccagcactttgggaggctgaggcgggtggatcatgaggccaagagatcaagaccatcttggccaacatggtgaaacctcatctctactaaaaatacaaaaattagctttgtgtggtggcacgtgcctgtggtcccagctacttgggaggctgaggcaggagaattgtttgaaccaaggaggtggaggttatggtgacccaagactataccactgcactccagcctggcaacagagtgagactccacttaaaaaaaaaaaaaaggcggtgggcgggggaggggggggcgaagataaagggacatttaaatgaaagtaaggtttctattacttcccttgaactggtaaaatgctaacactgttaccagaaaagggtaccaatccataccccaagagagggctcttagatctccacaagaaagaattcagtgtgaatccacagagtaaaatgaaagcaagtttattaagatagtaaaggaataaaagaatggttacttcataggcagagaagcgttcggggctgctagtggcccatatttatggttatttcttgattgtatgctaaacaagaggcaaattattcatgcttccccttttaaacaatacagcataacttcctcacattgccatgacatttgtaaactttcatggtgctggtgggagtgtagcagtgaggaacaccagaggccactcgtcaccattttgtttttggtgagatttagctggctttttttattgcaacctattccatcagcaagacctttatgacctgtatcttgtgccaacctcttatctcatcctgtgactaagaatgccttaacctcctagtagtgcagcccaataggtttcagctttattttacccaaccctttttcaagattgagttgctctgtttcaaactcctctgacaacaccaatagtcagtgtgaggaccataggctcttggccccctaaaggtctgctgaaagatcactgacatgagacatattcattaataggaaaaaaggcatacagacttacttaattaatgtgtatacctgggagccttcagaatgaagactcaacttttcagtaagtaataaaagcttatacaccatcttgaaattacagacataatgcagatccagagtatctccaaaaacaggttttaatggcaagagaggttatgggagggagaaaggaggaagattgactctcaaagtggccttgttgtgcagaccaagcctctatagagtaaatgtttcttttcagacttttaaaaatgtcacacactcaatctctcctagacctggaaacggcatggaaaggagaggcctgattgcattaatggagattctctacagatgcaaattttcttcacaaaagacaggctaataagaccacttctgtttgctggccagaaggcagccatttcaaatatgtcaacatatatattttggggtaaaatatttgaatttccttcaacagcgatctatctatctatctatctatctatctactatctatctatctatgtagataggtagatcacataaaattgattgaccaagtagacaaaaagatatatagaaggactcagaaacattatcaaccaaccagatctaatgagcaaatgtatagaacgtacagcagattacacattattttaaaataccaaagaacatttactgtaactgtatgaggggtactttctgcctgctgcacaagtaaagaccacagtattgcagtaaataaagaaagagtttaattgacatgagtccagccactccatgcaggagacagaattattgctcaaatcaatctctccaaaagctcataggttaggagtttttcaaaggtaggttggggggaaggggtgaggttgatcaggtaatgtgtgagagattaaatcctgggtggaaccacaggagtggggttggtggggccagatggagccaggtgttagacatgcagaaacctgaaaagatatctcaaaagaccaatcttaggtttgacaatagtgatgttatttgcaggaatggctagcagttgtgtatgtctacactttactagaatgcaggctcctctactcttccctagtcaggtgatctctcattagctttaaaaggtggctgagttttggcaaagggctattaccatttaaactataacctaaatagcttccaaaattagctctggcctaagcccagatgtaattcaggcatgttgaaagttaaaggcaggaggtgggtttgggggggttagctcagatctttttagctgtcaaacttttctcactgatacagtttttgcaaagctggctttattatgatgatataacatatttttgaccaaaaatgagtaaatatcaatattttaaaagaatggaaatccatacagtgtgtgttctctgactatagtggaatcaaagtagaaaccaataacagggagatacaaggaaaatcttcaaacacttcactagagtgtgagcacctaacagaaatttttaaatcagtttgttctctgttatgtttatagcatgtaaaacagtgcttagtatatagtagccacacaacaattatttgaaatattcaatattgcaaaaaacaatcataaaaatcctctcatttctcctggttctgaattctgcatttaagtttcattgactttttataatttaattatccctttccaaaagttcatttattcacttatgtttttgcactcaacatgactataaaacctttaatttttaactcaagttaacttctttatcttttctcctatgttcttgccaaaggatgaccaaaactattcattcaaaggccatagcagaatgctatctgacagagagatattgtggatatattcacaaaggcagtattttcaagccaactatgaagaagggtagctttcaaataaatcagtaaattaaagctcagtacatgaaatgactctcagcttgagaaaatctacaaagaaaatggaaaagaagcataaagcaaatgagagatgtaaaaaatataataaaacctatggaaattggccaaaaaatgtgatgagatgagacttaactgactagtagttagagaaaggtaaagtctgagtgcctgacatcgcgttagggagccgacataaagtggtcaagtccttaacttcaaatgatgaaaggctcaagtattggagacccaaagttcttctaaagtcttggatatggggatgatctaaagatggagagactgatggaacctgtgtttaaggttttagacaagaacatctcttgtcatagaccaaagacccttcttccccagtatctagccctaacaacaaataaacatgatgtttgcttttggaatgggtgaatcaaaggttccgggaatgtgctccaggtgaaactgtgatgaggcattgcactgcaaatgaagggattaaacatggagagatagcgatatgtgccaggtaccctccctcagcatcactcctctcccagaatacagaacctaggtctgtaagtccttggcaagtaaatggaagattcttttcagacaaaacaaacaaacaaacaaaaacaaaaaaaggtaatctcaagagaaagcctcaacaacagatgttgacatttggaagctcctcagcatctgtaaggtgtaccaatcaaaaatctagccacatatatacagtttccactatcatttttataccatgcatggatgagtgacgaaagtcactagtaaacacactgaagaagtcaattttaaaaaggaagacatggagttaggaaacagatcctacatagaaatatgatacaagtttccaggaatgggatgaatagaggactcagggcaacagctgtgtagcacacaacaaacttaattagctgacatgggaacaggaggatgtatgagtccaggagagagatagatttttaaaaaattaaaaatcacactatcttatgattgaaaacattaaaatatgtgactttgttaagaggagttttactgttctttaaatttgggaatcaatttcatgacagacaagtatatagaaaactaggaaaatttcaaaagccatttaggagcttcaggaaatgctaagaattgcacaagatggaaacataattatgctctgctcattgtattcagtgggaataatatttcaaagtaattacataaacattgactactgactcactagaaaattataattatatttacaggtgaaactggaatataaaaagtgtatgtgtgtagcattgtttatgagaaatcaatagtttttttccatagtagagatagcattttttaaaatggaagacaataaatcacaagtatattatttagaaatatggaatgagtcataagaagaaatggcacaagatttgcgtccgggcaggtgaaagctaagtggagataagggcaaaaagggattttttttgtggttaatacaattcatgtagaatattagacttttaacacaggggtcccaactggtaccagtcagcaggaggtgactgctgctggtcacacagcaggaggtgagcggcaggtgatcatgctttacggtctgagctctgcctcccatcagatcatcagcagcatcacattctcatagaagcacataccctattatgaattgcacacgccagggatctaggttgtgcactccttatgagaatctaatacctgatgatctgtcactgtctctcatcacccccagatgggaccacctagttgcaggaaaacaagctgagggctctcactgattctacattatggtgagttgtataattatctcattatatattacagtataataataataatagaaataaagtgcaccataaatgtaatgagcttgaatcattcctagtccaatccccaccacttggtctgtggaaaaatcgttttccatgaaaccagtccctcatgccaaaaaggttagggactgctattttaacatacataccttactttgatacagataaaaattaagcattaaactgaattatatgaaagaaaggtcaatctgatattattggtaaaaaatattggagggtgacgtttgaatcaaggaaaacacttaggagatgcaatgaggtgctgaaataagcttgcagtgaagaagcaaactggacgaattcctaaatcccagttgttttatattcttctgtaaatcaagtgcaaagtagagtgtctggcattctggaagtcttcattaaatttaatttcctccattaaaaatgtgctttattatttaggacagttttagattgacagaaaaaattgcaaaaataatatagagatataccacacaccgaggctcccctattaacatcttacatagtatggtaagttggttacagtgaatgaatacattttgataggtaaattgtaacacaagtccatagtgtatttagattttcttagttttcatcgatagtccaggatcgcatccaggacacctctgtatgtagtcctcagatctcctcaggcacctcttgtctgtgacactgtataagaattcatttgttattgctttcagcaataatgatatttggtcaatgaagggccacatatattacagcgtatcataagattataatagagctgaaaaatttctagttacatcttaatgatcctgaccctgtgtaggcctaggctaatatgtgtgtatatgtcttagtttttaacaaaaacattttaaaaataaaataataataataaataaaaaggcttatagagtaagaatataaagaaaatattttcacacagctatacaatgtgtttgtgttttaagctaagtgttattaaaagtcaaaaaaataaaaagttttataaactttttactttataagtaaaaaatgttacaataggctaaagttaatttattactgaagaaagaaaagtattttaaaataaatttagtataacctaagcatcgagtgtttacaaattctacagtattataaagtagtgtgctatcattcacaatcactcaccacttactcactgcctcacctagagcaacttccattcttgtaaaatgaaaaatatttgggaaaaaaatacaacaataagaagtaacacaaatttaaaaagcaataacgtataataactatttactatataggctataatacagcaatatggtataacagctttttaataactatttatatagaacttacattgtattaggtattttaagtaaagatgagttaaagtatacctggagatgtatgtagatcacatgtaaatactatgccatcttatatgagggacttgagcatctgaagattttggtattccaaggagatcatggagtcaatcccccacagatactgaggaatggttatgtatacttctacctatatagatataaaatttcttactcacagtaaaggtttcatgaaaagcaaaaatcaatgttatttcttagttttgtggtaattcacccctaaattaccattatgataaaagttacagtcaaaaatattatttaacaacaatctaaaattacaagccaattttactaagtaagctttgcagaaatgtaaacataatgattattattaatatcaatatttacaaatggtatgaatctgtttaaaaactgtattgaagacactgttaaagaaaacagacactaatgcaaatattcaaatatgtatatatacactttttttatttttaattttttgagtcggggtctccctctgttaccaagcttgggtgcagtggcatgatcatagctcaccacagcctcaaactatttggttcaagctgtcctgcctcagcctcccaagtagcttggcctacaggtgcataccaccatgcttagctaagcttttttatcttttgtagagacagggtctcacaatgttgcttagcctgttctcaaaggctcaacctcatgcaaccctcccactctggcctcccaaagcactgggattaaaggcatgagtcactgcacccagcctcaaatacatttttactaataatttaaaaatattctcagaacaaatttactcaattgttctttctatattatgccaagaggcactgttgggactatatgttcaaatacaattcattagatgatttgaattagtgaatctttgtctcacacagccttttaaatatatatttgtctaactcaattagaagtcccatgccagagttttcagttagagaaacagtagattagacaaaaggaaataatgatgtttaatacagggctcctcagagacattaccatctaaataagtgttaagaaataggagacaggaagaggtgcagtggcttgcacctgtaaacccagtgctttgggaggcaaaggtgagatcacttgaggccaggagttggagaccagcctagacaacataaactacatttctacaaaaaattaaaaaattagttgagcatggtggcatatgcctgtagtcctagatactggagaggctgatgcagaaggatctctttagcccaagaattcaaggttacaatgagttataatgaagccactgcattccagcctcggcaacagagtaagactgtgtctcttaaaagaaaagaaaaacaataaaagaatagaacaggggatgaatatatgggcagtggctcctagttcctgcatttcaatccagagaattcaccactaactgaccttggtaaagttacttaacatcactgtggttctgtttatattacagatgcatatttgcagaaacaaaagtggaattgtgcaattttcaattctttgcaaagctaacaaggaatatttaaattttaaatagtctgcattatctaatgaccttaagtcacatatgaaggacctgctacaaactacaattttcagtgggctttagggaatgttaatctcctttttcaccactacacctgtagcaagagagaaaaacccaaaaccctgagagcttgcctggggaatgaatcaaagggaatgaagcaagaaacctcagaagtgctgtaaatgtgatctgtaaaagaatttataggaaagggcctttttttgtaatttattctctttaattagatttttgtaaaattatctagggaggtaagttctgtgcctaagtcttctaagatggaatgctattacttccttgggaccaaggaccccattgttcatttaaagtagcatcaaaaatacttaggaataaatttaacaaaattataaaatacctattctgaaaactaaaaatcatgagtaaaagaaattaaacagagcctaaataaatgaaaagacataccattttcatgtattagaaaactcaatattattgtttatattatcataataatcccaaaattgatctacattataaatccctataaaaaaatcccagctaatttccttgcaggaatagacaagctgatcctaaaattcataaggagatgaaagagatttcaaatagctaaaacaatcttgaaaaaaacaaaagagtttgagggttcatatttcctgatttcaaagcttactatgaatagacagtaatctaaggtggtactggcataacgatagacataatagatcagtggaatagaattgagagttcagaaataaacaaattcatagtcgacttatttttagtaagagtacccaaaccaatgaagaaagaactgtcttttcaacaaatggttctgggacaactgaatatttacacatataataatgaattttgaaccctacctcacaccacatacaaaagttaattcaaactgcatgaaaaatctaaatttaagaactaaaactattaaaactcagaaggaaacatacatgtaaataattttgacattggttcaggcaatggttttgtaaatttgccatcaaggtgcaaattacacaaaacacagaaaaaacagataaatggcacatcataaaaatttaaaacttttgtgcttcaaataacactatcaatacagtgaaaagacaatacacaaaatgggagaacatttttgtaaatcacaaatctagtgtggtatttatatccagaaagtgtaaaaagttctcgcaactcaattaaacgggcaatcaaaaaatgggcaaataatttgactagatgtttcactaaagaaggtatataaatggtaagcaaatgaacaaagtgccatcagggaaatttacatcaaaaccattatatacaactttatatcaattagggtggctataatcacaaagatagataataaggtttattgagaatatggagaaattgaaattctcatacattgttgatgagaatataaagtgacatggccacattgaaaaacagtctgacaattcccattttcaatacttggtatatatgcaagagaaatttttacaaatgtgccataaaatgcttgcacatgaatgttacagcagctttattcacagtagccaaataaattaattgtggtgaatgcacaactgtgactatgctaaaagtcattgaattgcacgctttaaatgggttaatttcatggcatatgaattatatctcaaaaaatatattcttagaaagataaaaactgtgtatattcacatatctataaatatttttatgcataaacatcagtatcaatattaagctaaacatgagtttatactgatgtccccaactagtttccacaacctcgtgaaatttttagcctcctcatcttgcttatctgttagttcttctctaacacagagaaacctggattcccttcatccaccacccgtttacttgttaaatttcaatatacatgtataatagtattaggattgttaacctgtatgtactgtgaaagggccatttatgcaaagtagcccccacatgctgaagaagccaaggaaccaaagaatgagacagacaaatcgactttgttctaaggggtgttttattggcagaacttgcagacagaaatgtggtcttggttggctgcaaggcaagtagatctctgcactgttactcctcagatccagggcttgtataccataaggaagggtgtatatgctccagcaagacatttaaatgcaaccatccagaaaaggcaagaatgacatgttcttacaacagagatggtaaatcaggatggtaaagcagaaatcaaaatacattcatgggactgggatagttaggaatcgacatggaattccgagatggaatcactcttgtcttcacaccataccctgatgtgaaacaactttatcaaccagaatacagttccatgtgcagttcctttagcctttcatctttagcctttgtcttacagatgcttgtgccttacttcatttccacagtgacttaggtcacatcatccccctgccccatcgctgaggttgtaacatacattcgtaatgtagttcaagtgtcacagactgcattccttctttagtcctgaataatttttagacatttgcatacattaaggttactcttggtgctctaaagttctatgggctttgacaatgtataatggtatgcaatttctattgtaatatcatatagaatagtttccttaacatggagattctgtgtcaatgtgggtttgtcagttgtaacaaatgttcccctctgataggagatattgataacatgggaggctatgcatgcagaatctccatgtctttttgcagcttgattgctcatttttaaaattattcaatacttcactgtatagatgtaccacagtttgtttattcattcacttattgaaggacatcttatttggctatttatacttattggtgataatggatacaggtagtataaatatctgcatgcagatttttgtataaacataaactttcaaattatttgggtaaagacctaggagtatcattcccagatcatatgttaagactagggttagctttgtaagaaactgcaaaaatctcttttgcattcacaccaataagaaatgaaaattaaccatgaacagtattcttgaaagcatttggtattgtcagtgttttggattttagccgttttaataagtgtataatattatctcattgttattttaatttgcaattccccctgacaaatgatgttgaacatgtcttcataggcttgcttgctatttgcatatcttttttgattaagtgtttgctcaaatacttcagccactttttaattgggttgtttgtgttcttactgagtgttatgagttatttgtatattttggatacaagtcttctatcagatatgtgatttacaaatattttcctctagtccatagcttgtctttttattctcttagcagtatctttcacaaagcaaagttattaattttaatgtattctcatttatcaacatttttataaatcatacttttggtgttgtatctaaaaactcatcactaaaccaaaaatcacatgggttttctcctgtattctcttctagtactactgtgtttttaatatttaagcctatctatgatacactgtgttaatttttgtgaagagcatagtatacatgccttttcttcttatggatgtccaattcctccagcactgtttgttggaaaaaaatatctttgcttttctctattgaattgtttttattcttttgtcaaatattagttgattctacttttttgtttccttttttttttggccacctgttctgtaccagtggtctaaatgctttttctgtcaaaaatgccatgttgtgttgtgtactaaaactttatagtaagtcctaggtcaagcatcctgagtcctccaactttattcttcttcagtattgtactggttattataggtcttttggctgtccatctaaacctaaaaattagtttgctagtatccacaaatagcttgctgggatttttattggaattgcatagattttaaaaatcaagttggaaaggaatgacatcttaaaaatattgagtctttcaattcatgaatacggttatctcttcatatgttttgaacatatttgttttttctctagattttttagtttcatatataaatcctattagtattatgttagatttataccaaaatatttttcttttattttttatttacattttattttttattttatttatttattcatttttttgagactctgtctcactctattgcccaggctggagtgcagtggcacagtctcggctactgcaacctccacctccctggttcaaacgattctcctgtctcagcttcccaagtagctgggattacagcgcacatctccatgctcggctaattttttctatttagtagagatgggggtttcaccatgtcggccaggctggtctcgaactcctgacctccagtgatccacctgcctcggcctcccaaagtgctgggattacaggcatgagccactgcgccaggccacaaaatatttcccttttagtatgtgttattttaaatggcattatgcttttaattttcaattccaatttctcattgctgatatgtaagaaagcaatttaatttttataataattccatattctatgaacttgctataattacttaccacttctagaagaattttttttcaattctttgggattttatacgttgacaaaaaacaaagatagtcctctatttttgttcatttcataagcctttatttcatagtatttcatcactgcgctagctagaacatcaagatattgaatggcaatggtgaacagggatatcctggccttattcccaatcttgcagggaaaatattacatttctccccctttttactacattgcaccatgagttttctgttttttttttttttcattctaattcttcattttatctcaggcctgttgggatagaaagaacagcagagatcagagaaaacttggtttcaatcacaacttggatcttggtcaagttaatttcactcttttacattttgattttctcatctgttaattagaaaaacaatttcctacaccagtgggttgctgtgataattacttagaataatgtttgaatgaatatttattcatttaacattttaatacctaactttgtttcatgacctgtgctaagtgcttgtgagataactttgtgtaagacataggtccagctctcagaaaacttggaggaaaaaagtcgagggcatagttctcttcaataaacaattctaagtgctatgagagctataagtacacatagtagatttttatttattttttattattatacgttaagttctagggtacatgtgcacaacgtgcaggtttgttacatatgtatacatgtgccatgctggtgtgctgcactgattaactcatcatttacattaggtatatctcctaatgctatccctcccccctccccctaccccatgacagtccccagtgtgtgatgttccccttcctgtgtccaagtgttctcattgttcaattcccacctatgagtgagaacatgcggtgtttggttctttgtccttgccatagtttgctcagaatgatggtttccagctttatccatttccctacaaaggacatgaactcatccttttttatggctgcatagtattccatggtatatgtgtgccacattttcttaatccagtctatcattgatggacatttgggttagttccaagtctttgctattgtgaatagtgccacaataaatatacgtgtgcatgtgtctttatagcagcatgatttataatcctttgggtagatactcagtaataggatggctgagtcaaatggtatttctagttctagatccttgaggaatcgccacactgtcttccacaatgtttgaacagtttacagtcccaccaacagtgtaaaagtggtcctatttctccacatcctctccagcacctgttgtttcctgacttttgaatgatcgccattctaactggtgtgagatggtatatcattgtggttttgattttcatctctctgatggccagtgatgatgagcatttattcatgtgtctgttggctgcataaatgtcatcttttgagaaatgtctgttcatatgtacacatagtagatttttaataattagaggccatcatcctcattattccttttccaacttcagctactcttcctcagttgtcaaaaagaactattaacattctctattttctttccattattgttctacaaacaataatgtattggtttctgtaacacaaaattaatacaaacaattttccaatgataatctctttagtttctgcatgatttccacttcttcctaacttttttccatacaaatctcaaaatttcaatacctgagatatgtgatgccaacttttttttggtgtcatgtatatttttcttccaatatagttcatacaatctttctctatatgcaacttataatataatattccaaaaagcagggatgatagttatatttttctacaaagcatactaagtatttaatacaaggctttttttgtaacattgatgttgattatttaagtgtgcagcaagtctttatacagtccgatattaatcttgggctcaatcctttgcatttttgtaacgaaaaagaagattaaataaaggcattatatatatatgaaactgtataggagcatcagcctggattttgtgttttacaaaataaaatcactgacaatactttggtctcccaaaggacggtgctttgttacctggcaacagtctttacgacactcatgatgtgttaactaaatatactttcagatcagcttccagatattgtctgatttatgagctgagtatttgaaatggttcatttcttctttttattacgtctattttgggaggaggaaagaagcagaggtgtaaggggataaagtggcagagctaccgcaaacacaaacaactgggaatatattagcagaggccacaccaagaacagttatttcccttttcatgcttcctgctgcctgcagtgaccaatgtgcaatcttggttttaaaacactaagtaacttgttttgccttgtctctcctaactttcttaaaagtaagctaatgaagaagcagcatctggagacactggctataatttgcatgttgtgtgtgtgcccaggtgtttaataaaacattaagataagtgctgtttttgagattcttttggtggtttctgctgactctttagtctctccaaaatcttttctgcatcagcagttttgtatttgatttggaacatgttctaaatattctccaccagagattagagagtgggcttgtagagcatgagtaaagaagttcaaagaaacggtttttgaggaccctgcgatgcttgttgtttctgtcaaaggaaagcagcacttcagtatgcatttagctattgagcagcaattactgaccgagttttcctcatggccaattattgctaggcaaaacgctctacaaaatttaggggatggcatttgctgcttaaaatgcatttgctctgactgaaatttgtattttaagacaactgatatgggttgtctggatgactgcaccactgattttgatactgttttaaggaatcacatatttactttttacagaaaaggaaaaaagaaatagttcctgtcatacaagaattttagtttagttgggttgtcagttttataaaagcagtttacctatctattttgtaggaaaaatagtcacgatttaattcacctattcctgaatcttagtcttccagtatttgagttattctatgatgtaaatatattaaaatgactattacataagaatccctatataggatatcagattgtgtgtgtgtgcgtgcatgtgtgtgtgtaaatactaaatttctactctatgccagggtcttttacaaatgttaattctcaagacaaagcttttaattgctatgtattatttataagcattttccaaatttgaaaacagaggcttataagtaatttgctgaatggatgaagttgtatgaagctgtagctattagcatcattggcacattgtctaacttcaattccagtattgtttgcaatattcaacttctctttaatgaaccatttaatgagaaataacaaatattaattaattattcgacagattgcatttctccttttcaataaaaagacatttctaatacatagtttattttaaattattaatagattttgtgtacttataatgcacatgtttaaccttcctttttgcttttgtatatgcagccctgtttatatgtgtaggttttgcgatataaattctaaaatatatcttcccgtatttgtggttgcattcctggggtaatgcaacaaacagtatgctgaaaaataaaaacagactttgtggtagtatttaatacaaatagttcatcttatatttcaagttgctttgcataaattgttatacacatagaaacttatttgtacaattataattttaatgttggtttgaaagtatgattggatgacagattataagagtaacataagtatttttgaaatagatgaaattactcagcacattgtcaaaataaagaaaatttattttatcgaatgctactcatttgcattcaatagtaataataataatttctaagtaaatatgcaccatcttcatcaaaaagtcttattttcaaaattcaaaataaatcaataatagtatacctcaaattctggtatggcaatcttgttctttaagtattattttgttctatttatagaaaccaaacttttggctaaacaaggaagtttttaaccttgccaaaatgaagagtcttatgctatcttaaaatatttagcaagagccaccagaagcacacatttttccaattttcactagttcttttaaaataatattatctgttccacacagtttccgcagaacaagagaatgagggaagcaattcatctgtaagaaagagggcagtatttacatttggaaatggataatgtgggcaaaaggtatttgtagagatatagggaccagataacaaatatctaccccagatgcaggggaaaagggtcagtgtctcaaatgattctgcataggggaatgttcaaaaagattgatgtaatggagcaagctataagttaaagcgttcagccctatagcatgcctccgcagtaagcactatgtaaagatgactgcccaaaatcagagcagtatcgatttttcaaattgaaaattacaggatttgtctaaatgtagctctttgttctcatgccatcatctttgtgattttgaagttttataggccagtgattgaattacttctattgtggagagaaaaagaaactgattgttaaagttgataattcaattatcattattacttagatgtgtaatttattcattttatgaacaagcaattagtttattttggacttggtttattcactttcaatctaaaacacacacatgtagcatttctgtgctggccacggcagcctcccagcttagctcccgaattccaggcagggatggagacagggccatggtttaccaggatcatatttaccattgcctctgagttacttttatataacctaaaacttatcatttcttagaaaataagaatacgtaatgtggaaataagaagaggtataaaagttaagattccaaaatatgtccaaaataatcattgagaagaacttatttttaagagtttaggagtttataacgcttcagtccctgttattttaacaagtaaccctttgatttaaaagtcaaagactatttattacaagatgtggaggcactatcccagcacagaagagttctcttttgttttaaagagcaaaagcaaaacccagaagaaaaccaaaaaaacaacaaaaaatggtgtgtaagtatagtattaggaaacactaaccattcttaaaaatcctgtctttcaggaaagaacggtgaccatcagaagacaaacagtaggaggatttggattaagcataaaggtagcctgcctttctagtctatccttacaaaggccatgccataagagctgaactttggtgcatttcaatgtttgctgattaataattagacaaggatggctatagcaaactccttaatatttggacggggatgtaaattaggtaggttctcacagaattcctgcaaactcttaccatttgatttagaaagtttagcaaagaatatgggaatttaccttatgattgaatttaactcattaactttctttgtctggtttttctgaaatgttaaatatgatgtcgtgtgcatatctttctttaaccaactggagtaggaaatgatgatctgcagtaaatagaacaataacaagtttcacactaataaagcccaatagtaagtgagatattgtattctgttcatcttgtttatttttcatttttaaaaaagaaatcagtaaatttaattgtatagtgctaatcatataggatagacttaaagtctttgcatatgctttattttaaaagtgaacatatgtgttcatttaaatttattatcaaattttaaaggcctttattttgtatattattgactattagagatgtaccatatctgcaatttattatcattgaaataaaggataaatttttaaagcataggaaattatgtaaatattgaagagttaatctcatgactgcaatgcctttgtcaaacctacatctcttcatagataaatgaagtttaactttataattattgggttagttatttgacttatatagggtgaaaataatttatatatttcaagtacacattgcttgaaatttcaacacaactcatgtcatatatttatggaaagcagaactctaaattttgtgaacatcagctctagttgactttgtgaaaatgactcagagtagaaatcagtatgcaatagcgttgtattgtcagtgataagaaaagaatattgctataaagagcactagcttcaaaacatattttgtacattcagtttatcaaagtgaaactttatcttatcaccaactaagaccagggaggcatgcagaacagattataggatgtgcaatgtattctatgagaatttaatcactcaataaatgagatttttttttgttttgcttttttttttttttttttggccaggctgtttattgagattgctgtaaagaatttaaaagtaccactaaagatactagaaaatccatgaataaaatccaatagtgagagctgatttcatctgaaatcatcatttttactgaaccaggcactaactctatttctggtagtagagcttccattaattttgtgtcacctagaaatgttcttttcctttttttgttgtttttcgtattttaaatttaaacccaataatgcaatgctatctatttttactaaaatgccacattttaacctagtttttaaagcatcaataatttttctaaataaagcttttcattttaatattttcattatttcaatccaatcaaaactattgtatatataataaatagaatattttttgaattaaataagtatgaattttccattcaattattgaccaaaaagtggtatttgagctatgatcaatatcttatattagagttaacaaaaaagaactttttgcaaaattcttatgacacactctgacaagaaatacaaacatcaagacttttatttagaatattactcattcatcctaaagaaattccttttatggttttttatttttactttctcatacttacctctgaacttcatttttctattttttaaactatcttttattgtgattatttagatcaaaatatgattctttcttttaactagcagtgttattacaaaaatctctttccctgtcatatatgagttgaataaactactgtgtttatttgttagcactattttccttagatctgagaatttaaaaaaatgtataaacttttttaaaaatatcattctaggctagaagcagaattagtattttaatgttgaactatttatttacagttttcaggagcaatttgagccactaataaaagtatgcatataaatacataaacgcatatcttaccactatttgcttcagttaagtaatcctcagcggcacacaccggaaagactcgtggtgagaattattaattaaaacctttatggtcttgacttaagatgacagaaggaagatggtatgttagacaactgaaaagccatttaccaatgtagttaagactcctacaggtgcttgtgaattccgctggactcagaacacatggtattttagttttatgttaaaaacacattctttaaaaaagaaaaaaacttggttaaagggtaatgaatgtcctttttagacagaattcagtcaaatgctctaacatgtgctgctagaagtcaaagccagctggccatgccctacactcttgacagatcttggcttggggactttcctgtcacagtcaccactgtgcagcatggtaattcctcacatctccccacaaactggacaaggacagtgtggtggggcttcttatgtaggtctgagtccattgttttgttgattaatatgtctcagcggctgtgggctgtgggcaacatgaagtctctgtagctaccagtgtccacaaatccttgatgtctgctgctcatgtgcaatattgctgtctctctcaagccctgtctccagccagggtaccttgtagggtacaagttggtgggaaaataaaagttagcctttaccttcatttttcttctttaccttatataagacattgtacaaacttctgggacaaaacgtgcaggtggcttggaggttgaggcagttcagtgtccctacggcttaattctaggactttaactcttcccttgatgtactaatgctagatatgatgcagaccacattgaggagggttcctatgtcaaaaattcctgaaatcccaaagaataagagaaaaatatatatttagtagaaatgaaaggaatattgaaacagctttacattttaaaaatatgacttaagtaagtccgaatcctttttcttttcaaattttgtctagttttctttccattattccttaatttttctctttaaattttttgaagcacattctttggagtttcttaccaaatctgagcctgtccttggaaagtcatacttaccatttcttcaaatcatctccaaaaatgctagacactcagtttgaaacaaagccacccaaaaagagttctgacatcaattacattgagatttagggtaggaattactgatttatcttcatggacttatttgtcctttagattcctaaactcctattgttttataacaggaatgttttaccattaaaaggtaaagaccaaaattgcctgtttctccatgttaattctaaataataagaaaaaaaaagcaaaagtaaagcccgaaatgacgtatgagcacaatgtccagctttagcgcatgctgcacatggaaaagcagatgccttgaccagggaggtgccacacacaggctgacactctcgcatccccatctcccagttttgatgaactatttgcactcagctcctaaagtgaaaagaaatcctttttaacctctggggagaatgtcccttcctggttgtgctactttctctgctttcttgtctcattctacagttattctttcattgctgtttagcaactgtagaaggatcaaatgagtaactgagccataatataatgagatgaaatttggagtcatgacacacatttgcaccggtccctccactgtctttaagtgaagcaaatccctactttagagcctggaaggagacagccatgcctccttcctctcttattagaacccttctagggctttatgcacctggctcactcctgctcccagccctccaggcatccttgcttatccaagatattctttctctcaggttgcctttcagaggcatcctcactcctgctgtaacttttgggattttttgacagtgatttagatttcttcctgcctgttattatttaattttcctttgttaaaacatctctcagaaatcacatacttgtgtgcctttttttctttgtattaatttgtctatcagtaaaaaaaaaaaaaaaaaaaaaaaaaaatcaagctcttcagtttacttttcacaaaaatttcaacaaaaagccctatctgggcttcccccaaagctggacaaaagaaccactaaactttcaactcataatcacatagtctgctgcctgttctcaggcagaaactgctcctttgaagcgggcagattcagcaggctagtggcatcctgcacatggcctcgggcctggctgcttttccctgcttgcagcaccatttctactggcatttcctggttcttctcccagccccaccaactcttgtctccttcccctctcaagtgcccatcctctgggctggaccatgcagagacttggcatttatataaataactttaatagtttcctcaactacatctgcagaaatcaccaaatttctgcatcgtaggatccaatattattgtattttgccttattcttcctatcgggattaccatagggatagtcatgttaaagcaagccatcgtcttgcccttgtgaggctttatttatctctcatatcttttaaaattcaatactatctagctgcacattattaaattatacttctgttcattgtcatttaaaaatttacctttgagggaaaggatgttttaaatgttattactataaatatattttatgcagtattttccaacagacacaattttcttatgaaaataataaattatctatgtccattaaataaatgtatgcaatcaaaggtgatttctatttggaagatttaacactacagcagtaaaaaatagaattataatcattattactcttaatcatcttctcatttctaaataattgctaatatttatgccccacttattaagtgccagtttctgagctaaatacttcatatttagttcaatttgcctttattatccagtggagtagataactattgttataccttccacagacaatgagattaagtgtcaagaggttaagtaattcatcaattgttataagcagtagagttggacctcagtccccctagaagccgatgacaaagtccttactcttaataactatgcttagaactataaaacctgaaataaattacctcaaaactctctactcagggacatagatcatgtttcctctctatgctgtttactttctggtttatttaaaactgaaataagaccaggcacggtggctcatgcctgtaatcccaggactttaggaggccaaggcaggcggatcatttgaggtcaggagcttgagaccagcttgaccaacatggtgaaactctgtctctactaaaaataaaaaaaaaaattatctgggcatggtggcacatgcctgtagtctcagctacttgggaggctgagacaggagaatcacttgaaccggggaggcagaggtcgcagtgagctgagatcacgcctctgcattccagcctgggtgacacagtgagtctctgtttcaaaaaaaattacaataaaataaaataaaacaaaactgaaataaatgtgtagctcaagtaagcaattttgtaagataaagggttgagtactagtcgtttcaaattttccaaataaaatatatatattagttgtaataaatgtatgccttttaacttattagtggtatctgggcaaaaatatttaaataacaaccattgctataagtgcatggacgtgcttgcatacatttttctgcattctgcttcccctgccatttttactcaagtctgattcacttgttttcactctagacaaaatgaatatgtccatttccatcataaaagtagataacagggacaggcacagggctcacacttgtaatcccaacattttgggaagccaaggcgggtggatcacaaggtcaagagattaagaccatcctggccaacatggtgaaactccaactctactaaaaatacaaaaattatccaggcgtggtggcacacacctgtagtcccagctattctggaggctgaggcaggaaaatcgcttgaacctgggaggcagaggttgcagtgagccaagattgtgccactgcactccagcctgggcgacagagcaagactccatctcagaaaaaaaaaaaaaaaagaaagagataacaagcatacagtaaagcttaaattgagggttatggattagtcccaaaaatgagttgaaaccactggtcaattatcatttcaaagaccattacattttttttcattacatagctttattgaggtataattccaataccatacaatttacccatttaaagtgtacaattaaattgtttttagtatatccgcagatctttgcaagtatcacggcagtcaattttagaacattctatcacttccagaagaaatctcatatttattcatcacccttttatcccctatctcccctctttcaaacctgagcaatgaccatttccctattttagactttcatatgaaggtaatcatatagcatgtgagaaagacaattattttttgccaaaatcaaacgaagtatgttggcaggtaacgatagcatccagaaggatgatggcacatgcccgtattcctccaggtgatattcctttacttgcctcttctgtagttgtccattgcagctcttaactctaattactgttattctgtttacaagtagtttcctttctctaaaaggaaaaatagtggttagctctatgcatcttccctgcacccccatgcccataatatgattgattgattaattgattggagtaataataatattgaactgaaaagattacttggcaagactcctgatgctctaaaagcattccaggttttatttggtggtatttcacagtaatgctagtaaaaccgttgtgtagagtcattctcaaaatgctttagatggaattatacatccttcttcctacagagctagctataaaatccactatgctttgtaaaaagattatcacaaagctgaacgatgtatgtgcgaacattacctgggctgtgctttagaacactgccttccttttcctaatcttgtatttctccataaactacaataacaatgctcagttaattcaagcattctctaaaccacagtcatgagccacagtcccgcccaggagtgccttggggagaagatggtgatgaaagccttgcctggacctcaggccatttatacttcagtaggaaagtagactttgatcaaattgttaccagaataaatgtaaatcacaggcatgatccagtgctacataagtgtattatttcaagtaaggagacactaaaggagggggctttaagccaaaatttcaaaaatgaacagtttccaggttaggagggaaggaggagcataactggccagacaacagtgcatgctgacatccttcaggttcagggcgatggaggtccaggagctacactggaagagaggcagtttaaaggttctcattattattcaactgtcatggaagcctatcacctgttttaaacaagccacatgatttgattattgactggaaaaccttacatttccccatttaggccctgcactaaatctaattaactgtagcagctgagctgctcacattttctccagtaatgaaggcagcgtgattttgagttccaattttatcttctgagttttgtcttaaaattcagtaattactgaagtcattttcagaaattagtttaaaaagtacatcagagctccaaatgtctaatttaaaagcaaaaaaaaaaaacaggccaggtgcagtggctcgtgcctgtaatcccagcattttgggaggtcaaggtgggcggatcacctgaggtcagggaggggttcaagaccagcctggccaacgtgttgaaatcccatctctacaaaaataccaaaattagctgggcatgatggtgagtggctgtaatcccagctacttaggaggctgagacaggagaatcacctgaactgggaagtggaggttgcaatgagtcaagatcatgccattgcactccagcctgtgaacagagcgagactccctctcaaaaaaataaaataaaaacagaaaaccaaaaaccatgtttggattcaaaccattcaaatttcaggataaattttacatataagagaaaaactgtggtaaaataagtgttacattttgcatttcaaagatggttacaatagtctccacttaaccttgggagatgcattccaagaccccagtagttgcccgaaactgcagacagtattgaatcttacactgcatataacatatttgcttacatatgcaaattcatgataaagtttaatttataaattagcatagtaaaatattaacaataactaataataaaatggaattataataatacactgtaataaaagttatgtgaatgtgcttcctttctctcacaaaatgttgtattgtactgtaccctggataactgaaaccacagaaagtgaaacacaaataagcaggggattgctgtacaagtctgggtgttgaggaaagaatgggattattgagtcaaccctcagaaaaactctatctcaaaagccttttctctggacaccaagaataggtttcccaatgtcttgccatggtaatttgcattaatagtctatgcatttaaaaaaaatgggttcagtagcagaataagagaaaagggtgaaatgcaaaaacagctgaaggaaaatactctgataacagcctcactgaggagaccagcaaaatcattgttgttccctgtcccaaaatatctgaatcacaatatctggatgattgtttcatggtttaattctacctaaaagttcatcagttaatgattcatttgagttaaccagctttttccttctaagaaacatagatgcatccttaacatcctttctaatttccaagtgtctctagaggctatcagtgaccttacgctgggcctggaaaagccgtagacttcattcattcattcattcattcaactcaacaaacatgtcaaagatagaccagacattattccaggcactgggtttacatcgatgcacaaaacaaactaccaaaaaatgtctgcaccctgaagaaatgtgcattttagttaggaatgggaagaagaaagaaaacaataagtgtgagaaatgaaaaaataacatgttagacactgataactgtaatgggacaaaatagaacagataaaaggggattgggaatttggagttctaactcataaatattaagggtcttagaagggattagtcctaatcttatttaccactttaatgctatgtgagtttcctcataaatcttaatacatgggctgtgttagcataatagccttcctttattcagtgtttactgtgtgctaaataagcacttgatttccaccacactgtcagccacaaatcactatctctgttcaggtcagaggcagggtcatcttagacacagtctgtgtttgttagggacacacagaccaaaaagcagaacaagtgggagccattgtaacctacgccagtaacttcccccacagagctgaggggtgcggtgcatgaatattaggttgctgtgaaatagtgaggaaaagggaactgagcagtgggtttgaaattcagtgagtaggacagttttcattaccttaattatcatatttcttcttaatattctggaattagaaaggactctacttgccaaaaaaaaaaattcaatattcctgcttttctaaaaaactattgactattttatatttaagtatactggcaattcagtgttaaaaatgggcatgcaagggaaaaaagaatatctcttccaaaataattttttatacttgaaacaaaagcttaggtggtttacatattctgaagatagaacaacctcaatggaattcagattgtcttttcaactaggctgtgttacaagttctatgcttctttttatatatgacattttattcttttatgtactgatttcatttctctactactgcttttaaccttctcaactctgtaatacagaaatgggattctttttccgtttttaaggatttattttattttctttcacataagtttagcttacttgtctttcttttttcatatctcatttagtcaactaataaatagtactactgcaggccgggtgcggtgactcacccctgtaatcccagcactttgggatgccgaggcagttggatcacgaggtcaggagatggaaactatcctggctaacatggtgaaaccccgtctctactaaaaatacaaaaattagctgggcatggcgcacctgtagtcccagctactcgggaggctgaggcaggaggatggcgtgaacccggcaggtggaggttgcagtgagccaagatcgcgccatggcactccagcctgggcaacagagcgagtctcctccgtctcaaaaaataaaataaataaatacataaataaataaataataaaaatagtactacttcaatattcttggcagtatgttttactctgcaaattgtttagtatgtgctttcacacaaggaggaattcaatactaaggaaggaaatgcagatgaatccctcatttttcatgcatatgtgcattctgattttgtttatccatttgttctggtaaaggtctctctacttccttggtatcccaacgggtcactgcaccaccaaaagcccttagctgccagcacagaataacttagcaggataacagtaatatataattatctggtgtttggaatcctaaataagaatttctattggatagcattgctacacattgaggagaatgcctatctaaatacataatcaatatttgttgataaatgaaaactttcaaagccaattgttattattggatgtctcagcaaaattctaaacaggtagataattttcatgggagcactatctacttagaggagaaattccacaagtttatttaaattctgcctaatatccacttaacattcccttcagagcctgtatggtttcttagctaaaagcagcattttttttagattaaaaagtacaatatatgattttctcttttcagggaggagcagaacataacattccagttgtcgtttcaaaaatctccaaggaacaaagaggtaatatgtttagagaattgtgtaccagccatttctttaaggcattgtttttgaagtgtgagatgatattcaagaatcctaaattacaatgtgattgactggctccagcttccccaccttcaggcattagtggctgagtctgcttcctgggtccttgccctttatcctcctgtgggagaggacttctctcacagaaggggaacaaggctgaaagataggaacccttgaaagcaggtatgagttagggactacacagcttttcagttgtttcattaaaccaacaaagatacaaaactaatgataacaagtcccatcaagtaaagacaatttcaagtgtctgtttttcagttctcatttgcaattttactcagctaaccattcataagaaactgtaggaaaaataatggagatataaagcagatgttgcaagaactgaaattagtaaaacaatgtaatgtttaaaaatgaacttggagccaattccatagctgacggattgaatgtctatgtcttaaacattttcacagagacctaataatcttaagtgcgtgagaaaatgtggtcttttacccttagaagagtggctcatttttagcaactgttaggtctgcaatagtaaaagtaaatggaaatatgtctgcatgtgcttcagtaattagactgagtcatattgtttcgaatttccattttttgtggatcttttaagatgctaaccatataagacacttaatttttatatttgtaaattttacctttatttaattaaaagtcctttcatctgcataacaaaaacagtcaatgcattatcaattgtgctttttcattcacagcggaactttcaggactactttttattggagatgcaattctacaggtatacattttatcactatatgtgtggtcaaaacattaactcaatttacaatatgccatgggaaactatgcttttcttttcattgcagataaatggcattaatgtgagaaaatgtagacatgaagaagtggtgagtttactttttcctaatgtcatagttttccccatgtgcaaataagaatttagtgcattgctaaagactgtcacttcattcattaggcagatatgacatttatccagtttgatatcaaattttcaaatgttctcttaatttttttttaaattagaaatagattaacgagtcctatcaaggatgaaatgtgttctgaagaattcttacttaaagatggtcattttctatgtttttccagtttttctatctacccctaccagtcaatgtccattaaatacaccactgggcgaaatacatctctaaatctctgtaaatgtttaaaagcttataaaccatacatttatgcctgtagaatctcacacagtacagtcatccctccctattcatgggatttcacatcggcagattcaaccaaccatctgtagaaaatatgtggggaagaacaataagaaataacaatcaataataaaaataatacaaaaaataatgactattacatagtatttgcattatattagatattgcaagtatctaaagattattttaggcatacaggaggatgtgcatagtttatatgcaaatactacaacttgttatataagggacttgagcatccacgggtgttggtatcctctggggtccttcctggaaccagtcccccacagacagattacctaggaacaaatggaagggcatataaagactgcgtgtgtgtgtagtctgtgtgtgtgagtttgtgtgtttctgtgtgtggggtggtggggagaaagagagagacagagagagagaaccttaacctcaaggcagacaggtttagcaatagacagagtagtcatccagtttttcggcagtattttcttagatttgtgaatgtacagattcccaagccctggaattagatattctaattcagccagtttgggagggcccagggatgtggattttagcaaccggcctaagtgtttccatcataagtggcctctaaattaaacttttagagaagctgaaaggttaaggaacttctgttgggggtggtgaaatgacattaaaaaaatacagaaaggaacaggactgtggtaggcattctaggacatgtctgtcgtggttgaataaatatcattcaaaaacctcactgatttctgtatcagctcctatgggaaagagtagaggataaatcgtatttaaaagtttatactcaaaggtgaaagaaaataagaaatactgtagtccttttgcttgtcacagctctagtttatttggtttttgaatagattgctcctctgttaaaagctatttagagaaaactatgttgatacatttcacatctaagagaggcaacctcaagtgtctgtgaaaagccacggctgcacaagaaccgagacgaaggagggtttttaattaggaacacttggcataactaatcaaggttttttagtatttgtcacttgtctttgtcttcttaaaatcttattggagtcatgctcttgccactctgtgctcaagttcatgtaaaatatacatatttcaattcccaagtttcctacaaatatgtgcaaaaaaactaatattttagaacaagtttgtaaacaagtgagaaaccagcacagcacagagccttctatcttgcagattcctatgtaaattttaaatatagtcacataagcaaagctgcttgtaacttgactcttttttcaaaagtacaaagtgattttaaactcattacccagggagtaaaaccaagtgcattctcttttaaaaccacatgctgttagacggaatgcaatttgcccttcagaggcaggcagcatgcttagacaaactgagatggagctttgattaaacagattagtgcagcatgaaagattagaacgcaccaataattccacttctgaatggttctcattctgttataaaggaaagaaatttgggattgtattgcaaattatatgtggtccttcacaataagcttttatttttttctgagaagcttaactctaccagctttgaaatatgagtactaatatttttatttatttctaatatttcactttccaacagctattagatgctttgtcctcactgcttattagctaagccagtagacttacacctcagtagaacagagatattaattaaatgtttaataatcaacctacaagggcagaaaaaggtataacaagctgagagaatgtaggtggttttgagctagcatgctgatgtaccacatttcttattccaaatagcatgctgatatgccacattccttgtaaaacaccaaattcagaaacaaattgggcaggtatggaagcatgttgtttgtgcatgtaacttttattttatatacctactctattccttgatgttagaaattctgcattcagtctatgatcagctttactgtcaaacagtcttcaaaagtgtaaatgttacttttgtgttggagttatcaggtttgatttatatagaagggggattttacattgttcaggtagtggacagtacctggtgctgtgagcagtaggtgctcagtagatttgtggatgggattctgtaaccaaatgcctagaattagatcatggaagcatttacatctactgtatatatttctcatgggaccagtacgggagtgtaagtgaagtcctggcttcaccacatcacccactgtattcttgctggaagattgttaaggaagagaagctcacagtttcctcatgaaaggaaactagaaccagtgcccagcaccgcttggcatgcagcatggtgcacacatagggcttcaatgctcagaaacaactctgcaaatcatagctcaaccacttacaaacattgtaatttaaggtgaacggaatgaactaaacttttctatcactctattatgtattcataaaaatgaaccattaataaatgttatgggaatgaatgagagtaccatatgtgaaactccaagcatatacctggcaattaattggtaatacattattttgatggcaccaaatgccaccgctcacatgctgctgctcttctccctattccccctccgtgggcactgctgtgtcaaggtgggacagggtctgcttaggagccatgatgggccctggggggtcacacacagacagagccaatgctgctgctcagcatcccatgcttcctccaacaattccagtgaggagttgacatggtcaagagtggcacagcaagagtggcaagactgtgtgaaaaatggggattccttgttcattctagcagtgtgtgtttttattttccatgtgaacacgttttggagcttatgagttgtacctccaagagaccaaagcccatcaaggaaaatgatctattgccactactgatgttaattaacactgatgctattctccttaccactgaaccctagacatattaagctgatggccatctctatatcttgtcatctgtatttttcttttgcttaacaagtaaactgatcacatatcaagaattatctgggccaggtgcggtggctcatgcctgtaatcccagcactttgggaggccgaggtgggcagatcacgaggtcaggagttcaagaccagcctgaccaacatggtgaaatcccatctctactaaaaatacaaaaacattagctgggtgtggtggcatgcacctgtaaccccagctaatcaagaggctgaggcaggagaattgcttgaacccgggaggcggagattgcagtgagctgagatcacaccactgcactccagcctgggtgacagagcaagactcagtctgaaaataaacaaacaaacaaaacaaaacaaaacaacaacaacaaaattgtctgagtggctgggtggcagggcgtggtggctcacgcctgtaatcccagcactttgggaggcccaggagggcagatcacttgaggccaagggttccagaccagcctggccaacatggtgaaaccctatctctactaaaaatacaaaaattagtcaggcgtggtggcgcacgcctgtaatcccagctactcaggaggttgacgcagcagaattgtttgaacccaggaggcaaaggttgcagtgaactgagatcgtgccactgcactccagcctgtcagacagagctaaaaaaaaaaaaaaaaaaaaaagaattatctgagtgccatctatgtgaaaagcactgagactgagtactttctgaggctgagtactttgtgtgataagaaagaatatataaataactgtatatcgctgtaaccttattggtatgtagacatcatttctttagattttaataattgagtatacaaaaattttaagaaaactattagaaaggggcaatatgaaaacaatgtttatttacaatggtctttaacatataacaatggtgatcttcctctcttcactagaaataatagtaaataagatttaactatagcagaaaagtatttgttgagtaaaaagcatcctggttctaataggataatctattcgtataactgaaatttccatctaatgagacttttgaaagagatcatcattaggcaaagcaagatggatgcatagctgattccagaggtttccttttaaagtagcatttctgctttcagacttgagatttatgggtttcaaaaaaaatatgttcatctgctttttgtttctatgattctcatgaatagaatttattaggtaatttgaattgcaaaaattaacacctaattctgaagtcatgattttgaactaaactctaaaaacattcataattctacataattctaaaagaacagactgagtaactaaaagtatgtaatttaaaatgacaccttcatacagtgaaaacaaatgctgataaaacctaatgcaaaaatcctggctaatagcattttgcttgttatgatatatgcctaagtcaatttaaaatttccactggagtaggaacatattcttttttactttagattaatcagacagaaacaatacaagagttataacaaattatctggaaaaaggcataaatttatatattggaacagtctaggaggttttatatgtcaccaaggaacatatttagcatgtgagttgagcacaaagatcattttagattaaaatatcatgaggcacaaatcatgttttacctaactgctaacgattacattgtttacaatctggaaataggttttgagctctaagtgattaatactgccttaagaattctaaccatactggatagtttttctttgaattaacttccaccaaggaaagctatatacaatgtaatttaactttgaatatttctcagtgctctgggaaatgtttagcgcaaagacaaaaggccagaaatgctgtctacactatgtctgcttttgaaaagaaataaaatatccttgccttattttcatacttagctttgcattaatacttttagggatgccttttttgctagacccacatgtccgtcccctgtataagctatacatccagacagcacaggtgacattttaatgactgcatgcttgtactcctgactgctgattcttatcaaatctttatttgtcctcttattttttgagtgaagttgaacaacttagagaactgaaagacccaattttgcaaagctccatctagtccatcccctcagctgtaacaaaatacttgtaactgggtaccttataactaatagaggcttttttttttccctcacagtcatggagactgggaagtccaagattaaggcaccaacaggcttggagtgcactgagggctgctctctgctttaaagatagtgtctttttgcagcctcctctggaagggatgaaagctgggtgggtgctcacatggcagaaaaaatttgaagggccaagtagctctctgaagatcttttatgagagcattaattctgttcatgagagtgaaacactcctgatttaataacttcccaaaagacaccaccacttgctaccaccacaatgggggtcaagtttcaatataaaatttagagggacacaaacattcaaaccttagcaccttctaataatgagacaaaaccaggcctgaaaaaccaattacttaggagggccccagccgatttccttggagaggagtctaaaaacaggatacatctcagaaggcacacctaaaccaggtcaaattgggaggagaaagctggcagggcaggcatgggtgagcctgcaatcccttcacacattctgcaaggatcttctcagacactctcctgtctggggggttggaatgaggaatgcgtgttatacaaattccaaaattttcacatagctgacattttattttcacaataaccagctgatcaaactgaaagccaaggagaagaaaccgtatgacaacggagattttaactcaaggtaaaagttttgtcacactttccactgtttgatgttgataaagggcctcattctgtcttgccctcgtttttctcatctgaaggattaagaggtcgcagtagattattgcttaggtctttttcaggtaaaatcttcagttctttcattgtcaaagaacacaaacatttgttaaagcccacagagctgcagcacacaaagaggaacctctaatggggctaactatgggcctcagtggatgacaacgcatccacactggctcagcgatggtcacaaatgcaccatgctgatgcaagatcttaataagaggggaactctttgtattcctgactctttccgaattctctatcaaaagacaattttaaggccttcccaaggagcaaatgtacaattttaagcaaatgaatacagagatgtgagattaggcaaaatgtttttacttctctccccttttgaaacactttttatatgacaatgaataactctttaaaggtaaaaatcatacagataaaagaggaggagaagagaagacagggggcaagggttgttggtaactttatttaagaatagagagcagatagacaagacggggggaatcctgaagggccaaggggctgtagccaaagccgccatccagcaaacatccccactgcaggcctcagacagcaatcgcgaatgggagtgttgaaaggaagggttgaagaggtgtagccaagaacaggcaatcgaattagagttcaagaggctctgagtattcagccccaggcactgccataagtacagcgaaaggtacattctgggcagtaagtggtctgcgtttgtccttctttcagctctcagaacactggcagccggtttcaccactcagagaagaggtgagaggattcttttttagtgaaattgatctaacagaaataatccacaaatagtacatttggactctcctgttgcaaacagggttcaccctaaaccacacagtggagcccagtggataaaccatgaatcctgtacccaacgctgtcaatttgcttttcagtgtctcactctcaaatattttgtaataccaaaggatcattaagatttgaagaaaatcaaccacatcaaaggcagaagctaaaacaggaaaaaaaaaactgaggaaacagacaaagcaaggtttattgaacaaaaggattttatattgtaatattttcagatagatggtgaaaattaatttgtaaatgaattaatgctaccattatatataaaaggaacatgcagaaaaagaagagctcttggatattaacactttgatatctatcttcaaaaattagattacaaaaatgttgggaaacatctcaaaatggaataaagtagcaaacaagaaggtgatatgacagacaaagaatatgagagatactacattcaataatttttacactgaaccaatggaattcagaaataaaatattacatgaaataaaaggagcatccattatcaaaagaataatacaagaaaaatatccagacttcttgtatatattttccaatagaaacacactaccaattaaaaaaaaataaaagcattttacatgtctacacttgccatgaagtagcatcacattttgatattactttgcattttcctaatgactaaaagtattgaacattttttcttgtgtttgttatatatgccatatcacttttattaattgggttcacttcttactgatttctaagagtttgtttacataatctggccacaagtcagatatacaattcgcaaatattttttcctagtctgtggcttagtctcttcaattacttaatggtattttttgaagcttaaaggttttgactgttaataagtctactttatcaatattttaattttgtcagttgtgcttttggtgtcttagttaataaatcttttcctaatctaaggccatacagacttactgccatgtcttattctaacggttttatagttttaactcttgtatttatgtctaggttcaattttgagttaactttcgtatacagtaaggtaaggtgtcccatttattgagaagactattctttcctattctattgccttgacacttctgttgaaaatgagttgccctaaatgttagagtttatttccaaattcttaatgctgttccattaatttattcacatataccagtattacattcttgattcttgtaactttgtactatgttttgaaattaaacgttggtaagccatcaaactttgttctgtttatatctgattgttaagcaaactatttgtattagaatggttttagtttttatttttattttttatttgagcattttatttgaatcatcataagagaggaggtaattaaaataaaatattcgaatatatatttattttgaattttcatgtatttttctccaaatgaaatataccctttttatgcaaaatgatatacattttttctttttcaacttttattttagattgtggaggtacatgtgcaggttttttacctgggtatactgcatgttgctgaggttttgggtatgaaagacccgtcgctcaggtagtgagcatattactcaacaataagttgttcagaccttgtacccctccttccctcctgcctcagtgtctattgctgccatctttgtgtccatgagtacccgatgtttagctcccacttacaaaagaacatgtagtatttggttttctgttcctgtattatttcacttaggataatagcctccaactctatccatgttgctacaacagacacgatttttttcttttttactgccatataacatttcatggtatacatgcaccacattttctttaatcttcccttggtggggacttaggttgattctgtgaccttgctactgtgagtggtgctgcaatgaacaagtgaatgcgtgtgtcttttctgtaaaatgatttgttttattttggatatatacccagtcatgggaatgctgagccaaatggtagttctattttaaattttttgggaaacctataaactgctttccacagtggctgaactagtttacattcccaccaacagtgtataagcattcccttttctctgcagcctttattaacagacattctgaatggtgcgagatggtatctcctgtgattttaatttacatttctttgatgattagtgatgatggacatttttaaatatgtttgtttgctgcttctatgtcttcttttgagaagtgtctgttcatgtcttttgaccattttttaacagggtcatttgttttttgcttgttctattgttccagttctttaaggactctggatattagtcctttgttggatgcatagtttgtgaatattttctcccattccgtaggttgtatgtatactcttttgatggtttcttttgctgtgcagaagctgtttagtttaattaggtctcacttgtcaatttttgttttcattgcaattgtttttgaggacttagttataaattctttcccaaagccgatgtccaaaatggtattttctaggttttcttctaggatacttacagttcgatgtcatgcatttaactctttgatacatcttgagttaatttttgtatatagtgaaaggtaggggtccagtttctttcttccgcatatgactagctagctattctagcaccatttattgaatagggagtcctttcttgattgtttatttttgtcgactttgtcaaaggttaaatggctgtgggcatatggttttatatctaggttctgtattctggttttagattgacagaaaattgcaaagatactaccaagaattctaatatacccctcacacatatttccctaatattaatatcttttgatattatgaaattattactaatatattactagtaagaaaagtttgcactttattcagatttcattagtttttacctaatggctttttttttcctcttacaggatcccatcagaatacacattgcatttagtagtcatgtctcttcagggtccttgcttttaattttttgatgactttgaaagttttaagtagtactggccaggttgttttgtagaatgtccttcagctgagatttttctggtgtgtgtgtgtgtgtgtgtgtgtgtgtgtgtgtgtgtgtgtgtgtgtgactgtactgggtttatgtggttttccagaggaagaccacggagtgaaattgccattcttatcacatcatattaagagaaaactaccagcatgacttattaccattgataataaccttgattacctgtctgagatagagtttttcagaattcttcattgtaaatgtatttttttctgtccagactatgttttcaagaagtatgtcactatacccaatgccaattatgcagttgaaaactgtgctttactgtgtgagggcaggctatctacataattatttagaattctgttaacatagatttatctattttctcaatttattatttatctgatcattttgataaatcactctggatgcatatatatttattttatactttgggatgtaatccaatactatcttatatattttactggtcaactggttccagttttgggtattgggaactctttctgtggacttcagtgtcacttttaaatactctaatatagtaggatttgctgttgttgttgttattgtttgtttgtttgttttgttttgttttcagcacctcagcttctggcactaacatacttttcaggctgatcttgcatatatttcctgccagtctaagaatcagacatttcccctagaagttctgcttgcctttattagagaatggtactagaaatcaaaatctggattctagatgtgcaaagtagtggtgctttctaggccttctcagctaggaaggaaacatgtgtatacatgcctgttcatatacacatagaggcataccttggtgatactgtggggttggttctagacactgcagtaaaagaccacatattcggtacagtgtactctgctccaatgacaggtgcaccaaaatctcagaaatcatcactaaagaacttacccatgtaaccaaaagccagctgtacccctaaaactattgaagtcaaaataaaaaataaaaagataaaaaagagaatatcacactaaagtgagtcttgtaaattttggtttatgaaaatatctatatggaagtacatatacaagttatatttaaaatatactatagtctattatgcatgcaataggattatttcttaaaaatgtacataacttaattaaaaatatttaattgctaaagacactaacaattatcttagctctcagtgagtcataatctttttgctgggatagagtttgcctcaatgttgatgactactgactgattagagtagtggttactgaaggttggggtggctggggcaatttcttaaaatagaacaatgaaatttgccacatctattggctcttcctttcatgaaaaattttccgtaatgtgatgctgtttaatagcattttgaacttctttcaatattggagtcaactttctcaaatcctgctactgctttatcaactaagtttacataatattctaaattctttgttgtcatttcaagaacgttcacagcatcttcaccaggaagagtttcctttgcaataaaccactttctttgctcttccatacaaatcagctcctcatgtattcatgtgttttcatgacgtggcagcaactcagtcgcatcttcaggttctactctttttttttttttttttttttttttttttttttttttttgagacgaagtctcattgtgttgccaggctggagtgcaatgacacgatcttggctcactgtaactgccgcctcccaggttcaagtgattctcctgcctcagcctcccaagtagctcggactacaggtgtgcaccaccacacccagctaatttttgtatttttagtagagatggggtttctccatgttggccaggctggtcttgaactcctgaccttgtgatccacctgccttggcttcccaaagtgctgggattataggcgtaagccaccacgtccagcccagattctacttctaattccagttctcttgctatttccactgtttgttgttgtttcctacactgaaaacttgaagccctcaaagtcctccatgggggttagaatcaactttttccaaactcctgttaatgttgatattttggcctcacccataaaacagaaatgtttttttaatggcatctagagtggtgaatcctgtccagaaggttttaaatcaacttggcccagatccctcgtaggaatcactatttttggagctatcaccttacgaaatgtatttcctaataacaaaacttgaaagttgaaattactccttgatccatgggcttcagaatggatgctgtgttaggaagcatgaaaacaaaattaatcttattttacatctccattagggctcttgggcgagcaggtgaattgtcagtgagcagtaaccttttgaaaggaatcttattttctaagcagtacgtctcaacagtgagcttaaaatatttagtaaactatgctgtaaacagatgtcctgtcatctaggctttgttattctattcctagagtacaggtagagtagaattagtttaattcttaaagtcgctagcattttcaaaatggtacacagacattggcttcaacttaaagccaccagcagcattggcccctaataatagagccagccagttctttgaagcattgaaaacagacattgacttctcctctctagctatgaaagtcctagaaggcatccagcagaaggctattttgtctacagtgaaaaattgctctttggtgtagtcaccttcatcatttatcttcactagatttcttaataacttcctgcaacttctctatcagcacttactgcttcacctcgcatttttatgtcatggagatggcttctttccttaaacctcatgaaccaacttctgctagcttccaacttttcttcttcagtgtcctcatttctctcacatttcatagcattgaagagggttagggccttgctctggattaggctttggattaagtggatgttgtggctggttagatctattcagacaactaaaactttctccgtatcagcaataagcttgtctcactttctcaccatttgcatcttcacttgagtagcacttataatttccttcaataacttttcttttaaatttacaacctggctaactgcttgtgcaagaagcctacaatttgccctattttgccttccaataccccttcctcactaagtttaataagttctaagttttgatttaaagtgagaggtgtgggaattttcctttcacttgaacacttacaggccatgacagcataattacttggcctaatttcaataatgttgtgtctcagggagtaggaaggcctgcagagagggagagaaatggggaaatgaacagtcagtagaacagtcagaacacacacatttatcaattaagtttgctgccttatacaggtgtgatttgtggcaccctataaataattataatagcaacaactaagatcaccgatcatcaagaggctgatgcaggaggatcacttggactgggaggtggagattaaagtgggctgagatcacaccactgcactctagcctgggtgacagagtggaactctgtctcaaaaaacaaacaaacaaacaaaaaccaaaaaacaaaaaacactgatcacaggtcaccataacagatacaataatatctgttaacatagtatctgttaaataatatctgaaaaaagtatccatttttcaagcagtttgactaactgaaaaagtcaaaatattgtgaaaattaccaaactgcaacccaaagacacaaaatgagtacatgctgttggaaaaaaaaaaaaaatgctctgatagactttctccacacaggcttgttacaaaccttcaatatatgaaatatgtaatatctgcagaggtcagttaagtcaagcacaaggaaacaaggtgtgcttgtatctattcatacacatttctatatgtaactaatattagctactcctgagtttatactgctgtctctaactcaaccctttatcacatgaaacaccacagcctcctccccttgctcatctcattctaacaaatggttatattatctgtcattcatttatttaattgttcaaatctagtatatatgtacagcagtatcagaataagccactccacaatgggaaacaattttatcaggtagagtagaagaattatgctcagtccctttcccctttgtcttacagaccttaagtgaagttgcttcaaacatttgtaacacaataagattctcttgtcacattctgcattttgtcatatctcacaacctcctaagttgtttttattctaagattttcacacactgaagttaactctttgattgtaaattcaatgggttttgacacctgcacagtatcatgtatgtagccactgttacaatgtcatacagaatagtttcactgccctaaaaaatcctctaggatccatttgttcctactatcctggccatggccttcaggaagccatggatcatttcactgtttctgtagtttttcctttaacagaatgccaagtaattaaaattgtgaaaatctagcctttttagattggcttttttcacttagcaaggtgcatttaagatttatgacttttttcctggcttgaaagctctttttgttactgaagaatatcccatcatatggatgcagtataatttgtttatccattcacctgttgaagggcatcacacttgcttctactatttgtcaattattatatgaagtgctataacatttccatgcaggtttatgtgtggacatatttttagaaatcaattggctcagaaggcagtttctgaattatattgagagactatctttagctttgtaagaaactgccaaactgttttccaaagtggctataccattttgtgtatatgcctgtagtaaatgaaagttcctgttgccctacatgcatgccaacattgtcattcattgacataaaaactaagtgtcaagctcaaggttattttatactccactttcttttagaattttatagtattgcattttaaatttaggtctattattaattttgagttcatttttgtgaaaggggtaacacttatatttaatttaatttttattttttgcatatgactttctaatagtttcagcacatttgtcaaaatcttaccaatttcccattgaattgccattgcttctttgttgaccagttgtttatatttatgtggagctatttctggtctttttgttctcttccattgatcatgtgtattcttttgccaacaccatgctgccttaattattgtagcttaattgtaagtcttcaaattgggaaacatgagccctttaactttttctttcccaatattctgttgcaatttaaagtcttttgctgtttcatatacattttaaaatcactttaaaatatctacaaaatagctttttggattttgatgggaatttcattaaattcattgatcagtttgagaaaatcagcatctaagcaatgttgagtcctcgaatccatgaacatggaacgtctattaatttagattgcctttgctctatcagcagagctttgtagttttccacatataattctgtacatatattgctaaattttgacccaggtacatcaattatttggtgttattgtaaacagtattgtttttctaacttcaaatttaaattgtttattgttggtaagtagaaagcaattaacacttgcatattaaatgtctatccttctaccttgctatacttcttcattagttctaagaggtgtcgtgttttgttttggttttgcttctggtagattttttgatatggtgggtttgtctggattgcaaactttgattcatacatgcttaactggaataaatctcatttggtgtgatgtataactctttttatacattattcagtttgatttgctaatattttattcacaatcattgtagctatattcatgagaaatattgctcttaatttttttgtaacgcttttaaaaacttttgtgggtgttaggttaattatgttatcacagaatgagttacaaactgttgcctctccttctgtgttctagacaaaatagtggaggattagtattatttcttcattaaatatgtgatataatttactaacgaaactctagatttcgtgctttctttttgtaatgttattatttattcgttaaatatctttaataaacataggccattttgtattatctatttcttcttgcggaaatttacccagatcatgtaagttatcaaatctgcgggcatagagttgttcacagtgttcctctattagccttttggtatccatgggatcaataagtatgatccctctttcatttctgacactggtaatttgtatctttctctctttatttcttggtgagtttcctagcaatttctcattttctttatcttttcaaaaaacaagcattatgtttcattattttttccctgttgttttttgtgtttgctttccatttcattgatttcctctgtagtttttgttatttgctttctttttactttaggctttgattgctgctttttctaattctgtattgtgagagcttagatcattgattttaaccttctttactaatacatgcattcaatggtttaaatttatctctaagcactgctttgcctgcatgtcacaaatattgataagatgtattttcacttttattgagttcaaaatatttttaaattctcttcagacttcttaatgactcacatgctatatagaagagtactgattaacctccaaatagctggggatttttgaggtctctttattttactgatttttattttaaattcttcattgtctgggaacgtatttgtataataaatatttttttttcaaaaaatagttaaaatttgttttctggcatagaatatagtctgcttttataaattttccatataagcttgaaaaaagtatatgttttgctacctgtaaatggtatattctataaaagtctattataacaatagtactgttcagtccaactgtatttttaaaaaactgctacctgcttgaactatcagtttttgaaaaaatgccattataggctaaaattataataaacatatatttctcctttcagttctatcagtgtttttgccacacatataataacatgctgttgttagattgtctaatattgctatgtcttctttgagattctactggtttatcttacttaattcctcacttaatcattatttcattcccccccttagctttagtaattctccttgctctaagtcctctttgtctgtaattaatatatctcctccagctaccttcattaatgttagcaaagtatatttttctccatctctttaccttaaacctataggagtcttcaattaaaatgggtttcttgtagaagttagagttgggtcttttatattccctagataatctgtcttttggttgcaatatttataccattcaaatataaagttattgatgtaactgaattaatatccaccatgtttgtaatgtttctctatttattgctttggttctttgttcccctcccccactcttttttaacttccttggtttaccttaagcatttgagtaagcccactacatccttctcttattgtatcaattatgcttttgaaaacaattagtgtttgttttagtttccattatgcgtttttaaaaatctgtatgcattttcagatagcactgtgctgcttcttcatgtgtagtgcaggtaccttttaacagaatgttcccaattcctccctcccatctcttatgacattactataatttattttacttatccataatctttaatcaccccacatattgttagtactattattttatacaaagagttaagttgacaagaatgagaaaagcaagatagtttatttacttgcgtttattctttcattggcattctcctttgcttgtgtgtatctgagcttcagacttgtgtcatttttctaatccctgtaggaattcctacatttcttgcagtggagagttcctggcaaggcattttctactattgtttgccggattaagtgtttattcctctactttagaaggacagttttatgggacacaggcttctgttggtgtcgtttttgttttcagcaattgacatgattcacttttttctcctcttgttttcttgggttctaaggagacccagtagtctcaggactgcactccctattcccctgctgcgtgtccacccccaccacggtcagggttccatactgcagtcaggttctgccagcatcctgaaaaccttccagaggcttcccagcatagaaaaaatgagtgcaaagtcattatctgggcttcagcaactccagtattcaaaattcatctaattccttcaccctctaacccagcatgtgccagcccccactcccccacttttgttggggctcacactcaccttaaggcctttgtccttgtcttcttttcctgcatttttctcccctgatctcttcatggtttagattcttgtcattcagaccttagattaaaagcctccttattgcaggcatggtggctcacgcctgtaatcccagcactttaggaggccaagatggtcagatctcttcaggccaggagtttaaaatcagcctggccaacagggtgaaaccccgtctctactaaaaatacaaaaattagccaggcgtggtggcgtatgtctataatcccagctactcgggaggctgaggcaggaaaattgcttgaactgggaggcagaggttgcaatgagccaagatggtgccactgcactccagcctgggcaagagagaggctgtctcaataaataaataaacaaacagttctccttatcacagaaaccttctctggtaagtcacacaatagaagccgtttgccattttgggctgcccagcgccacacaaacattcttatatgagggaacattccaagacaattgggaaataggtccttgtctagaacaacaaaaatgaattgaaggaatataaattcccccattaagttctctacaaaatagaatgttaacaaagcaacaaagtttagccgaacctaatactcccagtaatgaactttaatcctaagaaataagagtgaaatgtcaatatgagattatgttctgtgccaaaatggccaagacattgtgtccagaattggttccttccggtgggttcttggtctcgctgacttcaagaatgaagctgcagaccctcacggtgagtgttacagttcttaaagatggtgtgtctggagtttgttccttcagatgttcagatgtgtctggagtttcttccttctggtgggttcatggtcttcccgacttcaggagtgaagccgcagaccttcgtagtgagtgttacagctcttaaaggtggcgcgtccagagttgtttgttcctcccggtgggtttgtggtcttgctggcttcaggagtgaaggtgcagagcttcgcagtgagtgttacagctcttaaatgtggtgcgtccggagttgttcattcatcctggtgggttcgtggtgttgctggcttcaggagtgaagctgtagaccttcgctgtgagtgttacagctcataaaggtagtgcggacccaaagagtgagcagcagcaagatttatgacaaagagcaaaagaacaaagcttccacagaatagaaggggaccccaggggttgctgcagggggctctggtggccggcgtttattcccttatttggccccacccacatcctgctcattggtccattttacagagagctaatttgtccattttacagagtgctgattggttcatatttacagagtgctgattggtgcatttacaaacctttagctagacacagaatgctgattggtgtgtttttacagagtgctgattgatgcatttacaaactttagctagacacagagtgctgattggtgcatttacaatcctttagctagacagaaaagttccccaagtcccaacccaccccagaagcccagccggcttaacctctcaacatcagtgccacagcataaatgtccaggtgtcagccgtggtagaaacatcccaagcaaggtgtttaaaaatcatataatttttttttttttggagacacccttgctcctatcagagtgtgtttcaatagacattgcttcaattttatgagctaatacctttgcgatatacttatagtctatgtaaattaaaaattgtcatctatgtataatactacataggaaataatactaaatagaaaacagcaagatattactacaaccttattagaatggctacaattcaaaaaatcaagcatatcaaatgctggcaaagatgcaaagcagcagaaactcattcactgcagctagaaatgcaaaatggcacagccactgtggaaggcagtttgacaatttgctaccaagttacatattatcttagcatacaatgccacatgcccactcctaagtatttatccaagataaatacaaacatgtccacaccaaaacatatacaggaatgtttgtagcaggtttattcataaccaacagaaactgaaaccaagaaagatgtcattcaacatatgaatgaaaaagcaaactgtggtaaaatgaaatactattttggaataaaaagaacacagactacatgaccctatatgtagaaatccctaaagagtccataaagcaaagttagaactaataaatttagcaaagttggcagattgaaaattgacacataaaaatcagttggatttctatacactaacaataaactacctaaaaacattaaaggaaattttatttaaaatagcataaaaataaaatatttaggattaaacttaatgaaggaggcaaaatatttttacatagaaaactcaaaaatatttctgaaattaaagaaagtacaagtaaatgggaagacatcctatattcatggactgggagagaatttttattaatacatcagaactacccattgtaatttacagagttggtgtgatctctcaaaattgtgatggtgtttttctgagaaatagaaaactccattctaaaattcatatggaattgcaagagacaccaaagagcaaaagttatattgaaaaccaggaacaaaatcagaggcattacacttcctgattccaaaacttattacaaatctacagccaaaacaatgtggtagtgatataaagacaggcgccacattgtagatgtgatgaagagaatagttagctcagtaaacgattttaaataacattttaaagaccattcaattaggaaacatagtcttttcaacaaatggtgttgggaaaactggatatctatatgtgaaaaaattaaactggaccattgcatcataccatataaaaattaactcaaaatggatgattaaagatctaataagacctaaaaaaatactaaactcatacaagaaaacagagaaaagctttataccatcagattaggcaaggaatttttggatggaacaccaaatcacaggcaacaactgaacagatagataaattgtactaaatcaaaatgaaaaacttctgtgcatcaaaggacacagtcaagagagtgaaaaaggcaacctatggaatggcataaaatatttgtaaatcatatatctgataagaagttaatattcggaatatataaagaactacatttaacaacaacaacaacaacaacaaaaaaccttacccaattaaaaactgtctaaaagacttgaatggacatttctccaaaaaatatacacaaatggccaaaaaaacatatgaaaaaatgctcaacacactaatcgttagggaaattcaaatcaaaaccacaaagtgatattctcaaaccagttaggaatgccactattaaaaacaaaatcaaaacagaaaacaagcgttggcaagtgatatggttaggctttgtgtccccaacctaatctcatcttgaattgcaatccccacgttccccaagtgtcaagggagaaaccaggtggaggtaactgaattatgggggtggttttccccatgctctgctcatgatagtgagtgagttctcaggagatctaatgattttataaagggctctttccatttcatttggcacttctccttcctgctaccttatgaagaagatgccttgcttccccttcaccttctgctataactgtaaaattcctgagggctccctagccatgctgcactgtgagtcaattaaacctctttcccttaaaaatcacccagtctcagatatatctttatagcagtgtgaaaattgacagatacaacaaagatgtggaggaattaggactcctgtgcactattggtggaaatgtaaaatggtatagccattatgaagaacagtatgatggttcctcaaaaagttaaaaacatagctaccatatgatccagagtgtctcctctgggtttatattcaaaagaattgacggcagttgtgaagagatgcttgcaatcccatgttcatggaagcatttttcacaataaccaagaagtggtggcaatccaaatgttcattaacagatgaatggataaacaaaatgtgatatatacttgcaatggaatattattctcccccaaatggaaggaaatccttttacatgatacaacatggataaaccttgatgacattatgttgagttaaataagccagtcacaaaacaatacatcctgtatgaaaccacttatatggggtacctagagtaataaaactcatagaagcagaaaatagaatagtgttttccagagcctgggggaagaagggaacagagggttattgttttaggggtatagaattttagtttttaagtttttttttttcttttccccactggctccaccacagaggtgcaacggctccatggagtctagagtttcaggttttagagttgaaaacattgtgaatgtttgttgcacaacagtttgaatatacttaaaactgctgcacacttaaaaatgattaagatggaagaaaacctaggcaataccattcaggacataggcatgggcaaggacttcacgtctaaaacaccaaaagcaatggcaacacaacccaaaattgacaaatgggatctaattaaactaaacagcttctgcacagcaaaagaaaccaccatcagagtgaacaggcaacctacaaaatgggagaaaattttctcaacctactcatctgacaaagggctaatatccagaatctacaatgaactcaaacaaatttacaagaaaaaaaaaaaacaaccccatcaaaaagtgggcgaaggatatgaatagacacttctaaaaagaagacatttatgcagccaaaagacacatgaaaaaatgctcatcatcactggccatcagagaaatgcaaatcaaaaccgcaatgagataccacctcacaccagttagaatggcgatcattaaaaaatcaggaaacaacaggtgctggagaggatgtggagaaataggaacacttttacactgttggtgggactgtaaactagttcaaatgttgtggaagtcggtgtggcaattcctcagggatctagaactagaaataccatttgacccagcaatcccattactgggtatctacccaaaagattataaatcatgctgctataaagacacatgcacacgtatgtttattgtggcattattcacaatagcaaagacttggaaccaagccaaatgtccatcaatgatagactggattaagaaaatgtggcatatatacaccatggaatactatgcagccataaaaaatgatgagtccatgtcctttgtagggatatggataaagctggaaaccatcattctgagcaaactatcgcaaggacaaagaaccaaacaccgcgtgttctcactcataggtgggaattgaacaatgagaacacatggacacaggaaggggaacatcacacactggggactgttgtggggtggggggaggggggagggatagcattagcagatatactgaatgctaaatgatgagttaatgggtgcagcacaccgacgtggcacatgtatgcatatgtaacaaacctgcacgttgtgcatatgtaccctaaaacttaaagtataataataataataataataataaaaaagagcatgcagtggcaaaaaaagaaaaaaaatggttaagatggaacattttatatgtagtttctcacaattaaaatttttttaaaatcatgacaaatcacataaaaattcagatatgtggctcttcatttaaaaatcagaagctctggaaactttgggcctccactgtttctcaggtatttcacagattccagttatcctcctccttgtgcatttgcctacctgacttctgtagattcctgaatggcaatgctgaaatggccaaatgccagagtcagatgccatttccgtgtgttccttcgcatgctatagtagatcccagtaaaattcaaccacatcataagcatctctttaccggcctcccagtaaaaccaagaggcaatggtgacaataatgctgtctttcacaccatggtttgtgctcctagagtaatgcctggtaaaagcaagataactaaaaagtttgctgaatagaaagatttccaaaaaaaatcattttagaagtttggaaaatcccagagtggaaagaaaatgtgacaacataatataaatgcattacaaagaaagtgctgactttggaaatgaggaaaaattgtagattaaaggcaaataaactgcataaatactatacagcagtcccctccttacccatggtcaacgatggtacaaaaacgtgaagtggaaaacttcagaaataaacaagtcatacgttttacattgtgcactgctctgagtagcatgactggagcactgctccagtcccccatggacttgaattatccctctgtccagcatatccagattgtatacactacccacccgttagacacttagtagccatcttcattatcaaattgactgtcatagtatctcagtgctgttttcaagtcgccctaattttacttaattatggttccaaagtgcaggagtaatgatgctggcatattattataattgttccatttttgttattagttgctgttaatatcttactgtgcctagtatatcaattaaacttattcatagttacatatgtacaggaaaaacatggtatatatagggttttgtactatctggtgatttcaggaattacctgagtgtcttggaacatatgccctttgaataacggaggactactctactcagctgataaagttgtttttcatggattatgggttaaaaatttctgaaactgctacacatgtacactgtatttgaactattaaaacatactggatggcagagctaagtttctcactgttggagtgggaggttacaaataagcaaggggaaaagattagaatggtctgtgtggtaatggataggatacagttggggatgtccttatgagctcctgttttgcctaaattagatataagtcattgcacatagaaacatttatacacttatgtaaataaacaggtttataaacctactagatttttcttgctgtcccagctggagggcttagaaggtactgtcacttcagtggaaatgagcacacctagtacctagatcttggtatctaatacttttctccagtaaagagaaatggatgattcaaggactggggcaggacatacacaaaatgagcctgtgacacacacagacacacacacacacacacacacacacacagagggataaacatacacacacagtattaatagggcatgtcaaaggagcaaaggagccaactgaaagaggccccaatggccaaagctgaaaccatctgaacaagaaaataaatcaggtaatattggattttaattcattatatgaaatacatatctatgagtcctcggtgacatagatgattgaatcattaaactggggaagaaaagaaaaatcagtgcagaacaatttcaaataattcatgcagataagctgtactcatggaggtgaagtatgacttgccacttcttaagtatgggctgtccattctgacttccttatgaagaatgaagtatgaaaaggaggggtggggagaggaaatttagcgtgtagaaatgtgacatcacggcctcagcaagtttatcaaggataatatccacaatgagagtcctatcaatagcatgtacacttgatgtgatatgaggaaaatgaccctttatttctgtggtccccttccccagatcacatatacctagtctaattatgagaaaaaaaatcagaaaaaaatacaattcaggaatatactacaaaatacctgaccaatacatctcaaacagttaaggccttcaaaaaaaagaaaatctggagaaattgtcaaatccaaaaggagcctaaatagacagaacaactaaatgtaatgtaatatcctggatgagatcctggaactagaataaagacattaggggaaaaactaaggaaatctgaatgagctatggactttggttagtaagaatgcatggatactgactcattaactgtggcaagtgtaccatagtaatgaaggatgttcatataggaaaccggatgtggggtacatgggaactctctgtgctgtcttttcaagtttctgtatatctaaaactgttttaacacaaccattctatttttacaaacaattcatttgtatttacaatgatctcatatttttccttttttgtttacttttatttatttttctctctctcctctctggaatgtcagctcttcgagagtgaaagttatttatcttttattcaaagtgttgtgtattgatataatgctaatgggcaatacatatatgggtacaatgaatgaaatactgaaataccctctctgctgtaatctagatgacccattactttcagaaagagctctcctcctctcctatagattttgcttcattcttcttttctgttttcaaataatcctctctactttcatattcatctggcatatcagctcttctaccagcttcaggaaggaacctccagacagcagcccttggtttacctatgtttgtatacagaaaaccatgagattaaaggtggatcaacacaatttggatttcaacctattttgaaaatattcctttaaaaattatttggactttaagtcatccctaatatatttctatacttgatgctttaggattaatcttgtattatttttaatgacaggtttttggattccaacatatctattcatgcatattaccaattgtagatttctgaataagcaatacaatttgataagctaaaagttccttcttgttcccaaaattcccagtttattatcaatcgtttcactctgctaaccactgaagccacttcctaatcactagtttttgtttttcaattctagcatttctgggataactcctcttttgctataagttgtaaactgtatccattggacatatattttcaaattttctttccttctctttctgtgagtaaagtagtgcatgtgtgtggctgaaactatctttgtttttcttagggattcatcttattccagacagctctgttatttaaatgttgggtatgttctggagtttgtattgtggtccttgaaatgagaaagcaaatgggtacatatggtcagatacttttaagtctatttcactggagttccatatatttattgaataattttgttgaataaaatatttctcttataggaatacatagacatcccataataaaacattttatatgaaattcctcttattttaattaatctaatactttttcctgtaacaaaaggtaatatttattaagtaaatacaaacttccaagctcctctctaagtagtaaaacacataatcttcataaaactgctagatagatatgattattactattatttcatagatgagaaagatgcaatgcggagagattaaatcaattgcccagggatatacagctgtcaaactatggaaatagaattaaaactaatagaatctagctcccaagcccaaattttaacaagtacatgccatttgaagaaagtagtttggggatgattttgtgataataatctttcttctgagaatataattggaattaaaacacttggcttttttttttcttcaagaatttaatagaacttgggcattgagggactcttgtaattatccagctttctgccaagaatttgaatctcatctgatgccacgtttctgactgtttttaagcgttccaaatctgtggtgtgtagtgtgttaacagaaaaatgctttctttcctacagaatttgaaattaattttcttagtgcctgtcttctgcttacttccccaatggggaatattctcggtttctttcttttcccattgacactttcctccacattcttaatgcctttgatgcctcatttagctcctcacctacacagaatttgatttcacagggcctgagacttgtccatcccagctttattccaactctgcctgagagcccttcctctgcactcactgtggagtctagcctttggtctagcacagggtggactctgggcccctgtgccttcctcctcttcagctgtcccccatattggtggtggtgggtttctaccgtttcatgttgcctcacactcccctgttgaagttttccaagacatctcatgttaaattaccatttgaaaaacctgaattgttttctattgactagatcctgacaattacaaaggtttgtcaatatttcaagttttcctgggctcttaatgaatgctgctgtatttctccttgaagaggttcagtaaatgttagttgattaggataataaattggataagaaaagatacaaaaatagacacaatatcaactgtggagactttaaaatagtgagaccttgtctaactgaggatagagcacctctggctagaattacatgtcaaacatcttgaaatataatacttacaattttaaaataaaaatgttaaatcatcagttttaacatctcaagggttttgctgtaacaatctttagtaagtcactctcctcccaccttcttgcatttaccccacctgaattttaattcgctctgattgtggagcttaaaattagtgatgggtatggtcatcgtctttttcttttttgagattttttccaacatgaacaaatttaatgtgaggaccagcctgtaatcaggtgtgtgtagtctctttcggaatgaatggggcattgtcattcgatgacttgagatatctcaaaagtatacaaggagaaatatgtgtaaggccactgtaatggctggagttataatgcttggtttatttaaatttattttctgtttagctggagagctgctcaggctaattaacaagctcccgacatgtagcatcacacaatccaaggaagtaaatggaaacaaattgctaactagtgctgaaataattagagtagtattgtcttttggcgtgaaaatgttaacaacataaaaaagtccaccacacattagtaatctttaaagtgtttctttcacagtgacccaatgttgaaggtttggtcaaatagggttttgtattctttacaaaattatatttggatgatcagatataaactatattgcatgatttaataataaattgggaaaatattttgactttcacaacagaaatcagcctatatttaacaatattaaatatttcattgaaagaattacaggttgtgaaaatgaaagaatgaacagttgtttttattgggatgtagctcaaatagaagactcaaaactataattaccacactatttttattaaaaacaagcattgaatattcagtgtacacatagtatcctcttgtatataaaaagtattactaaaagttgtttcttgccataaataactttatcatttaaggtggcagcacccacaaaacaaggcagtaatagtttgaaggcaaagctgataaacatacagcacaggctgggcgcggtggctcacgcctgtaatcccagcactttgggaagccgaggcgggtggatcatgaggtcaggagattgagaccatcctggccaacatggtgaaatcccgtctctattaaaaatacaaaaattagccgggtatggtggtgggcacctataatcccagctactcgggaggctgaggcgggagaattgcttgaacccgggagacggaggttgcagtgagcggagatcacgccattgcactccagcatgggcgacagagtgagactccatctcaaaaacaacaacaacaacaacaaaacatacagtgtaaagtattattaggttctacagtggacaatgtgtaacatttgctttatttggggatttttatactatctccctataattgtgctctgtatattcaaggaatgtgaagattttatgtttagtgagtagcaaataattatgaccacagcaagtgaaatttaaaaacttaactgttctatgttaagaaaagcactgagattgcattttaaggacaagaggactgcactttggatttctattactctagatgtcatgaaataaatcatattgattttagatacttttcctcatcaataattggaataaagttatgtacttctacttatatcaaggaatgttttgatgattggtgtgaaaaatatctatgaaatccttttacgtctctttcactaatcaatatcaaaaagaacaatgcttcattgctcttaatggcttcccttaatgtgtaatgttttttgttactaatcagttttgtgatttctgcagagtcatggaagtgagacagtcagtcccagcagtgaatggaaacagttctggtcctggattttcagccctgcatgcaacatgttatggacatatttattcagtccccggtttatgaagtgaacataggaacagaatcagcagagctgtagccatttcccagtccagtgatctgacaaattgctgccctaatcaatctgtcaagatgtgtctgtcatgcctcctctttcctcccactaagttgtagctgtggactagctctgtctggaggctctgctgccccaggttgctatggagaccacagtgatagtagatatgaaagtaaaagctgctctttttcctcctcttcttactaacaaacgtgaactgctatcctaccctagagtccaaatataactgaggcaggtagggtgagaatgacgggacttcaaaggcatgtggggcttcctttctaatcctccatatgggcaggaagcccagcttccccgtccccgcctacttaccacctgctttgcaaaggaaatgtttgtgagaattaccctcagtagtttttgtaacactgtctcatttgaaagtattacatgtgagttctcacactctcattgtgagtttgcaaactcccaatgagcactcattcctctaaaatctctaacagaacataacccatttcaatcttaggtctgaagtaaatagcctacagattataaaaatcagcaatcatttacttcaattcatttagagagtagagagacagagcttgaattccccgtttctacaccattgccgaggacacatagatgcaaggattctaggcaagtggcctctgaaaaatgcaattatgaaacatgagggggctaatactttggctccaaactatgcctaatatatggccattgatatgtgtactccttacctggaggtttctttgcattgagataatgatgtatttagtttggaggagagttggtatgatgctgacatctgagcctgaagctcagagcatgaacacatgaaattccccaaagatgttttatttattgatttttcttattattcagataccaggtgatgggaatgccctttgggactctcttggaaaagaagcaaggcttgaagtagaatagtagactagaaagaggtctgagataaaatagaaaggtgacaatattataattttaagggttatttttagatatttgcactaattttcatataagtaaaatgggggcataaattacttccaactatgtattaaatattgaacagtctcataatgtacatgcatcttgcacaatttgataaatatcttagtgatttttatagttatcctatgtctgacatttttgtgcatagcagacctctctgaaggctgaaatttaaagtgactatgaagtgatagaatggatctatgtattttttttcatgtattaagcaacatataaggcagacaattttctccctacccattttttaatacattatatttgggatatacacatccgtttttaagtgtttaaaattactggactctcaaagaaaccactgttttctcttggtggtacagctgtgtttctccctatgcaggcttcagtcatcatgaaagtgctagcacagctcactccatggtggccccaacaatgctgctaatggtatcagggtatttatattgtactcagtgtatatcaaaggggatggcatttaaaattcagaatagcatgttcaaatgactcatgcagtggacggaaatgacagtatatggcagggaacagtgtaagcaattctacaatatttacttcttagttacatgttgtgcaaacattttgtgataatacgcataaacaaatatttagcaactgtattctgcagctgcaaatctaatgtgggtgtgataggggttagctttgtttttcagatcttgataattctttatgcttgaaataacctatacaaaattctattaaaataaggataagtgctatgtattatttctttttcttcacaaattctacttaaatgtggtacatagttttcaagctaaacatttatatagctatggttttactattatgaatttagagtgaatatgtgtataagttatttccatctaatgtggttatatcaaatatgtatatatgtatgaggctttaagtaaacattctggattttctttctttcttttctctttttctttctctctttctttctctctttctttctttctttctttctttctttctttccttctttctttctttccttccttccttccttccttccttccttccttccttccttccttccttccttccttccttccttctttctttcttttttttttatggagtttccactcttgttgcccaggctggagagcaatggcacagtctcagctcactgtaacctccacctcccaggttcaagcaagtctcctgcctcagcctcctaagtagctgggattacagtcatgcgccaccattcctggctaattttttgtatttagtagagatggggtttcaccatgttggtcaggctggtctcaaactcatgacctcagatgatctacctgtctcggcctcccaaagcgctgtgattacaggcgtgagcctccatgcccaacctggattttcttgatatagacatgttctctacttcagtatcctgcctgtataagaaatatgcagggcctggcgcagtggctcatgcctgtaatcctagcactttgggaggccgaggcaggtggatcatgtgaggttgggagttcgagaccagcctgtccaacaggaagaaaccctagctctactaaaaatacaaaattagccacacgtgatggtgcatgcctgcaaccccagctacttgggaggctgagacaggggaatcgcttgaactcaggaaggggagatttcagtgagccgagatcacgctgtcacactccaacctgggcaacaagagagagactccatctcaaaaaaaaaaagaaaaaagaaaagaaaaagaaagaaatatgctataacctttcagtctgtaaaatatgtcttgtctgcccatctgcaagatttgaactgagtacacttcatttcatgcgcaatgattgcattttataaatatactctctgccattgaaggaaggtggagggacattcaacatgggtctgaattaagtattttggggcctcagtaaacatgtgattacatttgatctgataatggaaactttgctcatttgaggaagtcattggtggtctctgagatatgaccaagagggcactgtagaaccttgtggaaaaacggctgggaccatcaggttgtgtgggcagggttgcccaggttttgttggtttccttgtttgttgtatcacactaagcaacgagacaactgtaccacatttcagtgatgtcagtattattagcacagaggccaaaaaaacactttgaatccttttatgcagactagatttgggccagggttttttacataatgctatttacttttaaaaacttctcttatacttttttttccttttaactggttgtaaatatttgtcttcccaccagcttagaagtctctagaacttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatacctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctgtccccattgcttgtttttctcaggtttgtcaaagatcagatagttgtagatatgcggcgttatttctgagggctctgttctgttccattgatctatatctctgttttggttactgtagccttgtagtatagtttgaagtcaggtagtgtgatgcctccagctttgttcttttggcttaggattgacttggcgatgcaggctcttttttgcttccacatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttctaagttggattcctaggtattttattctctttgaagcaattgtgaatgggagttcactcatgatttggctctctgtttctctgttgttggtgtataagaatgcttgtgattttttgtacattgattttgtatcctgagactttgctgaagttgcttatcagcttcaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctatcttgtgccagttttcaaagggaatgcttccagtttttgcccattcagtatgatattggctgtgggtttgtcatagatagctcttattattttgaaatatgtcccatcaatacctaatttattgagagtttttagcatgaagcgttgttgaattttgtcaaaggccttttctgcatctattgagataatcatgtggtttttgtctttgcctgtgtttatatgctggattacatttattgatttgcatatattgaaccagccttgcatcacagggatgaagcccacttgatcatggtggataagctttttgatgtgctgctggattcggtttgccagacatttatgcagccaaaaaacacatgaaaaaatgctcatcatcactggccatcagagaaatgcaaatcaaaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattccttagagatctagaattagaaataccatttgacccagccatcccattactgggtatatacccaaagtactataaatcatgctgctataaagacacatgcacacgtttatttattgtggcattattcacaatagcaaagacttggaaccaacccaaatgtccaacaatgatagactggattaagaaaatgtggcacatttacaccatggaatactatgcagccataaaaaatgatgagttcatgtctttggagggacatggatgaaattggaaatcatcattctcagtaaactatcgcaagatcaaaaaaccaaacactgcatattctcactcgtaggtgggaattgaacaatgagaacacatggacacaggaaggggaatatcacactctggggactgttgtggggtcggaggggggggagggatagcactgggagatatacctaatgcttgatgacgagttagtgggtgcagtgcaccagcatggcacatgtatacatatgtaactaacctgcacaatgtgcacatgtaccctaaaacttaaagtataaaaaaaaagtccagtaaaaaaaaaaagaagtctctagaactaaagggctttatcaactttatttcttcattgcttattctgtgttacctcatatggtgttttgaatgtgatagatatttgatatatgtttgctgagttaatttaaactatgcttctggatctcaaaagaaaatatacacaagtaagtaacttaaacaaatggagtcttattaatgtggaaagaagctacttagtccattctatcttgttttctgtatctaggtagagtcttccttctcagaactagggctgcgaagtggtgctgtgcagctgggctctatagataaagacgcatgaagaagttgatagatgatgatcatcctgaaattgctatgagagtaaaataggttttttttaagaaattctgcaagatttgccactgactattttaagaaaatggcacagtggaaaaaatggagaactcacgtttacatgtagttttatttgtcagtctgccacatattaggtgctatgtttgagcaagtcactcagtttttcaatgtttccatagagtctagcatgccctttacctaagtatctgtatggcaaatatgcttacctccttctatcccttggtcggaaatcctatcaatgggtcctaccttcactgatctatttaaaataactctccacacagctctgctcttgcttgtctgctctgcctgccattttccttgcctatgagcacctctcaacgtctccctttctgggcttgcatattgtttacttcatgctcacctaatgtctatcctccatcatctgttcctgccccttgaaaatgagcactaggcaatgaccatgatgacagcaagccatgttattgacagacgggttccaagagcccagcatgacacttggcccataaaaagtattcactaaatagtcattaataaataaatgtaatgtagtctttttttattacactttaagttctgggataaatgtgcagaacgcgcaggtttgttacataagtataaacgtgccatggtggtttgctgcacccatcaacccatcatctacattaggtatttcttctaatgctatccctcccatagccccccaccccacaacaggccccaatgtgtgatattcccctccctgtgtccctgtgttctcattgttcaactctcatttatgagtgagaacatgtggtgtttggttttctgttcctgtgttagcttgctgaaaatgatggattccagcttcatccatgtccccacaagggatatgaactcatccttttttatgactgcatagtattccatggtgtatatgtgccacattttctttattcagtctatcattgatggacatttgggttggctctgtctttgctagtgtgaacagtgctgcaataaacatacgtgtgcatgtgtctttataatagaatgatttctaatcctttggttatatacccagtaatgggattgctgggtcagatgatatttcttgttctagatccttgaggaatcaccacactgtcttccacaatggttgaagtaatttacactcccaccaacagtgtaaaagtgttcctatttctccacatcctctccagcatcttctgtttcctgaccttttaatgatcgccattctaactggtgtgagatgatatctcattgtggttttgatttgcatttctctaatgaccagtgatgatgagcttttctcatatgtttgttggctgcataaatgtcttcttttgagaagtgtctgttcatatcctttgcccactttttgatggagttgtttgttttttcttgtaaatttgtttaagctctttgtagattcaggatattagccctttgccatatggatagattgcaaaaattttctcccattctgtaggttgcctgttcataccgatgatagtttctttggctgtggagaagctctttagtttaacccaatttgtcagttttggcttttgttgccattgcttttggtgttttagtcatgaagtctttgcccatgcctatgtcctgactggtattgcctaggttttcttctaggattttcatggttttaggtcttatgtttaagactttaatccatcttgagttaatttatgtgttaggtgtaagcaaggggtccagtttcagtgtcctgcatgtggctagccagttttcccaacaccatttattaaatagggaatcctttcctcatttgattgtttttgtcaagtttgtcaaatatcagatggttgtagatgtgtagcattatttctgaggtctctgttctgttccatttgtctaattttctgttttggtactactactatgctgttttggttactgtagccttgtactatagttcgaaatcaagtaacatgatgcctccagctttgttctttttgctcaggatcgctttggctatatgagctcttttttggttccatatgaaattgaacgtagttttttctaattctgtgaagaaagtcaatggtagcttgatgggaatagcattgaatctataaattactttgggcagtaaggccattttcacgatattgattcttcctatccatgtgcatggaatgtttttccatttgtgtcctctcttatttcctcaagcagtggtttgtagttcttcttgaagaggtccttcacctcccttgtaagttgtattcctaggtattttattctccttgtgcaattgtgaatgggaattcactcatgatttggctccctgtttgtctattattggtgtacaggaatgcttgtgaagtcaatatttgaaagcaacaaaaattgtcctgaaggttaaaaccgtaaatccacattggaggaactgcaggggcaggggccccgggcagcccagccccaggggtaggcaggcaatggctcctttagctgacctgaggtgcctgcagcgggacttcctcagcctctatccacttgacctcgaccttgcttgtggacctggcaactccagcctgggcctgggtcccacgtcctgagactgccttagctcagatgctcctgctccgccaggtcctcctcaaggcggctactgcttctggcactgcagatagagtggtagcatataatgtataatcaacgaatttcaagacaattttggagctggaacccaagcctatcaatcatgtctacattgctcagacaagctctgcatcaggagactggaaaagccatgcttggaaaccttggacacagagagcgacctcacagatggaacagcaaggacgtgacacagatgtccttggcccagggcccttcctgccccgctggggatgcagccaccacgggttctgccgggaacctctgatcccaagctccccagagtttacacgtgacctggagacacacctcggacagccaacaattcagtattttgaatcagtcgggacaaaacaacgtgacagtatcagaatgacgtaccttagaaagaatgacatattcctaggcctctgggagtttgcgacaagtacttaagttgtacactttattattggaaagcttcatgtacgggaaagaaaacagccaagacaaacacaaatgcgtttttgatggatatggataaaggggaaaccaccgttccaatgttcaagcagtgattccatccgaagactacacaagacgacagaaagccccagcgagtgagccagccgccggacaacagcaatgtccttcctgactatcgcggagctggcggtcagcagccccttagctcccatgcccatcggagtacgtgcgcagcaggcaagggcgaccccgtggaaggacgcgggctgagcttagaggggcacccagcgctgctggagccgcccatgctgcaaatgctgtgctgtgatccagaacttatttatttatttatttatttatttatttatttatttattttactttaagttctggggtacatgtgtggaaagtgcaggtttgttacataggtatacttgtgtacttgtgccatggtggtttgctgcacccatcaacccatcatctacattaggtatttctcctaatgctattcctcccctagctcccccgcccccctaccacccgcaggccccagtgtgtgatgttccccttcctatgtccacgtgtcctcactgttcaactcccacttatgggtaagaacatgcagtgtttcattttctcttcctctgttactttgctgagaatgatggtgtccagcttcatccatgcccctgcaaaggacatgaactcatccttttttatgactgcatagtattctatggtgtatatgtgccacattttctttatccagtctatcattgatgggcatttggattggttccaagtcttagttgttgtaaacagtgcctcaataaacatatgtgtgcatgtgtctttatggtagaataatttatagtcctttgggtatatacccagtaataggattggtgggttaaatggtatttctagttctagatccttgaggaattgccacactgtcttccacaatggttgaactaatttaccttcccaccaacagtgtaaaagcaagcgttcctacttctccacatcctctccggcatctgttgtttcctgaattttttagtgattgctattctaaccggtgtgagatggtatctcagtgtgattttaatttgcatttctctaatgaccagtgatgatgagcttttcttcatatgtttgttggccacataaatgcctccttttgagaagtgtctgttcctgttctttgcccactttttgatggagttgttctttccttgtaaatttgtttaagttctttgtagattctggatattagtcctttgtcagatggattgcaaaaattttctcccattctgtaggttgcctgttcatgctgatgatagtttctttggctgtgcagaagctctttagtttaatgagacgtatttgtcaattttggcttttgttgccattgcttttggtgttttagtcatgaagtctttgcccatgcctatgtcctgaatggtactgtctaggtttccttctagagtttttatggttttatgtattacgtttaagtctttaatccatcttcagttaatttttgtataaggcataaggaagggatccagtttcagttttctgcatactggtaccaaaacagatatatagaccaatggaacagaacggaggcctcagaaataacaccacacatctacaggcatctgatctttgacaaacctgacaaaaacaagcaatggggaaaggattccctatttaataaatggtgttgggaaaattggctagccatatgcagaaaacagaactcttaagatagtagaatatacggaaatacaaacggggattttggagcatgatggtacaaccaattccaactttgttgtaatttttaaaattctggcaccttctatgcatatgatcctttagatgatatattctgtacagaggaagaaccagatcatccaaccaaaaacaaatgaatggatgccttacatattcctgaatgaacttttgaagagcttttgagaggctgacttcaaaccgtttaggaaactacatggaaattgtgcagacttttctgggacttttctaatgtttgtaatactgtatttaggttcttttcctattttcttttaaggagtacatttggaaatttaaaacaattggcaaaccttcaattagtgtattaaatgcaggagacttctgtattttgggcaccttcctaatacgctttatcatttagcactttgacttgagtggtgttgattaaacatttgaccagtaactatgtttttataaatctactgtacaaattatacagagtttaagatttaagatacagcttctaaggtcaacgctgtatataagtgtataatttttaaaaaagattttgtacatggaaattttctatttatatatataatattttttacttctatatattgagagtatttagtatacttttatataaataaagacaactggtaattgctgaaaaaaaacaaaaataataaaaccatgtcaaatacagtcaggtaccaaataaagataaccattatctccattatttttcaacaaatttgatgagttccagcaaatacaggtaaataaaaaattgaaatttcttttagaaatattaaagagagccctaagttggagggttgcgggggatatgccagggaatttttttttctattcctacttttcttagagttttcattaggaattgctgctcaatttgaccaaacatcctttcagaatctttaattgaagggagaaacatgtatatatgtatatatacacacacacacacacacacatatatatatacacatatatatatgtacacacacacatacaacttgttgaggaaattaattatattcataataattcatggatatttattcaggatttctcttttgaaataaagaccacttgctcatagcaaaatttcatttctcacttgctgaattccatatgctaatactgtattcaaaatacagtattggcatatgtatttatattaataattgtctcgtttattttatttatactaccacatctgcctttatttttaattttcatttaaatttactttaataaaatggtttgaagatacatgattttctactggaatcatctcttctttaagaattaggtaaaactcagttttatcactctgttcctgatgctttttcaaagtagaacttttatcaattgtaaaatttaaattaactttattaatggatcttgagctactcatttggccacataacaatcaaaagaaaaaagaaaatgttgcttgaatcattgaggaaatcatcttggaattacaacaaatgctgaaatagtgtttccatagccacgtgaactacctaataatgtattttacttcaattagtttaactcagaatgatatgtctctttatacacttttattacataaaatcttgttttaattgagtctttgaaaacaatgaattattttcagtcatagccttaaatattgtcattaccttaaataagtacaattttatcaaatgtttcaatattcttttctaactaaaataggtggctcttttctatattgaaattcagtgatttattattattgtattatgattagtttcactaagatttgttatttttattagagctgagagctgaaactgcattcttaattgtaataaataattatcaaaatcaaacattattgcataattatacattattttaggctgaaattttaggaattgtgaaattttaggaattgtgaaattttaaactattcatagttctttctttcatcatataaccagatggaccttcttgttgggacttttcattttaaacgacataaaatttagactagaaatgcctattgaaagattcctatgtcatttctacatatttatgaagtatttttaaaaattaaaatgcagaaaaaaataataaagtgaatgaatacatacaatgcctccccaggaacatcacattaccttccttgaactattatgttgacgataatctgactccccatccctaatgtgatgtatttctagcttttccagctctgtcctgtatcctgtggttgcagcaaccaagatgagagctgatgtgactcaatcatgtcaaattcttttttttttttttttgagttatttcctccacgttcccaattatatttgacttcacatagttgattaacccactacttccaaaagttatgtgataaggttttcttagatgcagctctataccctactttccagctgggtaatttctgctgctacacttgatttactttccaatccaacagtaacagctcttgtgaatattacagactcatttcttgctcaaatgcttctctcttaagaaggccttatctcctgcccatggctagcaactgccatgaccctgtgagcaatctgcagttgtgaatgtatatacctgcaggaaaccacagaagggtagtatgctccctcaccctgccaccagaagactcctctggaaacatgaatgtgctggtagacacacaaatggcaggaggactccctaacactggcatgaaagcctttacattaccgtttcaaccaaagctgtcacccagtagttcctgtaaaaagccaagttcttatttttccttcagttcgtaaatgactgcataaaaaaagatacatttatttggtttccacgtatagtcagtattttagagtgaacagtaaagtgtgttatagtttctagattagcctagttattttatctgtaaagtgacctgtttcaaaatcaaccctcaaagtcatgtttaagatccttttcagataggatccagaataagaaaataatttactatgtcaagtgggatgagtccaatatctaagtgaccgttttccatcattgttactggcgggcagaaatacgtcaatctgactctcttaagatcaaaatcttacttgattccctgacatcatatgaggccagttaactatgatcctcacaagctaatcttcctgcccttgctgtctgtgaagggaggtgtgtgcgtgtttcctgatgtgtgcttaaaatatgcctagacaaagcagcagtgccctctttttatcaattaaaagcaagctcagctatgggtatccttggctttatattgcagagcagtggcaggtagctaaattcctccttagaatctcatagacgttagaatggcctccaagaggaaaccagaaagggcaaagaaccaaaaaatgttgtatgaacttttcttcttaatagatgaatggaacttaagagctttcagttcatgaactgagtcattagatttgtagtggttttaatattaaacacataaatatctatttgaatttaatttctcttttctattcttattgattgtcaccatttatcaaccctcttgcttgggtactcatctatagcagtttgagagaataactgtgctaatactttatctgattaaaattcacaacattttatttgaattatgaaatgtgagtgaaagtaaaaaggacaactggatttattggttatttcttatttggcaggaataattcgttcattattattcaagatatagaacctgtattttccaacctgacagtatcagtctgatataatatgcatttaaagcatagaagaaaaattgaaaaaaaaaacactatctcaatcctattccctgaaaagattaataagcctgcattaattaagaaatgtgtatttgtcaaagacttaaaattatgattacacagatactcataagtgaccttatattttaaaaactcattatctctttagggtgagattttattattgtttaacgttcttatatttttcacttatacttgaaaaaaactttaagattgaagcacaaatataaagctttaaaagtaaagcaactgcccagtgcctatttcataggcaaccatatttaaccaatacatgtcatatttttcccatatctatacccatatttacatattcccatatttatatacttattcaaaattgattttcataccattatttctttttgtttaatcctagatattatctattgtacacttaatatagaatatgagtacttagctattttttccactgccccatatattttaatttatcagaaattcccaatagagtcacataatattgattatatcaatatatagaggttataatataatgtcaatacaaatacataagccaagttcataaattcattctaagccaaaaaaagcaaaagaaaaaacactggaaatttcaatgagattgtcctaaatctatagaaaaatagggcagaattgttatcttcacagtactgtgtccagcaatccatgacatagaatacccaccaacacaatcaaggtaataaaatactcatttaccctaaaagtttaatcttgccactgtataatctgtccttctgcctcttctcttctccccattccctgaacaatcactaatctgctttgtggcgctatacatttgtttacattttctacaattttatgtaaatgtaatcatataatagtatgttttctggcttctttcactaaatataattattttatatttattcacctggtatcatgtacccatcactcattgctttttttcttgttatgtggagtcacattccattataaggatatatctcagtttgtctacccatttactttttgatggacatttgagttttctaaattttctgattaaaaatacagctgctatgaatattcatgaaaagtatttgtaagtacatttactctgatttctcttggataaatttctaaaaattaatttactagatcatgtagtatggcttgtttcaattttatgaaattgctaaattattttccaaaatcattgtgacattttcagttttaattcttagtctctaagcattccagttcctccaaaaccttacacacacttagtatgtgagacatacataatttagacatttcagaagatttatagtggtatctcattatagttttaatttacatttcactaattgctattatgttaagcatattttaatgcactaatttgccttgaacataagttcaaggatatacctgcctaagatttttcctcatgttttattaggcgtttgtattattattgagttttgagtgttctgaaacatattccaagtatatattatttatcagaaaaagatttacaaatattttctcaaagtttgtgactttcttaaaagtatgttgcatagaaaagaatggttcaattttgattactcccaacttaacaatttgtgtttttattggatgtacttttggattaataactacaaaaataaatcctgccttaatgccacaacggttttctccaaagtttacttttagaagttttataagcttagactttacattcaggtaattgattcactctgagttagtattagtatgtcgtgtaaggtatagctcaaagctccttttcttttctaatgaggatttgaaatagttccagcacaatttgttaaaaagattttactttctctactccattgcaacattgttgaaaaattgttgtttatttttgtttgcatttatttctggacatatattatattaattatattacattatatcatgttacattattattttattttgctttatctatctttttgataacacaatgtcttgatgattatagtttctttatatctcttaaaatcaaacgatgttggtttaatagctttgctttgattttccaaaggtggtttggttatcctggattttttaaatttccacatgaattttaataacagtttgtcaatttttataaaaaagtctgctgggatttccatatgggtttgataaatattgagtcttgtgacacatatatttaaatgtttaaaaattactcatagcaatgttttgtatacagggcttttactacttttgttagattgatacataaatatttcatggttttggtgattttatagtttttttaaactagaaattctgattgtttataaagaaatgtgattattttatatttatcttatttcctgaaactctgctagaaagattagttatgattagttccaggagctttttttttttttggtagattctagtgcactttttgtaagccatcatgtcatctgcagatagaggcttttattccttctttccaaatatagatacctaaattttttctctatattgtcctgcctagtacctttatggaaatgttgactaaaagtagacagtgtggacactcttttattttttctaaacttaggtcgttaaggcctttagtcttttactatttagtaatgatattacctgtaggttttttttttatagcttccctatgccagtttgaggaagttccgttctaccattactttgcttaaagtgttcaacagatatgaattttgaatattgacaaatattttttgatatttcaacttaggtttttatgtggttaattacaccagttgatcttctaatgttaaaccaaccttgtattcctggattaaactccatttgatcattttgtattatctgatttgcattgatcatgttgtattgtttgatttgttaaaatatttaataatgtttacataagtcctttatctggctccttttaaaagttttaaaagtttgttcctttttatctttagtttgcaatatttttattatgatgtgtcttagcgtagatttatttggcaggattcttttgaggtttgttaagcttcttaaatctgtgggctcatgtctgtcatccaattggagaaattttcagacattatatgtttaaatattctttcagtccctcttctttctcctctcctctatgactcatatgatatgcattttatacattttgttactatccttcaggttactttttcttttttttttttggtctatatactctattgttcagatagggtgaattctattattctgtcctcatctttgttaattctactctctctcattcctactttgttattgaactattcccaagtgattttaaaatttatgaaaaaatatttgtataatatctatttggatattataacataacttttttggctgaaattttataatttttcacttgaatcaaaaagcttgtaatttcttatggcaacatttttgttgattgcttcaaaatccttgtcagagagttccaatatgtgatttatctcattggcattagtagattatttcttccctttaaaattgtgatttttctgattctcaatatgacatatactttttactatatcctggtcattttgtttattatattaggtgactctgcctcttacttgagatttctttttttaagcagaaatttaccgtttagctcacgggtttgtggtccatggttccatttacaatatatgttttagagctgtttggtgctgctttgttctgactgatttatctcgtgtcactgggcacccactgttccctgctgggattgtttgaagggatggaaaaagctttcccaggtcagtgctggttatggagggttcctccctgctgtagaggaggtaggataatggggaccttggagcaggtctatctttgctggtactctccactaggatggtgtctctaggcagaggaggatagtctcaggaccttgacaaagtggcctccctcactgggcacgtatgaggaggtacccctgccaatgatcctagttacacagtgcctctgagtggggcagagtgttctgaggcccagggggaaggctagcacttctgctggcttcccgttgtcaccgctcactgatgtttgctgccttgcctggtattagtgcggctcctttacaatccagaggtggtatgagcctatatagcgtgctttctgttttaatgatggggctgagaaagtgcccggcctgtttggtgttcctctggtggagcaggtaaggtatccggcctctgtgctgtccagtgctggcctgagaccccaatcagattttccttctccttctgtctttcagagttcttatttggttgtcttttgtattttcttcagtgtttacagttgtacttcttggggaggagcagagagagatgagcctgtgcgtttttttttttttttttttttttttttttcacggagttttgctcttgctgcccaggctggagtgcaaaggtgcggtctcagctcgctgcaacctccgcctcccaggttcaaacgattctcctgccttagcctcccgagtagctaggattacagacgcctgccacgaagaccggttatttttttttattttttttttttttttttgtatttttagcagagacggggtttcaccattttggctaggctggtctcgaactccagacctcagatgatccacctgcctcggtctcccaaagtgctgggattgcaggcatgagccaccatgcccagccatctgtgccatcttgtcagggccagaagtcattctaaattggtttcaagtagccaattctttaattgcggttgaacaagttttctatgtatttaacaagatatatttccatgtttattaactgctttttcactgattattcttgtctcattttacatgatagtttaaaattataaacatattaatatctttttcaggtgtgtttgctataagtaactcttcaacttcttgttcttttaattttttttaaattttaaaatttgcacatggcttatatttttggatatgattcttggagaaattgaaattattttaactggaagaactagacttactaattctgtattttaaaaaatgttgagagttattgataataacagacttcaacattatattacaactgatgctattgataataacaggtttgcaggggaaagaaaagaaaatattaagtagaatatgtaatgcctatttattttttgcaagaggattagagtgaattgggtcaatttgctttaatctgaattagtactctggtcaatattggcagaatcagatttttatgcttttcgaatcattttctcttacatcttagcttattttatgttacataacatatgctccaaagcttatccaatttattggtgcaaaataggtgctcaacaattattaataatttaccaataaatacagtgacctgaacattctatctgcctttctgtggacttcttgattcctcatattgcctaatatagagcataaactcaggaagacctcaacaagtatgaatggaagattcacgttgtgtataaacaggtgatcacagaatgtgacaagaggatgaacattgatggctcttactgcaatgataaataattagctccctctatcttttataaaatgtttctgaatactagggaaaaatggaaggtggaagaaacaaccaataatttcaaggctttgccatcatataacatgataaatgtaatgatgattgtattctttttattctttttttcaggttcaggttcttcggaatgctggagaagaagtgactctaacagtgtcatttttaaaaagagcacctgctttcctcaaactcccattgaatgaagattgtgcatgtaagcatttataaagaatagataaaagtgctcacatcattatagttacataattattattttgacaataattggtgatttcttcttaaagttgagatttttgcctgactgtaaacatttttatattacaaagtgttctactaacctttatgaaaagggaacagatgttatttttcttgaagaatagattcaccacattacagttttttctaacctacaattggagaagtattatttgttttaaaaataggcatatcaaatatcatgtatgcattatgcatgtctattaaatttcatcagaatatttggtgaatgtattttctctaactaaaaattaatactaaacaagaatatgtgcttaagttattctgatgagagaagatgaaaaaaagcgtttgcctttgagggaatgtactaatttacatagaactacttaaaaagttatttgtcaattttattttcatgttccattttctaaaatgaaatgtatattatctaatgcttttgctgaaaaattgaagaataatatatgtttcactgagacataatttgtatgcaataaaatacaaagatcttgcacagtcggatcagttctgaaaaggcacacatttgcttaatccacttcttacaatcataaaactgttcccagtaaataacagcccagaaatgactactcacttacactctcttcttcatacattattttgcctcttctagaactttacagaatggaattatacttaattttttattctggcgtctttcattatgaataatttccttcagattcacttatttcttagattcacatatttcttagtttgttcatttatattgctgtttattttgctgtttattattccattgtatgaatgtactacatttattaatgcatctttctgttgaagataccagcactgttcccagtattttgctataataaataaagctgctggaaacgttcttttatttaacttttattttaagttcaggggtacaaatgcagggttgtaacataggtaaacttttgtcatgggggttcgttgtacacaaaccagttattgaaattagtacccattagttatttatcctgatcctgtccctcctcccaccctacatcccactgaaaggccacagtgtgtgtggttctcctctatttgtctatgtgttctcatcaaatagctctcacttgtaagtgagaatgtgaagtatttggttttctgttcctgtgttagtttgctagggataatggcctccagctccatccatccatgtccctgcagtggacatgatctcgttcttttttatggtgacatagtattccatggtgtatatgtacaacatttttgttatccagtctaacactaataggcatttaggttgattctatgtctttactattgtgaatagtgctgcaatgaacatacacatgcatgcgtctttataatagaatgatttatatgtattgggtatataccatttgacccagcaatcccatcactggaagcttcttgtataaggcttttggcagttttgtaattttattttattacaataagtacttaagaattgaattgctgagtgactagaaagatgtataattaacttgttaataaattgccgaatttaggtggggtgcagtggcccatgcgtgtaatcccagcattttgagaggctgaggccggcagatcacctaagctcaggagttcaagaccaacttgaacaacatggcaaaatgccatctctaccaaaaatacaaaaaaaccccaaaatagccaggcatggtagcatgtgcctgtggttccagctacttgggagtctgaggtgagaggatggcttgagcctggtaggctgaggatgcagtgagctgagtaagaccccatctcaaaaataaataaataattaattaaaataaataaattgtgaaatttatttccaaagtgagcatgttatttattgtggtaaataacacataacataaaatttaccatctttaccattttaagtgttcagaagagtagccttaagtctatgtacattattgcgtaacatatcaccagaaacttttgatattgcaaaatggaaattctataccccttaaacaattccctattttccccagacccacccactggcaaacaccattgtattttgtttataagaatttgactactttagacaccttatgcacttggaataatccagtattttcttttggtgattagcttatttcatttagcataatgtccttaagactcatctatgttgtagaataggacaaaatttcattcctatttaagaatgaataacattctttcatatgcatataccacatattctttattcagccctcaaacagtgagcatttagattggttccacatctttgttattgtgaataatgctacaatgaacatgagtgtacaaatatcattcacaactctgctttcggttattttggatacatactcagaagtgggattcctggatcatatgttaattctatttttaattttttgaagaatgaccatactgttttccatagtagctgcatcattttacactcttaagtaacaggcaaagcttccaatttctacatatcctcaccagcacttcttattttctgtttttttgctttgttttgttttggttttgatagtggccattctaattgttgtcagatgataattcactgtggttttgatttgaatttccctgataatcagtaatcttaagcgtcttttcacatatttattggccatttgcatattttctttgaagacatgtctattcaagtctactatccagttttaaatctggttatttgttttgctgttgttgagttgtaagaattcttcagatactctggctattaacgtattaccagacatatggtttgaaaatattttctcccatttcaaaggttgctgtttcactctgttgatcattttatttattttacaaaatttttaattcttctgtagtcaagtctatttttgcttctaatgcctgtgtttttggtgtcatattcagaaaataattgccaaatccaatgtcataaagatttttctctaatttttctgctaggattttttacagctcaaatctaatgtttaggtatttgatttgtgttgagtcaatttttatacatagtataaggtaagtgcccaacattcttttgcatgaggatatccagttttcccaatataattaattgaagagaagactattctttccctattgtataaccttaacatgtttgtttaaaataatttcatcacatattgagggttaattttgggattattccgttccattgttctatgtgtctgcattaatgccagtaccacattgtttttattattgcagctttgtaatgtatcttgagttcagaaagtgtaaagccccagctctgtttttctttctcaagaatttttgactattcagaattcgttgaggttttgtatgaagtttaggatagtttttctatttctgcaaaataataccatagagattttgatagggattgcattgaacctgtagattgcattgcttagcatgaacattttaacaatattaattcttccagtgtatcagcatgggatgtctttctatttatttgtttcatctttaatttctcaatgatattttgtggttttcagtgtaaagtctttaaaattttgggtgagattattcctaattattctttttgatgctattatcaataaaattgtttttttattgttaatggatagaaacaactgaatttttatgttgtctattctgcaacttccttaaacttgtttattagatctaacatttttgtgtgtgtgtttaaactttagagttttctacatataagctcatatctgcaaacaaagataattttacttcttcatttgaatttgggtgacttttatttcttagtcttgcctaattgcttctggctagaacttttggttgtatgttgaatagaagacttgagagtgggcatccttgccttattcttaatcttagagggaaagctttcagttttccattattcagtataatgttagctatgggctttttatatatgaatgacctttattatgtagaggtaatttccttctattcctagtttgtaaaatgtattatgttttaaattgtgaaaatattgaatttggcaaatgcttttttcttcatcaactgaggtgtctatgtgggatttttttttctgccattctgttattgtgatgtgttaattacatagatagattttttttcatgttgaaccatccttgcatttcaggaataagtcacacttgatcatggtgtataatcttttaaatttgtagttgaattcagttttttagtatctttttgaggacctttgcattaatattcatcaggaatattggtttgtagttttattttttgtagtatctttgcttggtttcagtatctgggtaatgttcacttcaagctggaaactgctttcccctcatcaaatttttttgaaagagtatgagaaagatcagtgctaattcctctttaaatgcttggtaaagttctacagtaaaaccatctggtcatgggcccttcgtattttgtgaggaatttattaatgattcaatttccttactagttctatgtctgtctgtattttttgtttcttcataattgattgttggtatgtcacatatttctagaaggttatctattttttctagattattcagtttgttggcacataattgtccatattactctttaacaatcattttggtttttgtggcatcagttgtaatgtctactatttcatttctttttttttaattatactttaagttttagggtacatgtgcacaacgtgcaggttagctacataagtatacatgtgccatgttggtgtgctgcacccattaactcatcatttaacattaggtgtatctcctaatgttatcccttccccctccccacacccccaaacaagccctggtgtgtgatgttccccttcctgtgtccatgtgttctcattgttcaattcccaccttcatttctttttttttattatactttaagttttagggtacatgtacacaacgtgcaggttagttacatatgtatacatgtgccatgttggtatgctgcccccattaactcatcatttaacgttagatatatctcctaatgctatccctccccactccccactcccctcaacaggctacggtatgtgatgttccccttcctgtgttcatgtgttctcactgttcagttcctacctatgagtgagaacaagcagtgtttggttttttgtccttgcgataatttgctgagaattttatggtttccagtttcatccatgtccttacaaaagacatgaactcatcattttttatggctgcatagtattccatggtgtatatgtgccacattttcttaatccagtctatcattgttggatatttggcttggttccaagtctttgctattgtgaatagtgccacaataaacatacgtgtgcatgtgtctttatagcagcatgacttataatcctttgggtatatacccagtaatgggattgctgggtcaaatggtatttctagttctagatccctgaggaatcgccacactgacttccacaatggttgaactagtttacagtcccaccaacgatgtaaagttttcctatttctccacatcctctccagcacctgttgtttcctgactttttaatgatcgccattctaactggtgtgagatggtatctcattgtggttttgatttgcatttctctgatggccagtgatgatgagcattttttcatttgtctgttggtggcataaatgtcttctttcaagaagtatctgtccatatctttcacccacattttgatgggattgtttgtttttttcttgtaaatttgtttgagttcattgtagattctggatattagccctttttcagataagtagattgcaaaaattttctccccttctgtaggctgcctgttcactctgatggtggtttcttttgctgtgcagaagctctttagtttaattagatcccatttgtcaatattggcttttgttgccattgcttttggtgttttagacatgaagtccttgcccatgcctatgtcctgaatggtattgcttaggttttcttctagggtttttatggttttaggtctaacatttaagtctttaatctaccttgaattaatttttgtataaggtttatggaagggatccagtttcagctttctacatatggctagccagttctcccagcaccatttattaaatagggaatcctttccccattgcttgtttttgtcaggtttgtcaaagatcagatagttgtagatatgcagcattatttctgagggctctgttctgttccattggtctctatctctgttttggtaccagtaccatgctgttttggttactgtagccttgtagtttgaagtcaggtagcgtgatgcctccagctttgttcttttggcttaggattgacttggcgatgcggactcttttttggttccacatgaactttaaagtagttttttccaattctgtgaagaaactcatcggtagcttgatggggatggcattgaatctataaattaccttgggcagtatggccattttcacgatattgattcttcctacccatgagcatggaatgttcttccatttgtttgtatcctcttgtatttcattgagcagtggtgtgtagttctccttgaagaggtccttcacatcctttctaagttggattcctaggtattttattctctttgaagcaattgtgaatgggagttcacttatgatttggctctctgtttgtctgttattggtgtgtaagaaggcttgtgagttttgcacattgattttgtatcctgagactttgctgaagttacctatcagcttaaggagattttgggctgagatgatggggttttctaaatatacaatcatgtcatctgcaagcagggacaatttgacttcctcttttcctaattgaataccctttatttccttctcctgcctgattgtcctgtgcagagcttccaacactatgttgaataggagtggtgagagagcatccctgtcttgtgccagtattcaaagggaatgcttccagtttttgctcattcagtagactattggctgtgggtttgtcatagatagctcttatttctttgagatacatcccatcaataactaatttattgagagtttttagcatgaagggttgttgaattttgtcaaaggccttttttgcatctattgacataatcatatggtttttgttgttggttctgtttatatgctggattacattcattgatttgcatatgttgagccagccttgcatcccagggatgaagcccacttgatcatgttggataagctttttgatgtgctgctggatttggtttgccagtattttattgaggatttttgcatcgatgttcatgagggatattggtcttaaattgtctttttttgtcgtgtctctgccagcctttgttatcaggatgatgctggcctcataaaatgagttagggaggattccctctttttctattgattggaatagtttcagaaggaatggtaccagctcctctttgtacctctggtagaattcaactgtgaatccatctggtcctggactttttttggttggtaagctattaattattgccacaatttcagagcctgtttttggtctattaagagattcaacttcttcctggtttagtcttgggagggtgtatatgtcgaggaatttatccatttcttctaggttttctagtttttttgcgtagaggtgtttataatattctctgatggtagtttgtatttctgtgggatcggtggtgatatcccctttatcattttgtattgcatctatttgattcttctctcttttcttctttattagtcttgctagcggtctatcaattttgttgatattttcaaaaaaccagctcctggattcattgattttttgaacagttttttgtgtctctatttccttcatttctgctctgatcttagttatttcttgctttctgctaactattgaatgtgttttctctggcttctctatttcttttaactgtgatgttagggtgtcaattttagaactttcctgctttctcttgtgggcatttagtgctataaatttccctctacacacagctttgaatgtgtcccaaagattctggcatgttgtgtctttcttctcattggttttaaagaacatctttatttctgccttcatttagttatatacccagtagtcattcaggagcaggttgttcagtttccatgtagttgagcggttttgactgagtttcttaatcctgagttctagtttgattgcactgtggtctgagagagagtttgttataatttctgttcttttacatttgctgaggagtgctttacttccaactatgtggtcaattttggaataggtgtggtgtagtgttgaaaagaatgtatattctgttgtttggggtggagagttctgtagatgtctattaggtctgcttggtgcagagctgagttcaattcctggatatccttgttaactttctgtctcattgacctgtctcatgttgacagcgtagtgttaaagtctcccattattattgtgtgggagtctaagtctctttgtaggtctctaaggacttgctttatgaatctgggtgctcctgtattcagtccatgcatatttaggatagttagatcttcttgttgaattgatccctttaccattatgtaatggccttctttgtctcttttcatctttgttggtttaaagtctgttttatcagagactaggattgcaacctctgcctttttttgttttccatttgcttggtagatcttcctcgatccctttattttgagcctatgtgtgtctctgcacgtgaggtgggtttcctgaatacagcacactgatgggtcttgactctttatccaatttgccagtctgtgtcttttaattggagcatttagcccatttacatttaaggttaatattgttgtgtgtggatttcatcctgtcattatgatgttagctggttattttgctcgttagttgatgcagtttcttcctagcctcgatggtctttacaatttggcatgtttttgcagtggctggtactggtttttcctttccatgtttagtgcttccttcaggagctcttttagtgcaggcctggtggtgacaaaatctctcagcatttgcttgtctgtaaagtattttatttctccttcacttatgaagcttagtttggctggatatgaaattctgagttgaaaattcttttctttaagaatgtttaatattggcccccagtctcttctggcttgcagagtttccaccgagagatcagctgttagtctaatggacttccctttgtgggtaacccgacctttctctctggctgcccttaacattttttccttcatttcaactttggtgaatctgacaattatgtgtcttggagttgctcttctcgaggagtatctttgtggtgttctctgtatttcctgaatttgaatgttggcctgccttgctagattagggaagttctcctggataatatcctgcagagtgttttccaacttgattccattctccccattactttcaggtatatcaatcagacatagatttggtcttttcacatagtcctatatttcttggaggctttgctcgtttctttttattcttttttctctaaacttctcttctagcttcatttcattcatttgatcttccatccttgataccctttcttccagttgatcgaattggctactgaggcttgtgcattcatcatgtagttctcgtaccttggttttcagatccatcaggtcctttaaggactgctctgcattggttattttagttagccattcatctaattttttttcaaggtttttaacttctttgccatgggttcgaacttcctcctttagcttggagtagtttgatcatctgaagccttcttctctcaactcatcaaagtcattctcaatccagctttgttctgttgcttgtaaggagctgtattcctttggaagaagagagtcactctgatttttagagtttccagtttttctgctctgttttttccccatctttatgattttatctacctttggtctttgatgatggtgatgtacagatggggttttggtgtggatgtcctttttgtttgttaattttccttctaacagtcagaaccctcagctgctggtctgttggagtttgctggaggtccactccagaccctgtttgcctgggtatcagcagtggaggctgcagaacagcggatattggtgagcagcaaatattgctgcctgatcgttcctctggaagttttgtctcagaggagtacctggccgtgtgaggtgtcagtctgcccctactggggggtgcctctcagttaggctactcggaggacagggacccacttgaggagacagtctgtccattctcagatctccagctgtgtgcttggagaaccactgctctcttcaaagctgtcagacagggatatttaagtctgcagaggattctgctgccttttgtttggctatgccctgcccccagtggcggagcctacaaaggcaggcaggcctctttgagctgcggtgggctccacccagtttgagcttcctgggtgctttgtctacctactcaagccttggcaatggcggatgcccctccccagcctcactgctgccttgcggtttgatctcagacagctgtgctaacaatgagtgaggctccgtgggcataagaccctccaagccatgcgcaggatataatctcctggtgtgccgtttgctaagaccgttggaaaagtgcagtattagggtgggagtgacccaattttccagatgctatctgtcacccctttctttgactaggaaagggaattccctgaccccttgcacttcctaggtgaggcaatgcctcgccctgcttcagctcacgctcagtgcactgcacccactctcctgcacccactttttgacattccccaatgagatgaacccagtatctcagttggaaatgcaggaatcacccgtcttctgcatcgctcatgctgggagctgtagactggagctgttcctatttggccatcttggctccccctgcaatatttcacttttaatttttatttgcatattttacttttttttattagcctagtcaaggtttcgtcaatattgttgatcttttcaataaaccaactatttgcttagttgattttctatactgtatttcttttttccactttatttatttctgctctaatctttataatggctctccttctgctaccttgggtttagtttgtttctttttctagtttttgaatggtaaaatttggttgctgatttgaggtttttaaattattttgcaacataatgctttaaaatacatatgtttactgataaaattttctctctttgtaatgcttttgctgcatcccatgaatttttgtatgttgtgtttcattttaatttgttggatattgtttaaaatatttttaagtcccttgtgatttctttttgacttattggtttttcaaaacttcattgtttaatttccactcatttgtgtatttttcagttctctctctgctattgatttccattttaattccattgtatcagaaaagatatttgatatgatttcaatcttcttaaatttaataagatttgttttgtgaccacatatgtaaactattagggagaatattttgtgtacacataagaagaatgtatattttattattgttgagtgaagtgttctgtatatgtgttaagccaaattagtgcttagtgtcacacatgtcctccattttgttattctttctgtgtagtggttctataaattagtagcagttgaggacttaaatgtcatactattattgtgttgctgtctatccctttaattctgtcaaagtttgcttcatatatttggatatttggctgttaggtgcctatatatatttataattgttatatcttcatggtgaattgacagttttactattataaaatatctttctttgtgaaggtttttatagttaaagtctatttttgtctggaataaatatggtcactctgctcccttttatatcatttgaatgaaatatttttctctatcatttcattttcagcctgtgctcatcattaaatataaagagagtctgtagttgacagcatacataagcatatcttggagatattgccggtttagatccagatcagcaaaataaagggaatatagcaataaaacaagacacacaaattatttggcttcttgttgcatataaaagttatgcttattcttatattatagtctatcaaatgttccataacggcattatgtgtaaaaatacacataccttaatttaaaatattttatgctaactgggcagccatttgggcagacaacaagctagctgcaggagttttttttttttttttttttttttttttgttactccagtggatcctggaatgccaatgagacagaaccattcactcccctggaaagggggctgaagccaaggagccaaatggtgtagctcagcagatcccacccccacggaccctagcaagctaagatccactggcttgaaattctcgctgccagaacagcagtctgaagttgatctgggacactcaagcttgatggggggaagggcgtctaccattactgagcctttagtaggcggctttctcctcacagtgtaaacaaagttgctgggaacttctaacagggtagagtgcaccacaactctgcaaagccactgtagccagactgcctctctagattcctcctctttgagcagggcatctctgaaagaaaggcagcagccccagtcaggggcttatagataaaactcccgtctccctgggacagagcacctgggggaaggggcggctgtgggcacggcttcagcagacttaaacgttcctgcctgccggctctgaatggatctcccagcacagagtgcaagctctgctaaggaacagattccctcctcaagtgggtccctaacccccatgcctcctgactgggagatgcctcccagcagaggtcgacagaaacctcatacaggagagctctggctggcatctggcaggtacacctctgggaagaagcttccagagaaaggaacaggcaacaatttttgctgttctgcagactccgctggtgatacccagcaaacagggtctggagtggacctccagcaaaatccagcagacttgcaacataggggcttgattgttgggagaaaaactaacaaacagaaagaaatagcatcaccatcaacaaaaaggacatccacaaaaaatcccatccaaaggccccatcatcaaacaccaaaaatagataagtccacaaagatgaggaaaaaccagcacacaaagtctgaaaattccaaaaaccagaacaccacttcttctccaaattatcacaactcctcaccagcaagggaacaaaactggatggagaatgagtttgatgaattgacagtagtagtcttcagaaggtgggtaataacaaactcctctgagctaagggatcatgtcctatcccaatgcaaggaagataaaaacctttaaaaaaaggttagaggaattgctaactagaataagtttagagaagaatataaatgacctgatggagctgaaaaacacagcatgagaactttgtgaagcatgcacaagtatcaatagccaaattgatcaaatagaagaaaggatatcagagattgaagattaacttaatgaaataaagtataaagacaagattagagaaaaaagaatgaaaaggaatgaacaaagtcttcaagaaatatgggactatgtgaaaagaccaaacctacatttgattggtgtgcctaaaagtgaaagggagaatgaaaccaagttggaaatcactcttcaagatattatccaggagaacttcccctacatagcaaggcaggccaacattcaaattcaggaaatacagagaacaccacaaagacagttatcaagaagagcaatcccaagacacatagtcatcagattcaacacggttgaaatgaaggaaaaaatgttaagagcagccagagagaaaggtcgtgttaccaacaaagggaagcccatcagactaacagcagatgtctccgcagaaactcaacaagccagaagagagtgggggctaatattcaacattcttaaagaaaagaattttcaacccagaattacatatccagccaaactaagctccataagcgaaggaaaactaaaattctttacagaaaagcaattgctgagaaattttgtcatcactaaatctgccttacaagagttcctgaaaaaagtgctaaatatggaaaggaaaaaccgataccagccactgcaaaagtataccaaattgtaaagaccatcaatgccattaacaagctgtcaaataacaggcaaaataactgggtagcatcatgacaggatcaaatacacacataccaatattaaccttaaatgtaaatgggctaaatgccccaattaaaagatacagactagcaaattggataaagagtcaagaaccactggtgtgctgtattcaggagacctatctcatgtgcaaagacacacataggctcaaataaagaaattgaggaatatttaccaagcaaatggaaagcaaaaaaaaaaaaaaaaaaaaaatagcaggggttgaaatcctagtctctgataaaacagactttaaaccaacaaagatcaacaaagacaaagaagggcattatataatgataaaaggatcaatgcaacaagaagagctaactatcctaaatatatatgcacccaatataggagcatgctgattcataaggcaaattcttggagacctacaaagagacttagactcccagacaataatagtgggagactttaacaccccactgtcaatattagacagatcaagaggacagaaaattaacaaggatattcaggacttgaactcagctctggagcaagtggacttaatagacatctacagagctctccaccccaaatcaacagaatatacattcttcttagcaccacatcacacttattctaaaattgaccacacaattggaagtaaaacactcctctgcaaatacaagagaatgagaatcataacaaacagactctaagatcatacggcaatcaaataagaactcaggattaagaaactcactcaaaaccacacaactacatggaaaatgaacaagctgctccagagtgactactgggtaaataacaaaattaaggcagaaataaataagttctttgaaaccaatgagaacaaagacacaatgtaccagaatgtctgggacacagctaaagtagtgtttagagggaaatttatagcactaattgcccacaagagaaagcaggaaatttctaaaattgacaccctaacatcacaattaaaagagctagagaagcaagaccaaacaaatttaaaagctagcagaagacaagaaataactaagatgagagcagaacttaaggagatagagactcaaaaaaaccttcaaaaaatcaatgaatccaggggctgtttcttttgaaaagattaacataatagaccactatccagaccaagaaagaagaaaagagagaagaatcaaatagacacagtaaaatatgataaaggagatatcaccactgatcccacagaaatatattactactatcagagaatactataaacacctctatgcaaataaactagaaaatctagaagaaatgggtaaattcctgaacacatacaccctcccaagactaaatcaggaggatgtcgaatccttgaataggccaataacaagttctgaaattgaggcagtaattaatagcctaccaaccaaaaaagcccaagaccagttgggttcacagccaaattctaccagaggtaccaacaggagctggcaccattccttctgaaactattccaaaccattgaaaaagagggactcctccctaactcattttatgaggccattatcatcctaatactaaaacctggcagagccacaacaaaaaaagaaaattgcaggccaatatcactgataaacattgatgggaaaatcctccaaaagcaactctcaaaatgaatccagcagcacatcaaaaagcttatccaccacgatcaagccggcttcatccctgggatgcaagcctggttaaacatacacaaatcaataaatgtaatccatcacataaacagaaccaatgacaaaaaccacataattatctcaatagatgcagaaaaggccttcaataaaactcaacacccttttatgcaaaaactctcaataaactaggtattgatggaatgtatctcaaaataaccagagctatttatgacaaacccacagccaatatcatactgaatgggcaaaagctggaagcattccctttgaaaaccagcacaagacaaggatgccctctctcaccactcctattcaacatagtattggaagttctggccagggcaatcaggcaagagaaaaaaaataaagatattcaaataggaaaagaggaagtcaaattgtctctgtttgcagatgacatgattgtatatttagaaaaccctattatctcagccctaaatctctttaagctgataagctacttcggcagagtttcaggatacaaaatcaatgggcaaaaatcacaatcattcctatacaccattaatagacaaacagagagccaaatcctaagtgaactctcattcacaattgctacaaaagaataaaatatctaggaatacaacttacaggggaagtgaaggacctcttcaaggagaactgcaaagcactgctcaaggaaataagagaggacacaatcaatttgaaaaacattccatgttcatagacagggagaatcaatagagtgaaaatggccatactacccaaagaaatttatagattcaagctaccattgactttcttcacagaatttgaaaaaaaactactttaaatttcatatggaaccaaaaaagagcctgaatagccaagacaatcctaagcaaaaagaacaaaactggaggcatcatgctacctgacttcaaacaatactacaaggctgcagtaaccaaaatggcatggtactggtaacaaaacagacatacagaccagtggaacagaactgaggccttagaaataatgccatacatctacaaccatctggtctttgacaaacctgacaaaaacaagcaatggggaaaggattccctatttaataaatgctgctgggaaaactggctagccatatgcagaaaactgaaaatggacctcttcctaacaccttatacaaaaaataactcaagatggattgaagacttaaacgtaagatctaaaaccataaaaacccttgaagaaaacctaggcaataccattcagggcataggcatgggcaaagacttcatgactaaaacactaaaagcaatggcaacaaaagccaaaattgacaaaagggctcaaattaaactaaagagcttctgcacagcaaaagaaactataatcagagtgaacaggcaacctacagaatgggagaaaaaaggcaaaggctgatatccagaatctatgaggaatgtaaacaaatttacaacaaaaagcaaataatcccatcaaaaagtgggcaaaggatatgaacagacacttctcaaaagaagacatctatgcagccaacagacacatgaaaaaatactcatcatcactggtcattagagaaatgcaaaacaaaatcacaacgagataccatctcacgccagttagaatggtgatcattaagaagtcaggaaacaacagatgctggagaggatttggagaaataggaacgcttttacactgttggtgggagtgtaaattagttcaaccattgtgaaagatagggtggcaattcctcaaggatctagaacgagaaatacaatttgacccagcaatcctattactgggtatatacccaaaggaatataaatctttctactataaggacatatgcacacatatgtttattgcagcagtatttacaatagcaaagacatgcaaccaacccaactgcccatcagtgatagactggataaagaaaatgtggcacatatacaccatggaatactatgcagctataaaaaatgagttcatgttctttgcagtgacatggatgaaactggaaaccatcattctcagtagactaacacaggaacagaaaaccaaacaccaggttctcactcataagtgggagttgaacatttgagaacacatggacatagggaggggaacatcacacaccaaggcctgatgggggctgggggtctaggggagggatagcattaggagaaatgcctaatgtaggtgatgggttgatgggtgcagcaaaccaccatggcatgtgcatagctatgtaacaaacctgcgtttcctgcacatgtaccccagaacttaaagtacaataaaaaataatttttgctaaaacatgctaagaatcatctgaaccttcactgatttgcagcttttttgttagtctctctattgatggatgctgactgatcagagtggtggttgctgaagtttggaatggctatgacaattccttgaaatagacaacaatgaagtttgtcacattcattaactcttcctttcatgaaagatttctctgtaacatgtaatcttcttgggggattttacccatattagaacttccttcaaaattagtcaatcttcttaaactctgcaaccattttatcaactaagtttatgtaatattctaaatactttattgtcatttcaacaatgttcatagcatcttcaccaagaatagagtccatctcaagaaaacactcatgagattggaacaattcagtcacatcttcaagctctacttctgattgtaattctccagctatttccatcacatctactcttactgcctctacttgagaagtcttgaactcctcaaagtcacccatgagttggcatcaacttcttccaaatgcctcttaatattgatatttttacctactcctgtcaatattaatcatgagtattcttaatagtatcaacaatggagaatcatttccagaaggttttcaattgattttgcccaggtccatcagagtaatccccatctatggcagctgtccctgtattaaatatatttcttaaataatatgacatgaaactttgaaattcctttttcatccatgggctgcagaatggattttgtgttagcaggcatgaaaactacattaatctttttcatcttcatcagtagtcttgggtgtccaggaacattgtcagtaagcagtgattattggaaaggaatgtgttttgatgtgtgtttcagggtgtgtgtgtgtgtttctgagcagtaggtctcaacagtgggcttaaatattcagtaaaccttgctgtaaacagatatgctgccatctaggccttgttgttccatttctagagcacaggcagagtagattcaccataattgttaagggacctatccttgccctaggatttcagaatggtaaataaaaatggaattcaactgatagcagctgcattagcccctaacaagagttcgctgaagcttggaaggcagacattgacttccttcctttttttttttttttttttgagacagagtctcgttctgtcacccaggctggagtgcagaggtgtgatctacactaattgcagcctttgccactgaggttcaagcaattctcctgccacaacctcccaagtagctgggaatacaggcatgcaccgccatgcccggcttatttctgtatttttagtagagatggggtttcaccatgttggccaggatggccttgatctcctgaccttgtgatctgcctgcctcagcctcccaaagtgctgggattataggcatgagccactgtacctggcttgacttccttttacctatgaaagtcttagatgtcatcttcttctaatatgaggctatttaatggatacatcaaaaatctgttttttaatgaagccgtattcatcattaatcctagccctagttatagcttctaaagctcctgcaacagcacttgtttcttcatcttgtaattttatatatggtgacagtatcttttcttgagtctcataaagcaacatttgctatcttcaaacttttttttctgtaccttcctcacctctcagcctttatagaattgaagagagttagtatcttgccctggattaagatttggcttaagggaatgctgtggatggattgatctatccaggccactaaaactttctccttatcagtaagaagattgttttgcttcaaaatgcatgtgttcactggtgtagcactgttaacttccttcaaacacttttcctttgcattcacaacttggctaactggcagaagaggctaagcttttggcttatcttggctttcaatatgacttcttcactaggctttttcttttctagcttgtgattttaagtgagagacttgcaattctttcttttatttgaacacttagaggccattgtagggttattctttgttctaatttcaatattattgtgtcttagggaatatggaagcccaaggagagggagagagatggggaacagctagtcagttgagctgtcagaacacatacaacatttattcattaagttccttgccttatgtggcgtggtttgtgaagctccaaaagaattacaatagtagcatcaatgatgactgatgacagatcaccataccacgtataataataatgaaaaagttgaaatactgtgggaattaccaaaatgtgatgcagagacacaaagtgaccacaagctattataaaaacagcatatagatctgctggatgcatggttgacataaaccttcaatttgtaaaaaatctgtgaagcaaaatcgagcaaaatgtaataaaatgagatatgtctgtacttggatattgggttttaaaatccacttaaccactttatctctgtggttttggaagtttattccacttaacatttaaataattgctgatagggaaacacttactgctgtcattttgttgttttctgtatgtcttatagttacagtgcccctcttttcctctttagctactttcatttgtttccttgttttttgtagttccatgctttgatccttttatcaatttcttttgtgtaccccttataggtatttctgtgactctaataggtattgcatagaacatactataacaatctattttaaatggataataacttaatcacagtacacagatcttacttctttacatcccctccccaccttctataccatatattggtttcaagttagtgtctctgttggggaatgaaatatagagatttctatcccacaatcttgctgttattaattcccttttacctatttttaatggacaaatatacttgttaaattattattttctattaaaaataagtcacctaggcaagaaataatcatgttaatatactttattaaatactattaaccgtttttaagtaagtgaatttaaactgataactccatgtcaatcacatacactgccttataaatacaacttgttatattttatatcccttaaaccacttgtataggtgtagttgtgatacaaattccacatctgtgaatttagcctgccgcaaatcaaaattgttaattaaaatattacacaacaataaaaataatacaaataaacagtacagtataacaactacatacatatttacattgtatttggtattatatgcaatctggagatgatttaaaatatactgaaggatgtgcataggctatatgcaaatactacaccattttatgtaagggactacagcagatgtgaattttggtatgtgaagggtgtcctggaatcaatctcccatggaggaatgactgtatagttatttttcacagttttatcatttaaattctgtaccacaataaaaattactatgaatacaccttcattattctgtatttgtctacatctacctttaccagaggacattattttttatatgcatttctctttctatctagtgttcttttacttcaatttgaagaattgtctttagcaattttgtaaaacagttctagtggtgatgaagtcccatggtttttgtttatttaagaagatctgtatttctccctcaaatttattgaacaggtttgctgggtatggtattctagattggctgattttatttttctttcagcactttgaatatatcatcccactcctttctccctataatgtttctgctgagaaatgtgttgatctatgagatcttccctttacctgcaaaattgcatttttttcttgcagctttcaagattatctgtttatctgtgacttttgacagtttgataataatgagtttcagtgtgagcctttctaggttcatcctagttggagatcttcaagtttcttctattgtatgttcattttcttccccagatttgggacatttttgaaaattatttctttgaataagctctctgcccatctccttcttttttcggacttctataaagtgtctattggtctgcttgatggtgtcatataaatctcttagcatttcttcacttttcctaattctaatttccttttagtcctcaaatgtcatgcctttgaattcactttttcttctgcttgataaaatctgctattgattatctctagtgaatatttcacttcattattgtattcttcatcttcagaatttctgtgtgggtttcttgtcttttctatatttttgacattttcagttcatgcataatttttctaattttatttagctatctgtgtttttgttttagcacactgagcttctttgagatgattattttgtgtttttaaagataatttacagacctggtttccacttggttttcggtggtttattttgtttctctgttgcttcatatgtctgtgctattattttttttctgggatttgtgaatttgaaaaaatcagccatgtctcttagactttttctaactgattacacaccggaaaagaacttcaccaatcagcctgggtaaagtgtctcccaaacattttcaggggattcatcttctctgggcatgtaatatcccaaaagagaggtttgttggtttctttttcctgaccttataattactatttcctctgctggtctggctgcagaactgcaggttctctagtgctgcaatgagcccctgaactcttctgtgttctctgagcctcaggcatccagagtatgctatgtctatcagtgcacccagtcagtgacacagaaaccagacccttgtgcactcccccaaaagccagaatattggatgagtgttttttgcttttcttccactctagagagtggctgcaagtttgacacttacttctgatcacaccaagttattccagcttagtggaagggctgtcatgggtgaaatgaaatggtctttttacccatttttaatgtggctgctcttggctttgagcttacctgggttactgtgacttattaactagtttctggagcactcttcaaagctttcttaactatatattgttgcaaagttggtgtgtctatgggaagcaaggtctgaggtttctattccaccatctttctgaacttcatcaaagtcagcatatatatgtgtgtgtgtgtgtgtgtatacacaaacacatatatacacgcatatatatatatatatttttttgagatggagtctccccctgttgccaggctcattgcaacctctgcctcctgagttcaagcagttctcctgctcagccacccaagtagctgggactacaggcgcttgccaccacaccaggctaatttttgtatttttagtggagactgggtttcaccatgttggccaggatggtctcgatctcctgtccttgtgatcatcccgcctcatccaccaaaagtgctaggattacaggcatgaggcaccgcgcccggcccgaagtcagcatgttattaaacaactcccactgtgttccccagaaaggtatgcaagcactggttgccctacattctttccaatatttgatgctcaaatatttcttccagccattctattgagtgtgcagtgaaatcttattgtagttttaatttgcattttcctgatgactaataataattatctccatattgtgtgattattggccatgtgcatatcttcttttggaaagcttctgttcaagacttttccccatttttctgttggtatgttctttttactattatagtgcatgaatttttaaaaatattatctatataagccttttgccagtgatataaattacgaagattttctcttagtctttgtatatctacatttttcacttgaggttgtctttgttagcagaagctttatttccttttattgtttttgtatcctctctaagacatacttgcctaccccaaggttgcaaagatattttttcttattttcctctagaggcctgttgctttagcttttatgtttacatttataatacatcttatatttttgtgcatcttacataagaatcaattatgtgtgtgtgtatttgatatatgtatatatatgattattatttgatcatacatgtttggatttattttgagatactttgttatttccactaatttacatgtctatttttttaaatgaaaatcatattatttattattgtaacatatcctaaagtgacctagaagaggttcttcaactttgaaatctgtaaagatcatttggctattctacatctattgtattgctgcatatatttcagaaatcgcatgccaatttgcataaaaaatgtattggaattttgaatggaactaaattaaatttataaacaatttggagattaccttttcatttatgttttcttctcagcaatatattagtctttttaatttggaattattgcatatctttcattaaatttatttatatgcattttatgttttaattttattgtaaataatattttaaaacttcattgtccagttgtttattgccaacacataaaatataatttaattttatatattaacatattgcaacatagcataattctagaaagacttttctgcattcttaacgtttttctatatacacgattgtgttatctgcaaataaggttttgcttcttcctttccaatctacatttctttaattattttgactttcccgttgcagtggctaagacttccatttttatttttaacaacgtgttaagggtagacatccctttctttctcttgatactagtggggaataatctaggtttattttgtcattagttagggtatcggatataggtttttaaagatgttctttatcagatagaggagcacatctattcctagaacgctaaagtttttaatttgctttttgtaaaaaacaaaaattgatggtgaattttctcaaatatttttctacatacatcaaaatattacatatatgctttcgttctttagccttttgatatggtaaatgtttaaaatggattttgaatgtaaaaccaagcttgcatttctagaataaataccacttacttggtcatgatgtgatatatttttcatatattactaggcttggtttgctaatatattgtttacatttttcttttttgcatatgtccataagagttgatagtctctttcttcttttgtaaattttggttagattttttttaatgtatttgttcacttcaactaagttgtcaatttctttcatgaagttatttatcatgaccgctcatcattccttttaacatccgttagctctcagtaatgacccctccttcattcctgatgttgataacttgtattttctgtctcttttttctaaattttttttttgctatgggtttatctaatttattagtttccccaaatatctgatatttgccttaattaattttctttattattttctcttttctatttaatttttcccagttttatttttatttttcatttattttgtttgttttgctttggttcaatttgctcctccattcttaagttcttaagatcattaagtttatacctaccttcttttggtgtatgtatttaaacatttaaatttcactcaaatgactacttaagattcagtcacagagtttgatatgttgtatttttatttttgttcagttcaaaatgtatatgctttaaaataataagtatatacatttgctttaaagtaatacatatatacattaaaatgtagaagatataaatgcaaataaacttcacaggaaaaataactaaaacatagtgtgatattcttacagtttaaagattagaaaaattatatccagatcagtatagcgagaaagcctatatttcccatcttagttccaggaaaattacagaatgtgagagtaataaaagagaagaacaatatctgttttttagcacatggactattatgtaagtagtgttccctatgacctatgatgtttgaaatcaagtataatatttcaaatattaattgagcgtcaattatatttgtgggtaatatttataaacattagtaactttaaaaaatatctttagaaaaatcaaataatcagaagtcaggaactattgtgactctaacacttactaaactgggaaatcttagaaaatgacaaatctttaaggcattactcatctttaaaaaatagatattagtaggcatctcattaaaatctaatatgaagttttttcattgcaattatacaaaatgtgataattttaatggatacttggatactaacaaagagtacctacaaaaacagaacatgcaaacatttttgcatcatggaaaattatagtttctaagggtaggatttaccacttggttgaaatatgacattaaatagaactctgtagacaaccaaaatcttgtattattttaagtatggtttctaagagcaggccactttagataattaaacaaaataatactttttataaggctgtacattttcctttataaagtcttaatgtttctgaaatcaaagacaaatttttgtgagtctcttttagtgcccagatacctgtagtcacttggcttacttgcaaaactctggctttagtataactgagataaaattgtattgtaatatctgatttacttgatattactgagtatccttgaaagtgtaatggaatgcatcagtttagaaggttatggcattctcaccagtggaatgttatgattttgtctcctgcaggtgctccaagtgaccagagcagtggcacctcctctcctctctgtgacagtggcttacatctcaactaccatcccaacaatacagtaagatgacccaggcatagctcagattaataaggagataacacatagcttataaaaactgctagtgaatctgatttatctgacagataggaaatccctggttgcataatcatttaagaattatgataaacaagaaatgcaaaataaatagatcaggtttcttatgccatttttttcccctctcaagtctgtatggattaagttcttttgaagcaatagatactattaacttggggatgtcactggagatgtataatatacaatcattttagaacattgcacattatatgtgatttcaggttcaaaatgctttgacattagttttctcacttttttcttttgaaattacttaactaaaagtaactatttaatttgctatttgttaggatttttttagccaactttattcacagtaagcaattactgcaaagtgagaaaatccaattcacacattattttgacatgtaaagaacgtttaactatacatgtatttagtagaagttaaaattaaactttgttttatagatatttaatacaattttaatctttgttctctacttgcattttgagtaaatcgattttaatatcttataaatgtttttgaagttccttgcatttcatccttcaaaacactcacacattcttaaagaaataattttctctggttataagcagatctaacaatcatctttcatgcttacaaacataaagagaagcagaggtgacgttaagcagaattttattgttctattccacatatcatggtacatacgtcatatagcttcttcaaccgactggtatgattcatcctgcaatttgaaatttttgtcaaaatagtggcattttacttcaaagcaatctttttgaacatcttcagtcctgaatggctttcacggtacctgatttccctagtattactcctcagctgagtaccttaggccctcaagttgtcaacttttttccttcgtaaaaagaaatttgccaacaccaaaggttatctgtacaaatctagggatattttctaaaaccatcttcagctggatatatttcatgtggccatctttgaaactttttttttttttgccaaagaaataattgccacacaataagtggcatttaaaaccacaatacagcatgattggagtgacttaaagtttatgaggaaatatacaggtttcctaatgaaaaacttagatatacaaccaaattttttacctctttattttgtaattgctttgctcaccttcttccctcccgatccagatgccttcgataatttcgatccacttctgttttccttcaccgcgctggtgcacctgccctcagtagctggaggtgttggctgtgcccattcacagcttatccctcttgtctggatcccctttgcctgggagtcagagctcacaggggtgtttggcaccacatgccctgcttccatcagtcctcagaggttgttcctgagagtgccccctccacgtgtccctcacacaagaatctccatctcacctctgctcctaagacagaaacaagagcaacttacttcagaatgggagaaagctctttggagctgttttgttctaggtcttgcctcatacccttgaactcctgtataataagcagagcagaggagtcagagtggcaggtctaagggtagaaatcattctggtttgtttttaatccattccattgacatatagaaaaacatatatagaataatgtccttccttataaaactgtaattacagcaagaaaatcactccaattctataacatcccaaataaattcagttttataaaattaaaaataaagcaactgttataaattcttcttactggagctatgtctccccatttccagaggcacattttattttccttttagcactaggattgaacattcttttgacattgctgaagatatttcagtgtaaggaaattgaaagtatcatgatgctatagagaataataataaaaccgtatgaaaacaaaataaagtatattcaaaataaagacaaaaatctcaatgcatatcaattaaatgcatttttgttgagaacttactctgtggaaatacccctctagctattttactttggggagctgttaattatgattttaacacaaaaaaattaagatccagatctatagacaaaagcatacaattaactataacataagcagaaaaagagaagaatgagtagcagcattctagtaacagagataaagagttgtagagactttgaccatctgactaaaaattcaacgtaagttgagagactacaaaccaagtgtgtgctttgttgctcgcacgggagcattaacctgcaatggtaatcagaccgtgcaggcttgcacagccagggctagcacgtgctgttccttctgtatcttgaataagctttgatggaggaatggcaagtggagaacatctctactcagagatgtacaaaattaggagaggtcaaagacatgaaataacaacagacagtgggcactcagaagaaagagtgcattgtgaggcaaattttctttccacagaatatgtgtatattatagacagtctatttaaaagaaacatttgattttctgatgtgtgttaattctcagttctatcctaggctcacaaactgccttttcaatgtctataccttgatctgaagccaattttgagtaggtattattctggttttctaacatgtccttactgtattttaaggcagcattttaattctaaggggaaataaaggcttatagtatattagcatcattccactatcctacataaaaatataatctattccttctaaagatgcgcgacatcactaatttgaaggtacatgaaagtcacttgttttgccaaccaagaccttggctcttaagccccagcccagattcactgaatttcttctctctagagatggagtagaagaatttgttctgtgcttaccagaagactctgattcagataatcagccaaccagactgagaaacattcttcttaactgtacacctttaattaatacatcctatgccaccaaatccttaataaaatctcagttagcagtttgccctttgtgcagttctgttctggtaagatagttgttcttgaggatattgtgtggcatgtgtaaaattttgggaaacaagcaaggagacataattgctgctttttccagtcacattattaatattgtaggaaacaacattcttgacattgtagagtagagctattgaaaaatagtcatggttctcaaaagcacaaaagtgattgtgtttttagactatcttttatgcaaaaataaataaactactattccaaaaaaatgattagaaagtaaatttatattctatttacataaataaaataagtaaggagaaaaattctttaaaggatagcttgtgttccactgtaaataacaggtctataatatgaaatacatcaactctgttgagtcaaataactgaagtgggacttattacatatttcttataaagaagaaatataagaaagtgacatacttatacctttggtacatacaggcatcaaatcaagatgccacaagaaagaatgtcaaaggccacatatatttccatacttgccaatctatgaagtgtattgataagatttgtaaaacctaccgtactcatgtattggtgattagtcagtcctcaacatctcattacccatatctttaacaatctttgacattttctatcccatttattgaagaaacacaaaatttgaaagaaattattattgtattttatgaaagatgagaaagcatctttaaataatatacctgaagttatataaccaaaatgtgaaataatcaagtaaaaaaatccaaattatttttccattgtttcactcctgattatccaggttgaatgttaaatgttccacagtagatctgttggctctgctatcaaaaaggtgttagtctgagtgaatcctgggggtgccctttgctggctgggtgacttgggtaaattgtttactatagaacttaggaatgcgtgtgtgtgcactggggttctgggaaggagtttcagtcattgccaacgaggaccttgctttgtgcagctgggtgggtcctgggccacttgcaatccctgtggacatctctggcctggtcacagaaaccttgtttgtttacccaagcctgccacacagtattattgcttcttcatgttccctcatgaagaaaagttgggaagtaataataaaatacttctttaaaaaaactttcttgtctcacgcctgcaatcccagcactttgggaggccaaggcaggtggatcacctgaggtcaagagttcaagaccagcctggccaacatggtgaaaccccttctctactaaaaatacaaaaattagtcaggcctggtggtgggcacctgtagtctcagctacttgggaggctgaggcaggaggaccacttgaccccaggggcggaggtttcagtgagctaagatcacaccatgcacttctaagtgatagagtgagaccctgtctcaaaaactaaaaataaaaaaaccttctgtttttcctttcaaatatgaacatagtaatagctttgtttttcaaagatgttgcaagtggtgtaagtcaagcacttagtacaagtaggtattattaaaactactattaaatagtaacagtaatattcctaagaatgccctccctaaaagttccatgtttagaaataattttgccccttatttcagcttattattatttctcgagaatataatatttgatacattttacttacagctaccaagccaggcatctaagtagtttgttttactaaatgttaaattaccattagccttttagatatattgaaaatagtatggagccatttagctgggctagattataagaaattttttatttgttgctataatcttaccagttgttaccattattatccccactttgaagataaacatagtaagatagagactacaaaacttgcccccaggtaatggactactcagttgggaaactggtattcaaatctaagtgttctgattctgacttgcagcttaagacctcgccaccttgtactatctcccagctgatcccatgtcatatgctgaccacctgtacagctgacatgaagatctgacctcacatcacatgccgatcatccataacatctgacatgaggccaggagaaagagtaatatgaaacctaggtttgtgcctttgcagtcaccagagaggcattaaaagcaactgactagcattgaaggacaggtgacttggaagctgaggtgctcattgagtcaccagtagggacccctcactaagtgatcttagccagtccacacttccaggtattctaaactgctccactgacttagtacatttttatttgctcaatctgccacaattaacataaaatgccaggcaacatacaaccttaagtaaaagtaatattgtttttcactggaagcattgttaaaaagtttaatgcctgagagtaatgcttaataatatttagacttcacagagtttcaatatctagactaaaatagaatcttcttccaacactatcactcaaaaattagtgaataaagggaagtcaatgttaccagtttactggtcaaattgagcttacaacccatgccaatttaaatattaatattatttgatgtgttggtgtgatgaagaaattttaacattaaaactgaaataatgaaggaaacatgaatcaagtgaaaaagcccaaattttatcaaatattagtctcctctatatataaaggaagaaaaaagctctaacaaaacttaatgtatgtgtaattttaagccagcagtagttgccttgatatgcaattaaaacaacataagaaagtataaactttttatgaacatgaagttagaaaaaggagcacagatttccttgagcagtgttttgaaagttgttttataggaaagcttattctattcaaaaatatttgcaaaaatctgataaattaaaaacacttatgattgtgcttggcactcataaaatactctctatttgaatgaactacagctgatttttatttcttcacttaattggttaattatagttacagttttttcccactttttccattcttgaataaattatgttctgtcacattcttatcctttccttccagctcccctcattttaaaatacgttttcactagcactcttagtctcaatgattcctttcttaacttcttatagcattctgttaataaataagttaaccaatacaactttagtgtccataatttggacttcttctcatggtattccattaaagtcttttgatcatttaggggaaaaataatatcccccagataaaaggggtttgagatacagaaactcaaagcacagaagaaaaaaattacgttgaatatttatcttcctttcaggacacattatcatgctcgtcgtggccgacgtctccaggcttgaggtgggagaagcgatggtgcgacctcagactgatccctctacttcattcgcgcttctctcagtatgtgcccggcacagatttgagtcggtgagtccgtgtttaggagttatgactgttttgtttatgaaaaaagagaccttttagaaaaccttttgacatatcacaatacgccttatgattttagtatgtttttgatagtagaaagaagagcttcaaaataataatctaacaaagttaaacacttattattctgatgacaaaaccacaagttaaagccctgactctgctattaacttattgtaatggattcaatagactcaatagatagttttattaagttttcatatttcatatttgttaattgtttacttctcaagaatattgcatagtttatctatttgtttgtttgttcacttattttgaggcaaggtctagctctgttgccctagctggagtgcagaggggtgatcttagctcactgcaacctccacctcctgagttcaggtgatcctcccacttcagcctcccgagtagctgggactgcaggcacatgccaccatgcccagctaattttttgttttgttttgttttgttttcgtagacatgggagatctgcctgcctcagcctcccaaagtgctgggattataggcataaaccacatgcccagcagcatagttggtctaaattataagatttattttctgcttttaatattcttatattattatctattttagtaagtgtaagataagtagtgccctccttttcattcttgaaactttttttctctttttatcttgatcagttttgctaaggagttgtacattttgttgattttttaaaaatgattaatttgggactttcttgaatctcttaacttgtatgtatactttatgagtctctgctttttccctgattgtttccatttcttaagtttttcagcttgaatttttgttcttatagctttctgagagatataacctccaggggttgggaaactttcctgtaaagagctgtatagtaaatattttatgctttgcaggccttaatgtctccatcacaaagtactcaactctgctcttctggcacaaaaatagccatatacaatatataaataaatgagcacacctttgttccaataaaactttttcacaaaaacaggtggcaggctagatttgtcccataggctgtagtttgccagtccattttgataattaattttaagatgtttatctcttaatatatgtagtcagatcttcacatttccagcaaatactgttttagttactcctgcaagtttagcattacctcttgatttatttatagtatttttgagtatatcactttgcatagttttctgactggttgcttgaggtattataatatgtgtaggtaatatatcacagtctactggtaacgttttaccactttgaatgaagaatagaaatgttgcttccattaagattcctttatctttcctgtttgtaaagatattaccttaacttcctatatatacatcaaacactatatcgggtggtattatgagttttgcttcaaccatcaaataagattttaaaaactcgtggaaaggataatccattatacttaacccaaagtatacccatcaatgatctttctgaatttcaaagcttcttttaccgcttcctttctgcttaatttttttagacattctttaaaggtagatttgctagcatctaattcccttagttttcatttatctgagaggatacagactttggagttgacagttcttttctttcagtacctaaaatatgttaggcattaatgtctactgtcattcaaatcagtgtcccctgtaagtaatatgttctttccctctgtctgctttcaagacttttttttcttttcttttcttttttagtttcagaagactaattatgacgtatgttggcacatatttctttaaatttctcctaaatgggctttattctgcttcttaagtctgtatgattatgactttcaccaaattaggaaagtttttgacctttattccttcaaacacttgattagtcccgctttccattctctccctctacatctctgttgatgcaaatattaacccttttattattgtcctgcatttcactgagaaactttttaaaaaatctgttttctttctgttaaacagattgggaaaagtttattgatctgtatttatgctttcaaattttatttcctgtcatttaactctgctcttcagccaattcagcattttattttttgtcgatttatttttttcagttctagtttatccttttaaaaataacttcttttttgaagtttttaaaaatatttttatttgtttcaagaaaacttgtaattgcctgttgaagcatttttaggatggttactgtaaaatccttgtgagatattttcaatatctcattcatttcattgttagtatcattaattcttttctcattcaacttgtgattttcctggatattgatatgacaagtgatttaacaaaatcatcctagactttttggatattaaatgttgagattcagattactatttaatctgggttttgttgttgttgttgttgttcttgttcttgttgtttttagcaggcaatctctttgttgtgaggactgggtgggtgtatatgttaagtttcctactgcaccatgctgacacctggaaaggtagatggagagggctattcatatttcttggttactaaaggttggaggtagaagctcagctcctcagggaattctactgacataaggaaggaggtggacggataggtgagggcaactagctccacctcccaccacctcattccactgcggtgatgatggtgggagagactcagctccttgctgggccacacctgtcagcatggaaggggaggcacagtacttgtcccatctcccacaagcccatttattctaattgctgcaggtgagtatgaaggttcagctgtccatgacaccccactgacactaccctggcagggaaattggagcctgcttctttaaggtgtaggatggaagaacagcttcttgctaagccctgctgaaaaccttgtgaacagggagacaatggttccattggtatttgactggatttgggcaggtattgccaaaagtttttgttttgtttttattgtacccattctctagtccttcaaaaaggagttacagatttttattggaggctttacgtttttaaaagtcttgctgttagccattcagattggaggtttcagagggtcgtgtctaggacatgcaggaggaaaacccaggggattcagcactttttttatccctgaatttgaagtccctagccattcatgcttagctgttcacctcacaggggcttcccatacttttgtcatcttatgtgtgaagttctttagttgcatcagaaagcagctgataagaatgaggccactctgtcttggccagaataagaaatccacaagtattgatattcatgtattttaaaaaattcatttgataatgttttattttttgttataattacttctatgacctatggactatttaaaagtgtatcacaaaatttcaaaatattttgggattttctaattatctttttttgctatttctatttagtataatttcatgctagatgatttcaatactttgatatttgttgaggcttgattttactcagcatatacgttattttgggaaatgttttatatgtatttataaaggatgagtattgtcatttttttagtgctgtgttgtacgtatttcaattaggtcatatgtgttcgttagaggctctgatcctctgcatcattcatgatttttttctgtttattgtattaggttttacataaacatggtaaagtgtcccactatgatggtagatctgtgtgtttctctacattgttgagtcagtgtttgctgtatatatttaattatgttgtcagatgcaagtagatttagaatttttataaattcctgttatatgatgcttgataattatggcatgtccagtacctttggaaatgtttcttgcctttaagtctatctgtattaggataaataaaaaacagatttctatttgttaatatctacttgtatattcttctatcctattctttaaacttttattagtcttactgtataaaatatgccccttctgcattaaatatatatgtatatatacacatctatatattatacatatatttgcaatattctttgttgtttttaatccaaagtaacaaacttggtcattaattcaaattagtctagttacctttaatgtaactacatatatattttgattatacatcttatttttttctattgaaaatcctagctttttataattaaaccttttattttgaaaaaattgaatattcacgtgcacttgtgggaaatagtattttcatttactcttattatcccagattgtatcacattgcaaaactgtaatacaatatcccaaccagggaatggacttgacaaaattcaccactaagattttacctgtgtgtgtgtgtgtgtgtgtgtgtgtgtgtgtgcatgtttatttctgtgaaattttatcacatatgcatgttcctgcatccactaacgcagtcaagttttgtatgaacagttccatcattgcaggcattctcctgtagtccttccataactacaccagcatccctcttgccctcctccctcaccacatttctaatctctgacaactaataatctgttcttcacctctgttatttgatcatattaagaacattatatatgatactatataaccttatttaattcaatttttgatgcataatagatgcatagttttagaatacatgtgatcatttaatacatccatagaatttgtaaaaatcaagttagtatacttacaatatccatcatcttagtatttgtcttttctttatgtgagaactattcaaatccttcttttccagctattttttaaaaatatacaatagattattataaactacagtcaccttactaagctatttaatactaggtcctatgtcttatactatactatatatttgtgttcatcaatcaacttctcttcattctctctctcttctaactttcctggtctcgggtaatgaacaatttactagctgtctcaatgagatcaacttttttagctcccacttaaatatgagtgagaacatggaatacttgtctttttgtgcctggattatttcactcaatataatgacctcaaattccatccatgttgctgcaaatgacagaatttcattttgtttttcatggatgaataatattttattgcatatgtatatatacatatatatatgaatgtagtatatgtatatatacatatatatgaatgtagtatatgtatatatacatatatatatatgaatgtagtatatgtatactacactttctttctgttttttttttttttgagacggagtttcactcttgttccccaagctggagtgcaatggtgtgttcatggctcactgcaacctccacccccgggttcaagcaattcttctgcttcagtctcccgagtagctgggattacaggcgcaccccaccatgccctgctaattttttgtatctttagtagagatggggtttcatcatgttggctagcctggtctggaactcctgacctcaagtgatccacccgcctcggcctcctaaagtgttaggattaaaggcatgagccaccgcacctggccaaatgtatactacactttctttagccatttatgcactgatagacacttaggttgatttcacattttggctattatgaatattgttgcaataaacataggagcacagatgtcttttcaatatattgatttcctttctttaaaatgtatacccactaatgaaattgctggatcgtgtggtagtcttattttcagttttttgagaaccctccaaactgttctgaagtagtggttgtactaatttacattttcaccaacagtgcataaggattcctctttctccacatcctcaacagcatttgttattgcctgtctttcatatataagccattttaactggggtgagatatctcattgtagttttgatttgcatttctgtgatgattagtgatattgagcaatttttcatatacctgttgaccatacgtatgtcttcttttgagaaatgtctgttcaaatcttctgcccatttttaagtcagattttttattgttattgagttgtttgagtgtcctgtatattctgttcagtaattctttgtcagatgggtcatttgaaaatattttttcccattctgtagattgtctctcactttattttttctcttgtggtgcagaagctttttagtttgatgtaataacatttgtctatttttgctttggctgtgcttttgacgtcttacagaaaacatcttagcccagactaatgtcccagagcatttccccagtgtcttcttccagcagtttcatagtttcaggctttcgatttaagtgtttaatccattttgattttatttttgtgtatggtgagggatagggctctagtttcattcttctgcatatggatcttcagttttcccagcaacatttattgaagagactgccctttctccaaagttgccacctttgttgaatgtgagttggctgttaatgagagaattgatttctgggttctctattctgctccattggtctatgtgtctgttttgttgttgttgttgttgttgttgctgttgtttcctcccacaggataatttcctggagattcttccaagtagttttattttttcagttgttcattccttttcatttctgagtgatatcctatggtatagatgtagcacatttaaaaaattcaacctttgaaaacatctaggttgcttccggtttttgattattctaagtaaagatgtatgaatatttgtatatagattttttggaagcatacatttccatttatttggataaatgctaaaaagtgcaatgaatggattatattttaatagtattttagtcttttaagaagcaaccaaattgctctctagagtgattgtccaattttacacttgcaccaacaatgtaggaatgactgtttctccacatctctgccagcatttagttttgttgctttattgaaccactttaatgggtatgtagtgacatgtccctgtggccttgatttgcatattataatgacattgagcctctttttatgtacttatttgccatcagtgtatcttcttcggtgaagtgtctgtttatgtcttttgcccattttgaaattgatttgttagattttatactgttgagatatacatatatctcaaattcctttttctcaacacacgagtttttgtgctgttttatttccttacctcttgtaataattaaaaatgtttattatttaatattctctctattcaattttcatatattcgtgtttttgttatcatttaagttatcgcctaagcattatcatagagccatacatgtataactattacagtttaacacaatttatatcaatttcagaaaatgttagaactttaagaccccttaattcctttgttttttcttatctttgggcatatttttgatatacttaaaatcgtatgttagatatttcaaaatttattattgctttcatataactattcaaacatattctatttttaatctttcttctcatttctttcttttggttctattttccttctaccttaagagctctgttaatatttctattaagagaatgtatattttttaaaagcgtacatttatttactttttgatttaaaaaaatgcagttacattatttgaagacatttagctagagaaatttctgacaagaaaggaattgtctgaatgggtccagatgactccttacattttcatttttatggcattcagcacatcaacagcttcatcagctgaattaattacactcaatacacatgacagcaataagcatttacaaacatagcactattcagaatggatttcatagagattcacattcaagagctaatttattgtttactcattcactcaaccaatattgacttaatatctgtaagtgggagacattatgtttgattctttctctgtaaaagctcacagactagtagtagtagattcagtgagggagtggggggcaagaaaagataaataagtgatttataatagattcatggatgaataatacactattgcatatatatatgtatatatgaatgtaatatatgtatactacactttctttagccatttatccactgatggacagttaggttgatttcatattttgactattatgtatagtgctgcccatgattacaaataaagaaaattatttagcttggctcaaatgtaggatattatttcttggttgctttttttccatagcccataattttaacttcagtgatataatacctgtcatatataattgcaaccaagttgtgttacagtcatgtactattgtgcatatataaattaaaacatcatgatatttttatcagtaataatacagtttatatttatcataatgtaatgaccctgattcagatataaatatctgctttaaattttgaagtatgttataatattgcagtgtcaagggcattagaataagagataaagattgttaaaattggctggtcttttaatctcttcaagctttatttttcttatatgcaaaatgagcatataaatatatgcacctgtcactttatataatattatatacatgttatataaatatatatatatatatttgaatttgagaagtataattttgaggagtactctcagtgtttagcatactttatggctgaaagtactcaataaatatttataaaatgaattttaataaaaaaattcatgtcttagttttttctttaggtagaattatcatctactgcatgctttttaaacactatgaaaatcgataatattgaaagtaggcttttggactttaaaaattctcaaatgacagtagaatttctagttttctcccagagtgcacacacttgtttaccttgagatgaagacgtttcagatggtgacaggtttggcactggtggatgaaatttagtatctaaacagtaggcaagtttagtggttatgagaattgtgcttttaacaacacaacaatcttagcaaatgggtctctaacaataaagcgaaatatgaatctgacttatagtaaatacttaattcatggttgttcattgaaggagggaaacctacaggaatgtatattttgggggatctgaggaggaagcacaatcagcgaatgtgtgaagcagaaaaaagtaggtaggaagaaaaagaaaaaatactatcacgtaaggatgtcatagaagttatttcaatcagggttttaaggagaagaaagagtagattgtatcaactacagaaaataaatactgaaagaactgaggagcagtgattaatttggggatgactttggatagaataattgtagaagcaaattgataaaaaaaagtttgtaagaagaaacatattgacagtagagaaaggagcacaatatgtaagagtatattcataaaatgtgatgagggggaaaggggaatataaaatttaagcatatcatgatgttggttactaattgagaaggaagacttttttattattattattatactttaagttttagggtacacgtgcacaacgtgcaggtttgttacacatgtatacatgtgccgtgttggtgtgctgcacccatcaactcgtcatttagcattaggtatatctcctaatgctctccctcccccctccccctaccccacgacagtccccagtgtgtgatgttccctttcctgtgtaaatgtgttctcattgttcagttcccatgtatgagtgagaacatgcggtgtttggatttttgtccttgtggtagtttgctgagaatgatggtttccatcttcatccatgtccctacaaaggacatgaactcatcattttttatggctgcatagtattccatgatgtatatgtgctacattttcttaatccagtctatcattgttggacatttgggttggttccaaatctcactctgccacccaggctggagtgcagtggtgcaatctcggctcactgcaacctctgcctcctgagttcaaacaattttcctgtctcagcctccagagtagctgagattacaggtgcccacaaccatgcctggctaatttttgtgttttttagtagagatggggttttgccatgttggccaggctggtctcgaactcatgatctcaagtgatccacctgcttaggtatcccaaagttctgggattacaggcatgagccaccatgcccggcagagaaggaagactcaatggcaaaagtgctcataaacagaaacagcacccacgtctgatgcggcagctgcccctgcagtttcatcatcctgatgttacatgtggttctcaaaagtggatacagaggttgaattgattgcattccacttcacagattggtcaggaggtccacaaggactggtctctgtgtaactcaggagcaataaataatttttagaaaacatcaactaaataccattaagaccctctccataaggcatgcaagtattccttcgtctggcataaacctcttcacttgttcttacacaattatgtaggggattaaaaaagaaactgccacaatccccttaaaatatatgaatctctttggaaaagtccactcttcctttgaacaattctagatgaattttgtatagttctttcaatctagggcaaattatcttgccaaagagtcgctctttgtttcatttctccagtttattataacacacttatttaatgatatgaatttattaattaatattaattttaattttgccatagccagaggaggacagtattccagggtgcttgaatatctctggaaaactgaacaataaaaataaaaagaaataacccttgaagaagtatatgtattctggtaggcttcagtcacagaataaaaaattacatttgatcaaatgatcgaatatatattttcaaagaccataaattttaaccaaatataggttaaaggtgtataatgtagtgcttctactgatgtcatgagatattcaaaatttgcatgacaatgctttctgcttcaaatgccttcgagatggcaggattcaggaataaaaggacagagaaattatggaagagctgttatgtgactaggattagccaggaagagataaataaaatgatgtccaggtaagcatctgcatatgtaatacctgctcctgtgagggtagaaaggtaacaaagtagacaagagcaactaaggaccttggggtcccagagatcaattgtactggtgcttctttgcacaatttattacttttgccagggaatcctgctatgccaggaagaaaagggtattcatttagttaaactggatttattgagggctgggaagtagtaagattggagtgactggaggtcacagtgacaggaaattctaaaatgaaaaataaccacgtaatttgtgtggatgaacaggaagctcagtctaggcaatgcagctagatcctggatagatatatgaactagggtaattggaagggctaagaaagatcagaaaaataataaggtaatttggtggtgatggaaaggaagagggtgtagttaaagaacagaaatgtgagaattcaagtctgacagtggagctgtcttggataacatcagatctcaagttagcaaaagcaggagattgctaaagtaaagtggagatggacttgtttgtttttgtttcttacttacagattaaagattccgagcactgtgctaatgctatgagaggtataaaatagcatatatggcttttccttcaaggagctagcagcttggtaagatcgaacagtatttagcgctacacaaacatgtttaataccacagagaacaagtgttgcaataaaggaatcaggaagtcgaggggcactaaagtggaagagattcattccaaatacatgggttaaagaaaatctcatggaatagatggcacctgagttaacttcttaacatttgaaatggattttgacaggtagaaataatacaactggtatttttaacggattcttcagttgttaagaagtccagtcgatagtcttcaaaatacagcctgaggtgtgcagaatatgtgttgccttcttcatttcacgaccagaggaactgcgggtcagagagtttcacggtgttaactgacttgcaaggacctcagagatattgaaggagcatagatgggcatctcagacaaaggagtactggggagaaagacgctgttgcaaaaagtgcaggacttctttagggaatgacaagttatgtggtttcaattcatgaaacaactggtgaatttaagatctggaaaataagtcacaaaaaataacttgaaaaagctcctgatgtatctaaacagcttaggttttgtgcctgaaaaattaaaagagatgacatggcagtgaaccaaggtagtgcacacagggaagaaacagctcaggcctgctatgtgtggattacactcaacaagacagagtaaaatgcaacagtcacaaacccaaggggcctcttcttatttctttctttccttcaataacatccccctaccaattaagtgataatgaaatcaagtaaatgagtcaatgttctgtcctcacacacagggccactctgtgagactgatttttctcattgttcattttgtgtactttattctctcttttttccatatccttcaccccacagagagatatttctaaaatataaacatgatccttttcctccaatgcttcaatgtctccactggctcccctgactctcaggatcagagagaaaaattgcagcaagatatgtgagttatcactgattacaccttgtccgatcaccaacttcatggattgcctcttcttcagatccacacacaatgtgccagacaacccacatttctttggatatactatgtttttcatgccttggacatttgcttttggattaattatctcctctctaaaaattttgctttcccttacctgccccaaccaagccgttccactgtttagcccaatagggtggagtagctttgattctactcacttcttcttaattcattttaaaaagcagttattgaatcacatcgtttctaatgactttaagggggaaattatacatagaacttcagccatatgtgaaagtaccgggatccaccaattactcatcaaatccttattaaatctgtaaattgttctcatttttaggggaaattgaggcacaactaagtgaactaagttgcttcatcttcactctcactaatataagtttatttcagtttcatatcatctcaagttttaccagtgacagtcttttcctcactggtctaataggaccacccaagccacacaaatctagccactctggccctctatatggaggtgagcagtggttccttgcagactttaagcccacctcattctgagcctgcctgtttttccatggggagcttccagaactcatgctcattccagtcactccaaacttttacattttagtctctgcagctcttgctccttgtgcatgaaagtacatgccctcatgtggggtaaaatcaacaatgaatcaaaacaggaatcactaactatattaattagaaatgatatatatttatttgattgcttatgttaggttgaaaattattcatgaatttgtatagtgagcagtatatttttcattcaaggaagactaaatttgtattttaaatgaataaacctactttgagattgagcaacatttaaaaatactttttactgccagagcagttaccaagaatctttagaaagctgtataagtgcagagtggaaaaacaagcctgaacaaaaaacttcagactaactcttcagtgatgtaattttttttagtgtgtgtgtatatatatatatatgacacataattttgtctgagtatccataaggttaccgttaatgctgtaaaagtttaatgtctcacaatgctaaattaatgggtaatggagtctattgatttcataataaatattaactatttttgtttatcttgagttaaaaaattacattttctaaaagctacaaataaaaacaaaagcacttcagtttttccctagtgcttgatgagacaataattctatgtggggacattttcttttaacactgaaatattacaatcaagagcatattgatggattattcaagggaatattatacatagaacttcatccaggtattaaagtatttagatccaccaattattcagaaaatacttgttaaatctgtatggtaaattgttctcactttagatgaaattgaggcccaactaagtgagctaatttactaataaccttctttacttagtaatggaggccccagataactgtaatttttatgatcaacttatactataagaggtcatatgtaataaaaaaactgttcaagtatttcacttatgttcataaaagagtttccatatttgaaaagttgaaacagaatgtaaaaagtgatatgtattaacttataagcctagtttcataaaagatcagcccctcagaattattctatgtaggcactatgtaacatctataattacatagattgaagatttgatctaagtgtattgacttttattagctaaaaaatctagctgctatttaaagcagagaagacaaatatgatcaagatatgctttaatttatggtacatgaagcaatggttataaccagagagcagaaagaaatatgtattactaaactccaattatttctcattttctatggatggttaaacttctgtctgaatactttaaacatcatacttgccattatacatcagaattaaagctaaaaatatcatgtgaaattataacattcttttcattcaatgtgtatgctgtcacaaattcaaactaactttctttcaaaaagatggacaatagttatacttctgaaattcttttagtatattttcaaaagaaaacaaaagagcatatctaagcacatcccttttttcattataaaatgctgtgtccaagatatgagaaccagtttctctaaaaatattaataatttgaaccctcagagtcgtggatgcccaaggccttaccatgtgcccagttctgagacaggaaggcagagtggcgtagacctaccagtagacctgagccagacatgctctatggggttttctttgtttggggaataaactctgttttatatccaaaaatgtctagtagaagagccaggaaaggtgtttggagaaaacatataaatttacacattttacatagcattttgaatactgaattgcaaaagttttctgttactgtcaaaattgactggaattgaaatatagtttgtgtattgtgttgcacaatgaagtaattcttaagcctgagactttggctagtttccatccattttgggattttatctattcctgtccattaagtttatatctaaacattgcaatatctggaagtaaggaagtcattgaagctatatgaaacacttttaaattcaatagcacttttgtgaacaattttaaaaggcatcatttaattgtctatgacaacaaaaacaaaagtcaataaaatactgtcagaatgcttagactgatcatagcattttaagaaaaagtttaatgttaatgaaattggcaacatccatgcaaatggagagcatgatcatttacacctggaaagaaggtatgaacctcttgttccaaatcatctttgggaagatgaacagactgagaatgagggtggagaacaatggacaaagtgctgccactcatgttatcatctagtgactttttaatatcacgcttaatattttattgcctgtttttacgatctttctaagtcagaaaatgcattgacaaatgttaagaggagacaatggtagccaaaataataagtaaactacgcataatgttatagcaaactgggaaaagaatgcatctaaaatttcttagattctcttttatctacatgttgtatgttttagaagtcaaagtttctccatagttacctgaatctaaagatgcttcctacgaaattgaaattgtatgtcatttgggtctatcttcagtgtttcatttaaaacagagatgcttataaagtcaggtaaccaaatatgaatttggaggctgatatttatattgtatgaaagataagcttttcaacagatactattacgagctgcaaatagatcaatgacatgaggttttgatctgatttgttctgaacatctgcaggcagaatgcctttcaagtcattgctgtggatggggtctgcactgggattattcagtgcctctctgctgaagactgcgttgactggctacaagcaatagcaactaacatttcaaatctcacaaagcacaatgtaagtaatgattcaaggaatacctagccagggtttctcaggctttataaaatccttcagtatatatgtaacttcacatcaactgtttggtgttcttctcagaatgagacattcatgaaagctattctggaatacttattgtaagaaaactgagagttctggcccaatttatgagttcaataatacacatagatttccattaacaagcattataaacccctacattacttaagcaaatgaaaataactagttagcatataatccctaaatatatttaagtaaaagcattcgggaataatatagtactgggtttcaagacagcattattgatttacctttagtgatcttagaattgcagctaggaaggtttgaggagtagtaggctaggaggaaaggagttagcatagagactgaagggaacagtcagaagattgccattgtctcacattagatagagcctggtctgtattattagaaatggcttctctgcattttctctctttccactacaaccgttgcttccttccacattcctgtgtctctttattgtagctatcttctcattattttaactctttaataacctaaataattctttcccccgttattaataattctatgagaaatatagtctaacaaaatatacaaaaccacaaacctcaccttactgagtatcaatctaggtatcattaatgataattattttagaaaaagtacttgtcatcatccatgcctttgtgttaattctctcctcagtccgcaattgttccatgcgatgttgaggcatttcagaagtcctaagggagatcaggagtctaatatacaaatgatcaagcagaaatatataactctgtcaccagcacgtgaacacacaaaattgttcttatgtaaatgacccttcagatccaagtatccttgcacagagtagactttgctttgaaacctaagaaaggattgtggccactatacctttctaaaacgacaggaggaccactagccaataaaggcaactgtctagtttccagtctatggctatttcaaacaacgccatcataatagccatgcatatggtgatgggatcctctgggaatggggttgacagtcatgggatatgtgcatggtcaattttaccaggcaatgctaagtgttttccaattggctgtgcaatttacccctcactcttggtggatgatatgtttctttctataatcttcaaaactctgtgtcacgctgccttttgaatttttggttgatacatgtggaaatgtgcttccagtgtgaataaaaacagattttccttttttttttttttctggtggttccaggataggtgtaaatacaccaagccttacccaggctcatccctcaacaaggaggctaaacatgggtatgtctagtttgggcaagagtgagctctcactcccaacccacccttgctaatctggtgttgtcaccatattagagttgaggttgcacaagagggcataggtttcagaatgactgaaaaacaaagaaaaaaatagaaaagaaatgcaatgtttctctagggattgtttcctctccttcgactgacttatatggatgcttctagagttaaacacagaaaaatacctgagagtagggaatttgttacagaaatgattagagtttcttaaaaacaagatatgaacttatatttgtgagacaaatataattgtgttcttttgaaagaacagaatgttaaactttgaatccaaagttttttttccttatctagatccaaatttgcattgacctaaaatcctaggaatattgtcatgccatatttcttcaaacgtctattcagttagaatgctgtgcttcagctgacaagcatttgaaaagtcaatgctttagttaaaagcaacagcaacaacaaaacagtgaagatgcaaatgtctctaccctctgtaagcctaaggagggacaagccgcattttactgcttgtttttcatccttgtaataagtgctcaccgtcatatgattcccctatactactgttttaactgtttggagatccatatgtctgttgcatattaaaagttatgtatttcttctttcacctcctgtttctatattctaattacatgttcttttgttcttgcaatcagtttccattcaaaagtattaggttccaatgtattctgatatggaaagtactacataaatgttgaaaagttattaggcatagcaataaaaaatgtgaaagtcacattgatttcagagaaggcagaatgcattgatgaaacaattaatatggttaattagcataaagaaagaaattaggcagaaagagtagctaggaaagttttgcttaggttagttagatatcagttctacttctcttattttttaattctaaagatatactggaaataacaccttatggaaagatgtagacctttttctttatttgccaatattctgagagtataggcttgtataagtctgacttgaatagcttgttaataataggtgcagaaataaaaacattgtgataaatatttaaagaaattccactcaagagattatcaggcataaaataaaactgaaaaaaggattaaaatgcatataaaataataagtttgacagtttaaaaattatgctattgaaataagacatacatatgtatataaactttttaatgatgaatcacattttattgtaaagctagttggagaacagacaggggaaggataaaagcaaaaacaaaaaacgaaaaacaacctgtgttagaataattagatcaatgtgttgatcattttcttttctctttgctcactagtttctaaaagtaactttgtgagacagggattttcatacccagtttttaaaaattctatataattatagttgctataatttttcttccagaaataattgatcataatggctaaaaatacctaggcaaacactgacaatgtaaaattgtattttatcattattcagagtggctccaaaatatttacaatagttgttaatatttaatacttagtaaatgatgtctactagaatgagggtgaaggctttagggacttgtcttaagctgtattggcacagctttcaactcattttatttaaattctatgctttcacattggaaagcaaagcatggcagaggctatgctgttgtggggtgggtggggttcagctcatttcttaaccaactctcacataatgagcatttgctatattttaggtgagcattcactcccagtgaactattattttaggtaaagtggacttgagtagattctaaaaggtagaatttataaattgtaaaaaacagtaattgcttccaattaataatttaccaattttttattcattatttcaccagctatatgaacaagtattagtagaaagttatcaatttttatttccatgatcatttcttattaaataattgaagactttaaaatatgcaatgttgtaatagggtgaagtttttgggaaccttggaaataagtaaatatatttggcataatatataagggatatgaatcatcagactttgatgggtaggttagtaagatgcacctccgtgatgttcacttcctggcatttacacccttatgggatcaccttccatgtgcgttggctccatagtgagctctgaagcagacacttctcttacaagacttcagatgagatagcagatgacccttgagagcatttttagaaatccagtacattctaacccacactaatcacatgctgaggactcagcacatgtcagtcacatgctgagggctggctcaacacacaaagatgtcccaaccagaggcccatgccagctctcccctaccctgcaccccatctcacaccactcagacaggcacaggctgtacagacaagttatttacttcttattataaccttgggccctttctgccctggaaagtgggggtgggcaaggaggctgggcccagcatgcacccccacttctttaggggctgatccctcctacagtatcaggcgggtggtggcaggggtagaggttggagagtaggggagaaaaccaaaaaaaaaaaaaaaaacaggatgaagacccagctatgccacatgtggactcctgacatacagagattataggataataaatatttagttaaagtcacaaagttttggggtattctgttacacagcaatagggaactgtattagtttcctaaaattccaaaatttcctaaaacaatttcaaagcaaattacacaaacttggtgccttcaaacaacagaaattcattttctcacaattctgtggcccatttgtctgaaatcagatgccagcaggatacatccctctggactctgtaatgcagaagccttgtctcttccagcctctggtggctgccagcattccctggctcacagccacatcacactgacctccgcttctgtggttacattgcttctttctgtgtgtgtcacttatcagaacacttgtcattggtcccagggcccactcaggtattccagtctgacctcaagatctttaactgaagtagatctgcaaggaccctttatctggttccaggttttccatgtggatattttgggaggagcatttttggcctaccacaagaactatctggcaggtgaacaacatgattagatttagacagttctgtctgatttttgtgcaatgtctcctatagcagttcagtttcaaagcctttgctttgtcatttgggtgttccacacgtgcattgcttggggtgggcccagagcttcttgcagttcacacataaaatcgggatatcgcctccttcccttcactcctaagtgggagttccccactcttactggatcgcagcatcactctctttggtcttctctccagaaatccaaggctcttctcagagtttagtttcctgtactgatgcacatttcctcatgactggagaaaacagcatgagaaaaggagagaagagtggggatccctcatgccacaaaaactaatttttccagaacctttagatagagggtggattttctctctgagtttccagctggcccggctgccccaggctccatggcagcagctgcatggccaggggggccttggagtcagctcaggaaccaaaacaaaggaacagtaacagagatgtcttccacagctgttggctcgcagaggcctcttcccaggtctctgatcagcaagacatgctctctcagagtttttgtttgttgtccatgacttaatttgtcttgacctcaagtccatgctgggagataaaggaagcaagaaaaagaaaggaaaacaaaataaaaacaggtaaactcctgtttgccatattaatcattattcaatttttacttctttcaaaaaagttcttgctattatttattgtacaatgttctcagatagttagttgccttttgcattttatctagtgcattgaggtataaccggtgggaaagatggctgcagtgttttttttttccttcttggctctaactggaagcaatagatacttttaatagaaaacaaaatataagaaacaaaacaactacatgatatttgtagagtatcagaaaaaaataactgctattataccttggaaatattttttaaaagtcctgataaaataaatttattttcagacaaatagaaaaataaagaaaattcaacaaaataaagatttactaaaagaaatattcagggtacttttaaattttttgtattttttatttattcaacaaatatttattgaatacttgcctatgatgtgtcagatactgtgttctatttttttgtttgttttgttttcaacttttattttagaaacaggaagtacatgtgtaggtttgttacaaaggtgtattttgtgatgctgaggtttagagtataattgaaaccatcaaccaggtggtgagcaaagtaaggggtgctatttcaggcaaagaaaaatcatgccagatagaggcttggagatgtcagaaggagtaaatagtacaggagaaaatgaatacatagatgaatctagatgaacattgtttgtattaaaatgggaataatttcttgtagtgtttagataaataaacaaaattaaaatatattgcaaaagcaataacaaaaatatccaaaggaagcaaatgtaattagtattaaattttgttatgtcaaaatggattgtttgtttcctagagaaagccttaactaagtagccagaatgtgtatcttctaaattaacaaaggaataagtgaaaaaataatgctaatacctactaaaagaagttcataaaaaaataaaaaaagaaagcaaactagagcaggttgaacaaatagtaagcatacagtaagatgatgatttatatccaagtataagatacactttttacaagaggaattctaaagatattggaagattgaaagtcaaaatttagaaaaataccttgcacctgaaaaaataagaacttggaaaggattccctatttaataaatggttctgggagaactggctaaccatttctggaaattgaaactggaccacttccttaccctttatacaaaaattaactcaagatggattaaagacctaaacgtaaaacccaaactaaaaaaccctaaaagaaaatctaggcaatacctttcagtacatagccatggacaaagatttcatgacaaaaacgcaagaagcaattgcaacaaaagcaaaaattgacaaatgcaatctaattaaactaaagagtttctgcacagcaaaagaaattatcctcagagtgaacagacaacctacagaatgggagaaattttttgccatctatccatctgacaaaggcctaatatctggcgtctacaagtaacttaaacacatttacaagaacaaaaatacgttaaaaagtgggcaaaggacatgaacagacacttcacaaaataagacactcatgcagccaaaaaacatattaaaaaaaccctcaacatcactggtcattagagaaatgcaaatcaaaaccacagtgaggtaccatctcaggccagtcagaatggtgattattaaaaagtcaagaagcaacaaatgctggcaaggttgcacagaaaaaggaatgcatctatactgttgtgggaatataaattagttcaaccattgtggaagagagtgtggtgattccttaaacatctagaaacagaaataccatttgacccagcaatcccattactgggtatgaacccaaaggaatataaatcattctattataaagacacatgcacgtgtatgctcattgcagcactattcacgatagcaaggacattgaatcaacccaaatgtccataaatagtagattgaataaagaaaacttggtacatatacaccatggaatgctatacagtcatagaaaggaacaagatcatgtcctttgcagggacatggatggagctggaagctgttatcctctgcaaactaacacaggaacagaaaatcagacgccacgtcttcttacttataagcaggaactgaatgacaagaacacgtggacacatcgggggaacaacacacactgtggctggttgttgttggaggggagggagagcatcaagaagaacagctaatgggtgtggggctcaatacctgtatgaggggtttatctgggcagcaaaccaccatggcacatgtttatctgtgtaacaaacctgcacatcctacacatgttccccagaacttaaaataaaatttgataaaataaagaaggaaaacaaataaataaataaattgacataattagaatatttctctaagtgtttaataactaaatggatttgaagcttttagactgacattatgacattttaagtaatgcttccatgtaactgaatgatttggtttgttctgtgtccgcatccaaatctcatcacaaattgtaatccccatgtgtcagaggagggacctggtgtgaggtgattggatcatgggagtggtttcccccatgctgttctcatgatagtgagtgagttctcatgaaagctgatggttttaaaagtgtgtggcagttccccctttgctgtctctctcctgctgccttgtgaagaaggtgcttgcttctcctttgcttccaccatgattgtaagtttcctgaggcctccccagccatgaggaactatgagtcaattaaacctctttccttcataaattactgagtgtcaggtatttctttatagcagtgtgaaaacagactaaaacagttaatttacaaattaaataaatatgtattttaaaaaccagaaaaaaggaaaaaatacagtgcaaaccataaaagaaaggtttgtagctttgttaatactaggcaaagcaaacttcacagcaaatatattactaaatatagatatggtcacttcataataataaaaaagtttaatgcactaggaaacaaatgcaaacatcatgtcacatgggcttaaatatatctagatggaattgaaaatatagactgatgagaaagtaaaaatcatgaaatctcagaactagagacacaaaatggttaaggcctggctatgaggaaactgaaagtaaaataatagattacggaatcagaagaagaaaataaaattcatgctcagcctttattttaacctatagggctagtcattatcacattattccatcatacacaagcgacatttcccattgaactattcattcagtactaggtgtctagaatgtctccccagcctgagctggacattagaactcactttaattatctgtcttctataacctttcagctttcctcactgtcattccttagggtcaaaatagtcctgtgaagattctcgccatccaaaatccatcttatatatgtccttacccaaaaaagataactgttcatacattttaaagactcctaaaattttctgatttataagttacaatgtgtaactggaaagcaatttgaaaaatgttattttgtcaataattcaaaactgacattttatcttggtttcatcttataagatttaactctacccatctgtggtaggaagaataatgcccacgcaaagatgtctatgtcctaactcccagaacctgtgacaattccatgtcatatggcaatagagaattaaggttacagataccattaacattgctaatcagctggccttaaaatggggaaattagcctagattatccaagtgggtctaatgtgattctctacaagtgtaagaagtcaaagtgagagaacaagagacagcagtgaaagaggaactgaacccagtatttctggctctgaagatggagaagggaatgcaattcaaagaaagcagtagtccaatagcagtgaaaggctgcacttctactctagagcctccagaaagcagcacagccctgccaacacctcaatttctcccctgtttgattcatttaggacttatgacctacagaacagtatgataatatataaatgtgtgggtttttcttaaaccaccttagtttgtaggaatttgatatgacaacaatagaaactaatacaacatatctttatccagttgcatgttttcacttaatgtaaagttcacagtttaatttgaaaatcatgcctttaactcatgtcatatgtagctttttcagaataaccataaaatgtacttgcatatgttagaaaacaacctaacatttacgttattaattagtcccagtgcaaatcagcctatagtaataccactagagttcctaaatacttaatttataaccaactgacatcatcagagaaacaatgatcagaatcgttgcattcacgcagtctgagcaaggactgtctttggaactgggaagcagtgttggctctcagtgcctggataaacatggctagaagctttcaaatatcacaggaaaccaggagggagaagccacacaagacgagaataaggaactgctgtccctgaagagcagacaagactgttgaattgtcaggcagtcacaactgagaaagacggcaactgatccctgagagtgtctgtgaagatggggcctagtgctggctggctcagatcacacagcaactactgcctgtatccttgtatttccagtacttaacacagcccatatggagcaaataagaagtgaatgaatgagtcccttatcaatcaacagttgtttgaaggaaacattgctgagaatgtaaagaaaaatgaagacagaagagagaaaaacacatttagctacagtaagcactgcaataagagattcacatgtactactccttaaattcttacatgttccgtggggccactgtgctttagagtagggaaaagttgctgtggtcatgaggaaacagaggtgctgtccatggtagatgttccctgtgtttctgggtgtagttccttttgtccatcataaatctctgtctctcataatgaaatgtctgatagacaaattttttttaaataaattttgtttctataactcactgagtcactttctaagtggcaagtacagaaaaatacagtgtagcagagcaattggaaataagtggactttaaagcacatatctagttgcaaatcaagacaaatagttttgaacaggtaccatgtacaacaacttggagtctcctaagaatacattgacttgtggtttcctaaaaccttcttactggaaggtatcaggagattatctagccccatttcctgcccaattagaaatctctcctgaaaagattctttcagacagctctctcctggaaatctttcaatgacatagaaagccattgcttcacaatatagcaattaaattttttgacaacttaatattaggaaatacttttactgaataaaaatctctctcattacattcatccatttgtactagttctgatttgagaaagacacacaataatccaactttctttttcaaagacacacaataattcaactttctcttcctccagcatacaaatacaagtgtcacatgttgcagtccgttttttttttttaaaatagaaatatcactgactcctttctgtttctctctgacatgtcatccaagactttccttgtcctggtcgctgtctctggatgtagaagccctttagaataagtagagtgataatataattaactttgtattattgtaattgtcatgagctcaaatatttttgagattcattatagtttgatgtatatttactgattttgtacaataatatataaacatatatagaaaacaacaaccttacattttattataatgatcaatgaaggatcatattttcacattacctgatattgcacctcatggtggcaatagtaaataaaattcaaagtttgaatagttattttgcatttaaactcatgtatgggccagaaagcccaattcttgtgctggctgcacgaattactaaatactcaaagggatgaaagcccctccctcccatactcaagtatttacatgaaaatctagcttctcagttttttacttttcaaagactgagattttagtgttgttgccttctttcttagcttacaatgatatttaagatgtttaacagaagtgttaaatatcatagtctataagtttttttaaagattaataattcattaaacactaacagaaggctagtttttgccttatatctttgaaaataatgccatacaatgaggacttcaaatgcaatattgtggatgttacaatctccaataaaaatatgctattattaaaaatgtcctttctttcttaattttgtttattaatgtgtatagcaatcttcttccagcgttaagaagggaaagtggaaaatatacaactttggagtggacaaacctaacaaacgctactgcagctgggtggttaacgtcaactgtgatgtcaaattaataatatgtacccttgatatgatgtaacaaaaatggccctttgcctctgtgattttcgtccccaaatccataatcctagtctcatcatggaaagatagtggacaatcccaactgatgaacattctacaaaatacctgaccagcactcctcaagactgacaatgtcttcaaaaataaggaaaaattaaactgttataacctagagatgcctaaggggacctgttgaataaatgtgcatcagtccagttgggatccaggaacagcaaaaaaaaaatgtttggtaaaacctgtggaaatctgaaaagagtatggactttcgttaatattagtgtattcatatcattgtattattaatcataataaatgtgtcattgttatgaaatgtaaaatgccaataataggggagactagctgtgtggtatatggcaactctgttctataactgtatgttttttgtaaatccaaaactgtcctaatattaaaaagtttacttaaatatattcatatatatgtataattaagttaaccccaggtattaacaaacttgtgagatgcttatcagcttcctgatgtattcatccatgtattaattcagcaaacattttgtgagagcttactgtgtcaagttgttagggagcaggactgtaatattgagcaaaaaatggttagtctctgccttcgtggagccaagagtctagttgggaagggagacactaatcaaattagcacataagcaaatgtgaaattacaacattcatagataatatgaataagtgctatgagaggttgattctgtagctatccaggagtatgaggacaatttcctaaagtttatatataaacaatgagtaagaataaaataagagaattggtgggaaaatatattttacgcagaggtaataaaaggtacctattcaggaaaaaaagtaaagagatacaatcatagcaatggatattatttttttacggaaattttcacttgtctagggtaaaatgaaaatgtttaatataagtgaatttttcataagactcaatttattttttaaggataggtctttaattttatatattgtcttcttacatttatggagttaaatgtccatcctcttatcaaatgatggtaatcatagaaaaattttgttttgtctggtatccttgcttaataaaagaaaaggctatttaatcaatgtcattactgttgaaaggtttaatactccaacaaatacactcctcaaaatcattgacccagaatctttacagatagggcaaatctgcatatagtcccaaaacaaccggaaactttgagattaaaaccaggtcactgaatcctgaggctggaagaaaatgatgatgttatcagcagaatactaaccatgacaaatgggtcaaattttggaaaatcacagaaaccatttccacaagtctctagaagtctggtcttttataagtctacaacgtttgtgatattaattgaccaagtaataaaactatcacacacacacacacttgaaatatagtaggaaaaacaaatatttatcaaaatttaggcagcataaaagacagaggtctgtatgactgagttgggaagcattacaagcaaccagtattaaaaggtatttggatatgctggatctgaaaagaggaggaagtataacctcaaaactctccattgtttaatcaatcaagggagcaaagtctactgttttgttttgttttgtttttcagaagtctttttgtgttgtggaaaatgcatgagtttgatgttatcaaacttgggaacttgggtacaaaatcctagcttctctagttactagttatgtgtacttgacttcaatttgctccttagaaacagaaactaggtaactttaagttactgtgagcattcaatctaaaaagtgctttaaacattctgtcccttatatgatgctgaaacatttgcaatttttcttctttccagttgaattctaaattaaatgatgtaatccataaaccatcaataaatggcagcctctatttgtttattgtataagagtttacacatctttgttgatggaataatagtctttgggattctcaagaatcattatttgggtaatagaatgttgatgaaactggacaaaattagttgaaataaaattgtggcatcttaagcagctatgatctttgccaagtgatacatctgtactgcagtttcctcctctgtaaaagagacagagaggaggcaggtaaaatgctaacctccctttcagctagcacttcatgaatcaatccttcccaattatgctttcctactggaatactgaaattaataccaatctgtaaatagagataattttacatgacatttctattaaggttacttacagatgtaaaggaatctcctctttgattctgattcttccctatataccctatatgtgttgtttatttagatatattttgttactttgaaacatatgtgtatgtgtataaatgtatatgtatctatatagaaatatacatatacatacacatatgtatatgagatattattctagccttaaaacaagagaaactctatgtatcggtggagtaaactgttgtttttccccacctgacaagaattctagatggtagcatttgctaactatatttcagtgtgatggtcaaattaataatatgtacaagaaccaatttcctttattttttaaattaatgttttaaatggataatgaactcattacaattgtacattttaatggggtacattgtgatgtgccaattcatgtaaagattgtataatgatcaaatctaggcattttttacagtcattacattaaacatttgtcatttctttgttttaataacattcaaaatcttctattttagctacattgagatacactttacattgttatttgctctagtcaccctactatataatagagcaccatatcattcttccttcctgtatctctgtattcattggtcaacctctcccaattctccccttctctttcccttccccaggttctggtaaccaataaccaatattctactctctacttctgtgaaaacaactgttttagattctacatatgaatgagctcatgcaatgtctgtctttctatgcctggcttatttcacttaatacattgtccttcaggttcatccatgttgcagcaaatgtcaggatttcattatttttaatggctgaatagtattccattgtccatgtttgtgtgtgtgtgtgtgtgtgtgtgtgctatctatttatccatctatctatctaccattgtgaatagtgctgcaataaacatgggagtacagatatctcttggataaactgattgtcctttggatatatactcagtaatggaattgttgagtcatatggtagttctgtttttactttttgaggaacctccctacagtttttcacagtggctgtacactcccaccactggtgtgtgagggttctcctttctccacatcctcgccagcctctgttattgcttgtctttttgataaaagctgttttaactggggtgagattatatctcattgtggttttattttatatttctctgatgattagtaatggtgacaatttcttcatatacctcttggccattcatatttcttctcttaagaaatatctatttaggtcttttgcccattttttaatctgatttttttagttgagttatgttccttgaatattctgggtattaactccttgacagatgcatagtttgcaaatacatctgtaggttgtttctttactttgttaattgttttctttgctgtgaggaagccttttagttcaaagcaattccattcatcgctccatcttctatctatccacatcatttatttcctatcatctgtagagtattggcttttatcttatggccttcaagtcctggtcatggagggcgacaacagctacaaacatcacttcagtttcaggaaggaaagaaaaggaagagggatgagtagaatcagccacacctgtccccttgtatcaggtaagagaaaatttcccagaaacccttttggtagttcttctcattctgtttaacaaaatccatgacaattctttatggggtcgggtaagacaagtttggccagtacttaactttcctatcctctgtagtgccatatgacacagaagtggtggctgtgaatagcttctggatcagtcagtcagtagtatttaccacattgcttaatacggaagatgtattaattctaaagaaaaagcacggatagccagtccctctgtgggatgaacacagcccttcaggattcacagacacacacacaaataatttaatcagttattagagtgtattctacaggcatttcacccatctttctatattttacacacttacgtgcagaagtgaaaaaaaaaaactgtttggaagctatatatttaatccatagagatctgctgtactaccacttgcaagttaaaaaatcattttttttccataaaagcgttggttttgaaaagcaaaaaaaaaatcaaaaaacaaaaaacaaacaaaaaacaaaaaaaaaaccttctattctgtctgccacattgaaaaggctcaacaaagcttgtaggtgaattgaaaatcatgatggaataaagactaacagaaggaagatttaccaaaaatgaactaaagactgtgattagaggttgtggagtgtggtgctgacaggcatgggtgtcactgaagctgacattttcttccttttttatagccgctgacatttctgagtcctaaagtctactttttagcattagtatgttgctgtctgcttgtctgcattgttattctttatccaccaaaatgtgaatgtcagacaaagaggtgccaaccaaaaatgggttagtgtgagtgaaataaataattgcagagagagtcatttaagtcagaataaaagcaagggcaagtttgggcactgcactgcattcagattcttaacaatcatatttttacattttacataattagagtttatgtcaagaagtatgtcaggaaagtaaaatatttcagtaaaatagcctgctttgtagcttggaacagtactcaccggaacttaatttttttaacaagttttaatattggaaattatcagctgatttttatttaccacaacccaaaacatctgcgttgatttcctctccttcggatatatactcactaatgagattgctggttcatatggtggttctatttttattttattttattttattttattttattttattttattttattttatagatggagtctcgctctgtcacccaggctggattacagtggtgcgatctcggttcaatgcaacctccgcctccagggttcaagcgattctcctgtctcagcctgcggagtagctgggactacaggcgcacaccaccacacccagctaatttttctatttttggcagagacggggtttcaccatattggttaggctggtcttgaactcctaacctcaggtgatccacccaccttggcctcccagcgtgctgggattacagggtgagccaccacgtccagccttattttttattattattattattattattgttgttattattattattattattattattattatttaggtggagtctcgctctgtcaccagactggagtgctgtggcatgatctcggatcactgcagcctctccctcccaggttcaagcgattcttctgcctcaggctcccaaatagctgggactgtgggcatgcaccaccgtgcctgtagaatttttgtattttttagtagagacagggtttcaccacgttggtcaggatggtctcaatctattgaccttgtgatctgcctgcctcagcctcccaaagtgctgggattacaggtgtgagccaccacacctctggctcttatttttaatttttgaagaacctccacacagttttccatagtagttgcacgaatttacactcccaccaccagcgtacaagcgttcccctttctctaccccttcgccagcatctgtcataataaaatggagcagttttcctgaacatagtttccttccctctgcctccaccacccttttgtccaatgagccctgcctgcctgcccccatgcccctctttgctttgcttgtctttctggccagggcagctccagctattagcgtttcagcagccgtggaactatgaccctgcacaggggccaccccatagcataccaacgctgctatctccttcagtgcctagggctggagttagcatggccttcatcacacccaaagagaccgaagctaactccctgggacctgcctcctgtcccgggctcaagagaacacagcaggaatgtggggtaattgatccccaggtgacatactttgtccagtgaaagaccagggcaaagaaacagcctgctgataaatttgctcactcttgctcaatagacgagctgtttggatttgggagtgcagtgatggcacaggccccagagccaaagcacacttaatgaagcagtgcttcactgagaagctgaggccagttcagggatctgagaactcccacttcatatttgttttctgctggcctgccttgctggccttcacctatgaccctaagttccttaggctcaaatatcttccctaatcaattgttaacatgtgagactttgcctcacactctatttctacagaagcaggactaaggaaacaactttcacctctaaatgttcattgcagagtactgaatattccctaggtgattcgctctcacctcctaccaggcataggagtaaagaggtgtaagtgaattgtgttaagcagtagatgaaaggccattagaaaattacaaaagaaatcactttgagtgggcagttgctccactgaacatgttttagaaacccctcattctaaaatggagcttcaaagccaaggacccctgatgagggagcagaggtggtcacacacgtcacttgagggtgctttgagcttcttatgtatgaacactgtgcatttcatttatagaatactggctaataatataccaatggtaaaactattttcttcacctgtgactaaaagtaatactgataaacaaaaaacaatttttattatttcctgaagcccacggtgactgtgctaggtaggtacacctgcccctatgagaagattcccctccttctcatactcctatagcatcttgttataatactcgtctcagagacttaggattatttattgtatgtttgtttctatcacctattttatatatatatatatatagagagagagagagagagagtcatttctgatgtttggtgaattcatgcaaaaatgaatgattcgacactgaacatatacccatagatatttgtaagtgattgcgacctactttcaggcttctgattcacagttgtatgtgtgtgcatatgctaatcttaaaatgatgactgagacagataaaattggataattcttgttataggaaaataaagtttaagaaagctcactcagatataatatctaatcatcctaaggcattgatttactgttaatggatatgttttgaaaagcaacatggcctgattttaatttttatacatagtcatgagaaataaccaaagtaaaagggcataaaaggaaaaatatgagctgaaatgtgagctctagaagcaaaagtcatgtttaaattcttctcttctcatggtaaaagtagagttttctcaacagttagaggtgatatatggtcatcttgtatccttacactaatgtcgttatttgtcaagtgaatttatttctatagaataatgatctctctaggttctaacacatttgttaaatagcattggccacacatctctaaaaaattggaggaatgtttctagctttttggttaaatcttcaaaatggttctagctttttggttaaatcttcaaaattgattttcaccagaaaatataccctgttaaacagcatcctgcattgtccatctggagagcacaactccccagtcatcaaggtgtcttgtatatgaaagctggaaattaaaaaattggtatcgttaagatacaatttaaacatataagatctttgattaaactggcaatgtaattttaaaaaattctatccttaaaggcatttaaattcagaaaagaggaatatttttaaaggaagatttgaatttgattgaatttccctgctggtctaaagaggtcatcaaagagaatattattactactaaaagtacattacaaattactgctaaatcaatgctgctaaaagttaataaacaaaattcagggatttaagaaacaggacaatatttaaaacaaatgtgcacttctgtttcttaaattttttaagtaaattaattccaagcagatctttattaaaatcagttgtaaaactggctctatttaatggatctataataattgaacttactttaaccactttaagaggttaccattattaacattcagtggaatgagtttctaagaaaaaaatgtgcatatatttgtcattttcccaaggatttcctgaaagtgaatattattcctttgaatgttgtccgtaatatctaagcagatatttaattttgacaacaatatagtttataaattttagtaatttgataaacaggataattctcattatcatttcagttcttgagtatgaagcatattgtttgatttgtaatatatgcattccataactttatatttgtccccatgttttagaaacagaatactcaaattttaaaatcatagttccagtaaaaaatgtctaatgaaaaagtttctatttaatttaactgaaaatttaataacttataagtatacttcttatatataatagtcttatttctttaataactgtttttaaatgtaaggtttcattaatgctagtgattcctgtaggaaaaaaaataacgtgatagaatcaaataacaagaataactggtgaaagttcttaataaaataggatgatcttaattctaacattttttaatgtctggaaaaatatatatgatattcagcaaatactattttcagtaattacctgtaacatctcaacccatttatgcctagggttccattattggaacgctaagcatgtgggagttatttatattctactgctcaaggtcattaccaaggtctgattgcaaaaactaaaaaagactgcagcctcaggcataaataggttaaaatactattttttaccattccatttcaaacagaatatgaagattattttcatcttgggtatttagtatattctttcacttaaaaatactattcaaactccagtttctgaaagagtacatctatatttacctgatatttttatcttttggaaataaaacatggaattccgtttgcttatggttggtaaaagatattttttaaacgtgtgccttaattatatttttactttagaaatacagtaaagtgcagaaaaacattaaagtgaaacatgtagcaacaataatggctcatgagtgtaatattaatgttttatgagtatatattacatatacttgaaaatgtgtatttttctttacacatataaaacaaaattgccagcttcctatgtttatggtattatcttttgttcatatgtgatcataaacacttcctcagaacagtaatcatattctgagattacccacttttaatggattaatagatgtttggtttttttgtgtatattatataataacttacgaatggtttaatatttgacatgtaagtcatttaaaatattttattaatccaatgaaagcctatggatttttttggtgtaccagtcaatgaaaacattgctgactatttatttgcataagaacatgaatttttttattctcatgaacctagcttgactttatgtaatgtgacaacaatgtgtgaaagtatattaacatgctgttcaatatttggcccttattggttaagatcacattaatggttttaatctattgatgtttgatcatatgcaaaagtggcatttcacattttcacatttttatgaattttctcttacatagatgtccttttctgtttggtcatgtttgtttggcactctgtgcactaggtactgagtgtggtggtgcaattatgtcagacctagtctgttcagtcctacagctatgaaggagagcatatgtatttttaagaagagtttattatatagtggagctactaatcattttgtaatgttttcttgttttcaagttcgtttatgggggctttatgaatagcccactttttgaatatttatttttatgtagtgttcacattaacttttctactgaaatgaccttctttgaatttgattagtccattgcaaggccaaacacacctacttctaaaatatgcctcctgatgaaggtaataacagtgtgagaataacaattgacagagctatcattttcctctacatttgtggggtggcatcttgagtgactgcatagcatgcccaaacacacctcagctccttttctgttttccagactccaccataccaaagtagcaagcccaaggcccttacttctctgatctgcatgttgggtgccaaatttcttgctgtttggggtttaaggtttggatgactctccgtgagggcactgctgctacctctgtatcgttgattgcttgtgtgtcctctgtagggctagtgtgcagggtcggcagtggaacagtgtgagccacaaggagacaaaccaaatgtgagtctgtatttccttttccatattcttcaaacatgtactggtctttcaaatgtgaatctcatagactatttctggaaatttctaaaaaatatttctaaatgaagagatcacagaaatgttcattcatatcttcttccaggaaacttctttcagcctcattttgtttccttgaaatagttcctctttccctctgtctgtattcaattgttttttctttccttatttttcagcagttttactatggtgggctcaaaattagtagattttcttaaatttgtagattaatggctttatccatttggaaaattttcagctcttccacactattccattctctctctgcttttcttccaggatgccaattgcatgcatcccaaaaatgttttacagctttatgtcttatgctcaggtctttgggttaatttttgaatataatgtaatggaaggtccagcttcatgattttgcatatgaatttccagttttcttagaatcattagttaatacgactgtcttttttccattgagtggttttggcatctgtgttaaaaattatttgaacatatatgagggcttatttctggactctattctattctatgtatctatgtgcccgtttttagacctatagcacatagtttactgtagtaggaagttttgaaatcaagaaatacgtgttctctggtattgttctttgttaagattgttttggcaattcgggagggcccttgagattccacgcaaatttttggatagattttttatttctgtaaaacacctcattgaaattttgataaggtttgagggaatctgtgagttcccttgagtagtgttgctgtcttaataatattaaatcttcacatctatgaagatggaattttttccatttatttgtcttgtttaattttttaagaaatgttttgtagattacattttataagcgtttcacctcttacttaattcctaagtattttattctctttgatacttttgatactattataaataaaaattttaagttttcttttcagattgttcattgttattacatagaaatgcaatttattttgcatgttgaatctgtaatcagatagttttctaatttattaattataacaattacttttggataaagctttagaattttccacatatgagatcatatcatctatgaacaatgataacattattttttccttttcaattctttcttatatttcttttttcttgcttaattacagctgctaggacttgaagtactgtgtcaaataatatggtgaaaagcaggcatctttgtcttgttcctgatcacataggaacatattatccttttcataggaaaaggtttcagtcttctaccattgagtatgatattccctggcggtttttatgtatggcttatgttccgttaaggtagtttccttctatttctagtatgtggagtgtgtttatcataaaagagtgtagaattttgtcaattgctttttctgcatcagttgagatgattatctgctttttgctttcattttgttaatgtggtgaactacttcgattgattttcatgtgttgaaccaatcttccattccaggaataaaacccacttgataattgtatataatctttttaatgtgctgttgcactgttgaatgtgctgttgaattcactttcttagtattttgttgaggatattttcattaggttcataaataatattggtccatagttttttttttttgtttttttttttcttctggtgtctttgtgtggctttggtatcagagtgataatggcctcgtaaaatgagttaggaaatgctccttctttattttttggaaaagttgaagaaggattggtgtagtacttctttaaatgtttatacattgagatttgacataaaatacatttttagaaaacataataaatatggaacactgtgttatatgttggcaaagcaagaatgtgtcaaatcttagtgttaacttccctcattagtcaggaaaatatactaacttgatgatttccattattgttgcactgctgttcttttacttatgttaaaatcattgacaaagtagaaaatgaggtttctttaacaaactacaagatgttgagattatacaaagaaagaggttaaatcagcttctagtaaaagaagaattaagaagcctgaccagttatagattttcaaagtccagtcctcagtgataagatgcaaagcaccaagagcacagaaagagaaaatggcattatgtttattcagagctagaatcctcaaagcatttgaaaagatagaagtggcatacagtttacctcaaaagatagctaattttttctgataacacttgttagggtcatatggacattctgctagactgagggaagttaaaatgaataagacacatgtctcttcttaaggattacactgcatttagtaaacacatgcagcaagaggaatagcagatggaaatgtagacccaaagagaaagtcaccagacattctttctgagtcctcagaaaagctttcatggcagatatggttttgattatgtggtacatgggcatagcctttgtgtcagactgaattagctggtgccaatttcagggtgaattaaaggatatttaatctctgtgtacctcagctaaacatgaaaataaaatagattcttgctaggtgaaaaagtgagaggatgagagagaaagagagagagagagacagcaagagcaagggagggtgggaggaacaaaagagggagagaaaaataaaacagggatgaactgagctttggtgggtgatatgatttggccgtgtgcccacccatatctcatcttgaattatagttcctataatgcccacatgttgtgggagggacctgattgtggaggtaatcgaataatgggggtagttaccctcatgctgttctcattatagcgagtgagttctcacaagatctgatgactttataaggggcttttccccatttgcttggcatttctccttgctgccgccacgtaaagaaggatgtgtttgcttccccttttgccataattgtgtttcctgagggcctccctagccgtgctgaactgtgagtcaattaaatctgtcttctttataaattacccagacttgggtatgtcttaattagcagtgtgaagatggactaatatagtaaattggttcaggagtggggtgtggctataaggatacctgaaaatgtggaagtgacttgggagctgggtaccagttagagcttggaacagtttaaaggactcagaagaaaacaggagaatgtaggaaagtttggaacttcctagagacttagagggctcagaagacagaaagttgtggggaagttaggaacttccttgacacttgttgaatggctttgaccaaaatgctgatagtgatatggacaatgaagtccaggctgagatggtctcagatggagatgaggaacttgttgggaactggagtaaaggtcactcttgctattcaatgagactggtggcattttgcccctccccagagatctgtggaactttgaacttgagagagatgatttagggtatctgatggaagaaatttctaggcagcaaagaggaatcagagcataaatgtttggaaattttccagtctgacaatgcaatggaaaagagaaccccgttttctagggtgacattcaagtaggctgcagacatcagcataagtagtgaagagctgaaagttaattaccaagacaatggggaaaatgtcttcagggcgtgtcagagaccttcatggcagcccctcccatcacagccacagaggaaggaaaaatggttttctgggcctggtccaggcccccctgctatgtgcatccctggggcatggtgccctgcatcgcagctgctctggctatggctaaaaaggccaatgcataaagtataataataaaaaaaagggggccaatgcgcagttcaggccgttgcttcagatgatgcaagtcccaagctttggcagcttccatgtggtgtttgccctttgagtgcgcagaaaacaaaaattgaggtttgggaacttctgcctagatttcagaagatgtatggacatgtctgggtgtccaggcagaagtttgctgcagcagtggagccctcatggagaatctctgctagggcagtgaagaagagaaatgtggggtaggcactgcccagtggagctgtgagaaggccaccattctccacaccccataatggtagaactactgacggcttgcaccgtgtgctgggaaaaggaacagacactcaatgtcagcctgtgatagcagccaggaggggagctataccctgcaaagccacaggggtggacctgcccaaggccatgggagcccacctcttgcatcagcatgacttggatgtgagacattgagtcaaaggagatcattttcgaaccttaaagtttaacaactgccctattggattttggacttgcatggggcctttagcccctttgttttgacaaatttgtcccatttagaacaggtatatttactcaattcctgtacccctattgtatctaggaagtaactgacttgcttttgatttcacagggttatagatggaagagacttgccttgtctcagatgaagctttggacttggacttttgagttaatgctggaatgagttaaggctttgggggactgttggaagggcatgatggtgttttgaaatgggaagacatgattttgggaggggccaggggcagaatgatatggttgggttgtgtccccacccaaatctcatcttgaactatagttcccattagcccaatgtgtcatgggaggaacccagtgggaggtaactgaatcatggggatggttaccctcatgctgttctcattatagtgagttctcaggagatctgatggttttataaggggattttccctcttttgcttggcacttctccttgctgccacaatatgatgaaggacgtctttgcttccccttccatcatgactgtgtttcttgaggcctccccaggcatgcttaactgtgagtcaatgaaaccacttttcattataaattacccagtcttgggtatgtctttatcaatagagtgagaatggactaatagagtgggcctggggagagtgaacatgagcaaagacactgtgctgtggcaggacagggcctacatcctagagttcatacatacaaggacctgatacagaagtgactcctgagagacacatgggccaggatgtggaaggatttgaattatatgtgattttgttcttttgtttctgaagtaatggacagtgtgtaattacttaagtaaaaaatggccatttcaaatttacatttttaaaatgctcctgtagaaacaataggtgcatatataatagaaggtcaaacctaaaatattattcttaatcatccatcttatcaagagcacataaaattataagaatgtgcacttgcatttatgatgttcttttgtgttaaatgataaatgggatgactaaattccaaaatctgctctgcaacaaaggaggtagatcacttgcagaagtcaccagtgataaggagtgacaagatgctaggaaatcctactgagaaggttatatttaagaatcaataaattctatggtcatgtttcataagactacatctctcttttttgaacagaaatcaatttaaatttcatcatatttactctatattttctactgatacttcagatgcctctctctctccatgtttcatttcagcccagaaacaattattattgtaatataagaacttccttttaaattataagtattcctttcaaatcttgtatgcatggtatgaattctacattttgaagccatcagaattactattgtcaatctaaaaaaaattagagattagtatctccaaatatgttgcatttactcaggaatgaaatatgaggattaatatttgggatgccacagtgtatcaagtgagggaaggggaaatggaagcttttattggcacaatgggaagggattacataagttgcttagaaacaaagttctttggtttcacagactcaagctcagttcgttgttggagatgtccttactcggcaagtgttcttggcagagcatcctattgaaaatattgcagtcctaaagaatgtctagtgatagaccttgtcatacaaacataagtatatgtgcaaaatttgcaagccatgcaaaggataagatgcttgaaggaggttaagaaatttcttgtggagttttagagagtccttggaaacagttcttttcttagacatgtaatcatgagttccctctccttcatgtcttcccagccctattttgtctggatctgacaaaaacaatcatccagtatctgcaggtttcacactatagacattaagactcaagaacttagagggtttttggttgtttgattttgtttgtttgattgcttgtttgttttgctttttaagtgattagctttcaaggcaaagttaaacttcaaattcatgagtttaactttgttgtaactgagctattctctgtcttcattcattcaacaaatattaattgagcacctactaagacctaggccttctctaggtgcaagtcggtgcagtatagactgagacagacagaagtctgtgacctagaacttacattctagtgaggggagcaaataaattacaaaagaaaagtattaaaataagcagttattagatactgataagtatctctatactgataagtatcctctatactgatagtatagaggaaataaagatataattaagcacaatgtcacatttttagtgtgtatgggtgtgtgggtgtgtgtgtgtgtacatgtactatgcatctgaaagtatcatcctgtctgatttatttgaggtactgcaatttttcttttagcagaaaatattccaatacaattctagaaaaaaacaggaattcaagcataacatattttttttattgaataagtctggaggttcccatttaagcaaatacgatgacctaggcttggttttgaatagcatattttaatgaatgtccttttaagaaaatactacacaaaagtgtcatttttaactttctgttctatgttttgggtcattcatagaactaaaatcacatattttgggaattaaaagatagaaaaatacagaattcccaagctcaaagagcctatagttttctagaaatcaaagataattataagaatgacccaatgagtttccttatcacaactgcagcataaaatgaaataaactgatatttaaaaaaattgaattttatattttatgttcttaaaaaaataagaacttaacactacttagattttgtttcctttgtgtaggtcacaccatcctgaatctaggtatgctctttgagaatacacatgagagcaggcatggtggctcatgcctgtaatcttaagtactttgggaagccgaggcgagtggatcacctgaggccaggagttcgagaccaacctggccaacatggtgaaaccctgtctctactaagaatacaaaaattatcagggcatggtggcggcgcctataatcctagtgacttgggaggctgaggtgggagaattgcttaaacctgggaggcggaggctggagtgaactgagatcacactactgcctccagcctgggcgacagagtgagactcaaaaaaaaaaaaaaaaaaaagaaagaaaatacatgagccattaaaccaatttatatgatagaaaataactagcatcaaaaattcttggagctgcaaagccctctgtcatagacatatcactcagcctcagttcctttttgcgatagtcatcctgaggaaggatattcacaatacattttactacccaatggaaggaaataggtcaaatcaaatgtttcttatgcagtaatacgaattttcttttttgctggaagtctctataaagtttcaaagtgtctataaatcccctggaactgtaagtaaatagcaaaatgctgagcttttttttttttttctgctagaggtcaggtaagtttcttcagatttgttttttcttttctttttttttttaattatgctttaagttctagggtacatgtgcacaacatgcaggtctgttacatatgtatacatgggccatgttggtgtgctggacccattaattcctcatttacattaggtatatctcctaatgctatccctccccgctccctccaccccacgacaggccccagagtgtgatgttccccttcctgcgtccaggtgttctcattgttcaattcccacctatgagtgagaacatgcggtgtttggttttctgtccttgcaatagtttgctcagaatgatggtttccagcttcatccatgtccctacaaaggacatgaactcatccttctttatggctacatagtattccatggtgtatatatgccatattttcttaatccagtctatcattgatggacattagggttggttccaagtctttgctcttgtaaatagggccgcaataaatgtatgtgtgcatgtgtctttatagcagcatgatcctttgggtatatacccagtaatgggatggctgggtcaaatggtatttctagttctagatccttgaggaatcaccacactgtcttccacaatggttgaactagtttaccgtcccaccaacagcgtaaaagtgttcctatgtctccacatcctctccagcacctactgtttcctgactttttgatgattgccattctaactggtgtgagatggtatctcattgtggttttgatttacatttctctgattcttttttttttttttttttgacacggtgtttcgcactgtctcctgggctggagtgcagtggtgcgttctcgatgacactgagagagtccacactagctcctgaaagagacaacaatgctgctgtcacaagcatatcccagcatagcacctgaacagtggtagccctctaggttttagtttagacagtatctggaaagaaacttgattgctaagatttactttagtggtggaaggatgatgcattagtgtgcctgtaacagaagaataccagtcttcttactgtgatctggcaccgaccacaactgtgcaagtcaaacatgatgaagtccccgcagatggagctgcccttctgctgtgttgtgctgaacagccactgacctgggtgggcactgggtccatgcgttgtttgtttctctctgcctggaaagcccaaagtgcttggaaaggaaagtgctctcagtcaaggaagcctgaggccagtatttgggaagaaggggcaggcattggctctgggtcattcatacagaattttcatagatagaacttacttgtctgctacctgaaacaagaacacaagaaaacaagaccgtatgctttggcagctgtctgaaaaatgagtttccaagaaatcaagcagagatgaatataatttatgaatttatcttctgtttttcatttttaaaaggcttaacgtggccttcatttatctgaatccattttactttgtggtcatttatagctcttgctggttttgtagagtgatgtgttgggcaaccctggtctaagccattctgctccttttacagccagaggattaatagcttaaataactgtgatccaaaagcagccggttttgtgatacggacagaaattatgtcctttgatctctaaaagccttcaagttcaaacacagcctttattttagtcaaaattatactccctttttagctacgtataacacaaattgttctgataacataaaattagcattggtttctaagaagtgtaacatggaaaatgcctttttgaaaaacactgatttgtcttatttgaagatcagtcttaaaatgatgcagagaatttagaattttcattatttggaaatagtattactaccaagagtagaaaatttttaaaactttgctctctgaatgcattttattactaaaaatatttattttttaatatttgactgtatataatatagcagacactatattaatcatatgaataataccatgttttaaaaataaatttaaattgtaattaatgtatctttttgggttttctaattaaattttaatttgctttattgatattaatgttataattaaaaagtaagtatttttcaaagcaaattattgccagtatctttatattgagagttcacttataatttaggtttcctagagaatggttgtaaacagaaatgaaggtatactatgtccaattgataaacactaggatattccaccagtgccacttatgagaaagcatcaatggattcattttccctctatctgttcattccccacccagcctgattcacacatgattgtcacccatttggcacctgagtgtgcaaatcctagtctagagttgacaagaaaatagaagggagtatgaaaactacagtgtaagaaagacatctttgctcagcattctttaaaatgcacttcttatcttcaaagggaattcaagcttactttatattaattataatcactacttattaagctctatattcctgtcaatttttccaacaaatatatgcagttaatgtcattattgatgttttacaaatgaagggatctagatatttgataattaatgatctgtctgaggatatttagtaataattacaactggaattcaacaccagatctgtctgactgcacagcctgacaaagtcttatgcaactacattttagctcctgtgttgaacttatcctcattcccctctgcagcctccttggattgtttggattctgtaaagggggcatccttatgccattgtctctgcatgggatctttcatttccatgttctagcacttatcaccatgagtcacacttggtagaaggtcattaaaagattttagaagtaaataatgacattctctcctgtcttcatttcattaatacacacacacacacacacacacacacattactgaggactgaggatccttataagcctttaaaatgttgtgaaagatttaaaagtttagctagagagaggaaaaataaaacaggtgtttttgaaaaatgtgtattctgggggttgttttgatgacattttagattttcgaagttttaaacaatggagagcttcgttaaaaaaaaagtaaagattaaactaattttattttctaatgataaaagttatatttcaaaataataataattataaaatacaaagcagcaaaggaagcattcatgtaataacccctaaataaaaaacaaaactgtttgaattttgtatttataactgtcagtatcattgtcatacacatatgtctacttatgtatgcacattaaacataaaatcaatttcggttcacgcttacagacattaatctaaatttgtaagactggatgtatgcccaaattatcaatctttgtgcatgtgtatatatatgcatatataaatttatatatgtttaatatacatacacatatatgcatacatacatatatgtatatacatatatgtaggtatatatgtatgtatgcatatatatgtgtatatgtaatttttaaaatactgcataaaactgccttgaaattagaacattttgtaagcatcgtatcttatcaatcttatcaatcttatcaatcggtaaatatcaccataagcatttgtaatgaatgcacagtgttataaagttttggatatattgattattgtttagcataataaatacttcagtgtatgctacatatgttttaattgctgtgatttttccacttactttatactctctgtgtgtgtatatttaaaaatgttagactgttaaaaattagtggcttggccgggcgcagtggctcacgcctgaaatcccaccattttgggtggccgaggcgggcggatcacctgaagtcaggagttcgagaccagactggctaacatggcgaaaccctgtctctactaaaaatacaaaaattagctgggtgtggtggtgcacgcctgtagtcctggctacgcgcgagggtgaggcaggagaatcgcttgaacccgggaggcggagattgccagcctgggggacgagagtgagacttcgtctcaaaaaaaaaaagaaaagaaaaagaaaaaaaaatttagcggctcatggctcatgcctgtaatcccagtattttgggaggccgaggcgggcggatcacgaggtagggagatcgagaccattctggccaacatggtgaaaccctatctctactaaaaattaaaaaataaaaaaaaattagccaggtgtggtggtgggcacctatagtcccagctactcaacaggctgaggcaggagaatcgcttgaacccaggaaacggaggctgcagtgagctgagattgcactgctgcactacagcctgggtgacagaatgagactccgactcaaaaaaaaaaaaaattgaagatatgaaatgttctaattagacctactttaagttattgttttattttaaaatgttagtataagtactaacaatataacattttatattgttatattccacttggtacaggaaagatggaaattatctttaaaatggatgtgggtgtgtgtacagattttaaatcttaacaaggaattattttgtatctacaacaccaggaaaaatttctgaatacaatggaagcacatttcttgctgccacagtgagggtaacaggcggacggagttttctgtgctggacatcccactccccattttggttacccgccttccattcctgtgcagtcagtagtttggttagttaagtgtatatttccactgaaacatgaataaacatgaatagattatattaccctaatacacaattaaaaagctacaaatttcagtagaaatcagcttacacaatttattttcttgccaaataaatctattaatactacacacagcagtattcaagcattgactcattctttttgaatatttttacataatcctgggataacataaattgttcaagtataaagtattatgaagttacagagaagaagtatttgaaaagttatgatgatatcatttgactaagaggcgcacaatttattagtatttccactttaaagaatattacttcttcaataattgacttaatgtcttgttctactttattattttattattgtattcgccacattacaaagacaatctacacataatttctaaaggccattttcatattttgcaaacatagtttttacatattattattattatttacattttattctagttgttggcatatcacactgtcttgtcattctctctagtcattaatatactacctcttttctgtattctaatttctgatacagatattctaatgtaaaatataatatattctatattctaaattgctcccactttcttgccttatttttgagccgtggtaggaaatacaccatacattttattattttaatagtagtaatgttatgtaataaaccattcaaaggatagagatggtaacattcacatatcagttaataagttgatcttttccaaggtaagtcaggtatgtactaagggaaactaacaaaaacaaaaaattataatataacaattcctcacaggtaaataattctgatggtctagtaaacactctagtgggacagaaagtagatctctgtgggagaaaacatctcaattctgcaaacgctcccaagggtgggttagcaggacaagacgtctgtgcttggctcagaagtttggctcaatcactactttctatcccgtgttttgctcaaccactactttctatcccgtgttttgctcaaccactactttctatcatgaagtgtttactttcatagctgatcttcaagtttcctagaaagatggttcagactatttttcagattaaaaaaaaaaaaaacattgcagtttacgaagctacatagtacattattgaagacaagggcccacataaaatattagttgaattttagaattctttataacaattcatatgaattagcaaaaagtagatttccacaaagtactcagtatagattttttaattgattaataaaaatgtttagagatcagttttttccatctgtatttccaggctatgctgattttagctgaaggcatatatgagtaggttcagagattccttagcagagccagaaggtattttgaaatgattataataatgtaagaagtacatggtttctgtacctaaccttgctcagatcacacatatgttctcaaattttcttttctttttacattttaagtgagaaatatcttgctagtaaatctgttcttgtagatgtgacttttgttgattttccaactttgtgtactttttctgtttaaatgaactgttatttcacactagtcagtaggataaaagggaaccaaaaaaggacaaaataaaataagtcagtggcatgatttataaatgaaaatagtctgcattacttctgctgtaagtgtataccatagagagttagcatgcttaagtttctctacaaagctattggaaggtaattattttattcagcaaaagcactattgaagaaagactttgtgtaatgtcctttatccaagcctaatgttcatttttattaggtttttaaagtttgtttccatggcatatgacagaggaaatgctttctctggagacctactttaaattcttataaaatgtcattgattaaattttcttaaagtaaatgttagactctatctggagtcttgactgaaaatgttcaacacacatactttatcctttagcgtttggatattgcgcttccctgttctcttgagtgctaaaacaaattggatataatataatttcaaagtgcaaaaaataaaccacagaaagttacactctgcattcttgatagataatcatttagtattgtttgaacacaggcttttggtttctctgagttaaaaaaattttaaagggaaatcttttccaaactgtttacataagaagtgtgggataattttgatagccaattttaaaaagaaaaaatctgtttatatatgttgttttatatgtgatgatttcagcatatcaaaataggatattagtatatattagctcactaaaaataatctgcataaaattctggggaccttgtgttaccatctattgttcttctcacttttattatttatttatcattgcagattaaaaaaatcaacagaaactttcctgtaaaccagcaggtaagatcaaagcatacttggaaagctaaataatatatttctttaattttattgattatagaagataacgttacctgatttctagacagaaataattggtactgtcatttactatcttcagtgagaaacatacatttcagatatctccttcatattatgtaatatattggttcctctacttatattaaaaagtactttaaaaatgtttatctaagtcaaaaattattgtttctacaaaataatttatttgaatacattgttgaagaacttagagttttatttacatatgttagttttagtatatcttaacttctgggagacctacttttaatttatctcaaaattcaaatgaatttttcacaatttgctgacagtatttcaaacgagtctaagttaatgcatagaacaaaaataattttgattattcagttctataaacctcttactcttgatatcaactttgatttgaaaccactgacaaatctaaatatctatgatagctatttataaatgatacataaattacaaattaattttaatgataaaaatgtttaaatgctcttcaacttataaaatgtaagatatttttcttatctaaacctcagttcccctatgtgcaacatttgtgtaagggcgactatcctgtaagtttattttgaggattaaataatagcacatgtaaagttctcaatctatgctatcattatcatcaaagtttctaaatgtttacacttgttctttggaatacagaatttatgttttgtagaaattgtatcattaatgatgctgctagcccaaatcagcctccaaagccatgtgtaactagaacactgtagagaacagctttggagagttaattgtgtctacaatgctctgattagttcttttcagctccagaggtcccctccctcctaccttaagtccctctgccctgagccaagttgatatcttggataaatgcagaggttggagagatgtacgtgtcttgccacatgctgcagcagcctgtagttgtttttaaggcccttacttacagtgtggaaaccagagctgtcaccagcagcttctgcttacttgctctgtaacaacacctgggatgttccctttgttgctcccatgctgtcccaggtgattctggtatgggtgtcatcttgagaactgcagataagtgtagttcaagataggtgtcatcctgagagctacagtttaatgcttttacagggttccagtagagggaaaatgtcattaataagaaattactcaaatagaagaaagtatcagctatgagggaagattataatgtccatcagtagacaaggctgttttatagtcagatctttaaaaatggaaatctactgttttgtaagttcctctccaaaataaaaaatggtgaattattttttaatttaagaatgactctagagctgtgtcgtcaccctctcatgccctttctaaactcaacatgggagatattaatattggtgtaatatattactacagaggtcattccgctgatagccccaaagctattctgtaatcaatgacaactacagctaacacttctcatgtagtcagcttgctgactgggagcacttcttgccacctttgcttatacccaggtttagaatagtattaagtaaaataagtgagaatttgaataaatcacacatagaacaagtaataaaaactttaatattctaacactataatattctgacacatactcatatgtaagcatagatgttcattagtattcatcatttttatttgctagcctgttaatattattcattatataataatttcaaatccaaaattatataattcaaaactatttcagattttatttcaattatcttggcagctcacagttttgaaaattgtaacaaattcatcctgatatttaagaaacctgaaaagaagggttaatagacttttttccttactacttcccattgtgtacatgaagaattttaagaaataggattaatttatagttaaacatttatattattgcataattaggaaaactcactgcacagtatgataacaacgcattaattgactagagtacatttcctatttagtaaaatctgagccagttttaaaaacacatataatcccatttctgatgatatctacattaaataactccctcatattcctgatgttctaggtatcaaaacagaaattaaaagtcacccaagctacaatgaatccgaagttctctgctccctgagatttgattttcaatttgtgctacccagatggtaccactaccctaaccagagaaattaaaatgaaagcaaaacatagggagaaagccactgcggtccagctgagacaaccgctaagattagctccacatgaactctgccacactccagaatgcataaggctttcagacactgtgtctgaagaagagagttgggcccaaaattataaaccatatgaggaaataaaccattataaagaaatgcataatctagacactaaagaactatccaaaatatttttaatcatgattttttaaataaagaaatcaaaatcataagacaagaagaggacatggtgctaaaatttgtagttgtaaaaaaaaccaaacaggagttcaaaaatgaaaaaaaaacctacatttaaaattagttaaccaactaaataatcttagttattgcctccacttgaaatcatattagtgtatctcctacttcacttttcatgaggagtaagttttccattttttctatgcatctggaacacattcatgtgcttttgttctattaagattctgatttggttcttttttttttttttttgagagacagagtctcattctgtcacccaggctggagtgcagtggcacaatcttggctcactgcaacctccgcctccctggttcgagcgattctcctgcctcagcctcccaagcagctgggattacaggcatgcaccaccacgcctggataatttttgtatttttagtagaaacagggattcaccgtgttggccagcctggtctcaaactcccgaccttaagtgatctgcctgccttggcctcccgaagtgctgggattacaggcatgagccacaacacccaacctgatttggttcatttttacagtgaacacactgaaattaaacttgccctggtaactttctgttgaaaagatgaaaggcgggacagttgtcttgctgatgaacaaaacagggataactgaatggaagtcaagtgatgttgtgataattctctcaatgtattagaggtaaaggcatataggcccagacaaccaggcctacatcacactactatatgtacctagaccattaggttataatttattatgtgtgtcatttttactcatttttaactgaaatttcttcatcctgaaatatatctcattcctcccacaaaaatatcatttttcaataagtttcttctataattacctgggagtaacattataaagtattaatttgtcattaaaatattaatatagtgagctttatattaggcagtatacaaaataatataatcaaattatttatattagtttaaattaataaggttatacttatttaaaataacatattagctctggtagctattcctatagaaatattgacatttgacgaaccataataatttggacacattattatagatgtgtacataccatacatagaatgttggcagctggaattaaaagtgactagagtcactagtcatgctggggagaattagggaattacaggacactttaaaaatctatttctgtagtggtatcagaaaagaaagaaaagtaggataaattttgtcagttttgcttctctataaaagcaacagaaaaatggcaaaaatagaatcaacttttaacaaatatggaaattcacaaaggctcactgaacccagggagcatttattcaagaaaaacagctgagtcttggtaagaacagtaagctttgtggcattataactggacctggtcccaacccctctcttttctctggcaatatgttggcttacataataatgatgcataccctaaaatttataatctaatcagttgtatatttaattcatgaaattttagctttattgaagatgtgtgtgtgtgtgtgtgtgtgtgtgtgtgtgtgtgtatttagacaaaatattctattaatgaaactgacaattggtctttatttttggggaatgtcaaaaatctatttttttcaatttgagaaagaaactctcctagttctttatacattcaatttattaatgttaaaaacacattatagagtcacacaatctgaagataatgagcctgtttttgttctggtctatttcataacacttggtgataaaatatgctggcactttatgatctaaaggagaatccacctcaaaaaaagtaatgtgtctgtataaattaactcttggaaaatcaaccagctcataaatcatttgataacaaacatgatggatatttcccaggaaaaagaggtgtaaatgttattttaagttaaactaaaggagcccacacctaattatgtaaaaatttatgtattacagttaaaataaaatatacacttcagaagacttggaaaagtgttattcaaataatagaaagttgtatatgtgtgtgtgttgaatttatacacataagtacctgggtttcattattgaaagaactgtcttaattctcattggctttcttttctaaatatatagattttcaaaatcctgagggagcggggaacaaatgtagcaaaattgtcttgttttacattttccagattgttatataaatgggatcatactgtatgtatgaatttttgtggcttctttcatacagcataattctttttaatattgctcatttagcagcgtgcatcaatccatcattctttctaatgctgggtagtattttatcggtggctctactaccatttgtgtattgtgtattatcccattaatgcacatttgcttcattttaagttttagtgtattacagataaagctgatataaatatttatgaaaagtctttgtcttgacatatgtttttattatatttgggtaaaatcctagtagtgtaataactcaatattatggttgtgtattttgaacattttaagaaactgcagaactgttttccgaagggttttacatttcacattgacactagcagggtaaagataatctcgtagatatccctatggtcaggcttttaatttttggacattctaatagatgtgtcatgatctgttaaattttaatttacatttctctatagaataatgatgttgagcatcttttcatgtgcttatttgacatctgtatatattcttttgtgaattatctcttcaaatgttgcccaaggacagaattttttaaatttgatgaattccaattcactgtattttaatgagtcatgcttttgaaattgtatttagtaaatatctgcctaacacaggaaataaattttcaactattttttatcctaggttttttacagtattctttttatttttaatctatgatttatttttatttaacacttgtttcaaaagtgaggtatagattaaagctatttttaaggggaggtacaatagttccagcatatgtgttgaaagtattattctttcttcactgtattattattcctctaccaaaatacaaattgatcacatacatgtgggcctatttctggactccaaatgctgttgccttggtctatttgtatctcatgacacaaatacaaaaccgtcttgaatactgtagtactacgatgtctaacatgagtagtgtaagtcccctagctttgtaattatttgctgttgttgataaaacttctaatattttttattaatgtttttatataattgaaacataataattgtacacatgtttgggggacagtgtaatatttcaaatcatatatacactgtataatgagtcaatcagagtaattgccaaatccatcactttaaacatttatcatttattttggtagtaacattcaaaatctcctctagctatgctgaagtttacactacatggttatttgctgtagttaccctactgtgtaatagaacatcagaacttactcttcctgtgtaactgtaactttgtacccacaggcgaacctctcccaatctcccctcactcttcccctccctagcctctggtaaccactattgtactctctacttgtatgagatcaacttttttttcgataacactgatgattgagatcatgtgatgtttgtctttctatgcatgggtcattttacttaacataatgtcttccaagttcattcatgttgctgtgaatgacaagatttcattcccttgtatagctgcagagaatatatacatatatatatacacacacatatatatacatatatacacgtatatatacacatatatatacatatatacacgtatatatacacatatacatgtatatatacacatatatacatatatacatatatacatatatacatatatacatatatatatgccacatgttctttattcattcatctgtatatgaacatttaagttgataccatatctcagctattttgaatagtgttgcttattgggagtgcagctatctctttgacatactgatttcatggtcttttgagtgtatactcagtaatggattgctggatcatgtggtaattcaattttgattttttgaggaaccaccatactgttttccataatgggtgtaccaatttacattcccaacaacagtacaaaagagttgccctttcttcacatcctttccaacatttgttattttttttgtcttgttttttgataatagtcatttgaactggtgtgaggtgatacctcattttggttttgatttgtatttcactaatgattagtgattttgagcatttttaaatgtaaatgttggccatttgtatgtattcttttgagaaatgtctattcagatcttttgcccattttaaaatccaattacatggtttcttgctattgagttttttgagcttcttatatattacggttattaatatcttgtctgtgagttgtctcttcactttgttggttatttcctttgatgagcagaagttttttgtttgttcgtttgtttgtttttgttttttgtttttttttagtttgatgcaatcccatttgtctatttttgctattgtcacctgtgcttttgaagtcttattttaaaaactccttgcccagcccaatttcatgaagcaatttccctatgctttcttcaagtgcttccatagtttcaggtcttacttaaagttcaagtcttacttaaatttaagtctttaagacattttgatttgatttttgtgtgtggtgagagataggggtctagtttcatttttctgagtatagacatgcagttttcccaacattgttattgaaaaaactgttctttccctaatatgtgttcttgacacttttgttggctataagtgtattgatttattcttaggttttcttttctgttccattggtttatgtatctgtttttatgccagaaccatacattttatttactatatctttgtagtatacttttaaagtcatgtcgtgtgatgccttaactttgttctttgtgttcaagatggctttgactactgggagtcttttacatttccatatgaatttgaacattgctttaaaaaatctgtgaaaatggcattgtcatttgataaggatttcattaaatatgtagatggctttggttaatattgacattttaataatattaattatcccaatccatgaacacagactacctttctatttgtttggattccctccaatttctttcatcaatgctttatagtttttattatagagatctttcatttttctggctaagtttattcttaagtatttctctgtggccattgtaaatgaaattgcttcctaatttttttatgataggttgctattggtgtagggaaatactactaattctatgttgattgcatattctgcaaatttactaaagtcattcattagttataacaactttttggagtctttaaggttttctacatctatggtaggtgtgtatatttattgggtgcaagaggtactttaatataggcatgcaatgcataataatcacatcatggaaaatggagtgtttatcctccatccagttttcccagcaccattgattgaagagactgtcatttccgccaatgtatattcttggtacacttgttggaaatgaattcactgtaggtgtataaacttgtttctgggttctctattctgttccaatgatctgtgtgtctgtttttaacagtaccatgccatttttcttactatatctctatagtataattagaaatgaagtaatgtgattcctctagttttcttctttttgctcaggatagctttgtttattctggatattttgtggttccaaataaattttaggattgtttttctatttatgtaaagaatgtcattggcattttgttaggaattgcattgagtctgtagattgctttgggtagtatggacattttaataatattgattcttcaaatccatgaatataaaatgtctttctttttttgcatcctttttaatttctttcaccaatgttttatagttttctttgaggtgatctttcatttctttgttatttgtgactattacaaatggggttacagttttgatttcattttcagattgttcactgttggcatttagaaatcccactgatttttgtatgttgattttaaatcctacagccttaatgaatttgtttatcagttctaatagttttttggtgtctttggatttttccaaacaaggataatttgacttcttcttttccaatttcgatgctgtttatttctttctcttctttgattgctctagctaggacttccagtactattttgagtaacagttgggaaagtgggcttgtcatgatccagacaaagatgctttcaagaaaggctttcagtttttctctattcattataatactaccttgggtctgtaatacatggattttatcatgttgagatatgttccttgtattcccggtattttttaatcatgaagggatattgaattttatcaaatgtttttacagcatcaattgaaatgatcatatggttgttgttcctcattctgttgacatgatgtgtcacattgattgatttgtgtatgttaaaccattgttgaatctctgtgataaatcccacttggtcatgatgaatgatctttttagtgtgttgaatttgcgttgacagtattttgttgaggatttttgcatcagttttcatcagaaatattggcctgtaattttttttttcagatatgcctttgtctgattttggtatgagggaaaactgtccttatagaataagtttggaagtattcacttctccattttttggaagagtttaagtaggattggtattagttctttaaatgtttgatagaatttagcagtgaagccattgggtcctcagattttctttactgggagactcattagagctccaatctccttctttgtgattggtatggtttggtattggattcttcctgattcaatcttggtaagttgtatatgtctacgaatttacctatttcctttggattttccaatttattgccatatatttttgctcataatagcaaatatataaatttctattgaatttatgtggtatcagttgtaattagaaattcatctctaattttatttatttggttcttctttctttttttcttagttttggtaaaggtttgtcaatattatttatctgtttaaaaaacaacttttcactttgttatcttttgtattgttttatttgtttatttgtatataatttatttctgctctgatctttattctatttttttttccttctactaatattgggtttggtttgctgttgcttgtctagttctttaaggcatattaggctagctgggcacggtggctcactcctgtaatcctaggactttgggaggccaaggtgggcagattatgaggtcaagagattgagaccatcctggccaacatggtgaaaccccatctctactgaaaatacaagaaacattagttgggcatggtggcatgcacctgtagtcccagctgcttgggagaatcgcttgaacctgggaggtggaggtttcagtgagccgagatcgcgtcacttcactccagcctggtgacagagccagcgagacaaaaaaaaaaaaaaaaaaaaaaaaaaaaaaaagacatgttaggctattaagctatttctttgaaggctttttgtttgtttggctttgttttttatgtaggcacttatagctataaattttcctcttagctctgcttttgctgcatcccataggttttattatgttgtgtttccattaccatttgtttcaagaggtttttcaatttccctcttaatttcttcattgaccaactggtcattcaggagcatgtgcttaatttccatgtgtttgtatggcttctaaaattcctcttgttatttatttctaatttcattccattgcagtcagagaaaatgcttgagatgattttaattttttcagtattttcagacatgttttgttagctgacatatggtatctcctttagaataatctatgtgctgaggagaagaatgtttattctgaagctgttggatgaaatattctgtaaatatttattaggttcatttgttctaaagtgcaagattaaatatgattttctttgttgattttctttctggaagatttgtccagtgctgaaagttgggtgttgaagtgtgtagctattcttgtattgagatctgtctctcttttttactttaataatatttactttctatatctgggtgctttggtactgggtgcatatgtaattgctatatcctcttgatgaatttaactttttatcattatatagtaactttctttgtctcctcttgtagtttttgtcttgaaatatattttgtctggtataagtatagctacttctgctattttttgtttcaattagcatggaatatctttcattattcctttattttcagtctttgtgtatcttcagaggtgaagtgtgtttacattaagcaacagataattgagtcttctttttttaatccattctgccactctatgtcttttgattgagaggttagtctatttacattcaatgttattattgataagtaaggacttactcttattttgctatttgttttcttgttgttttgtggtcttctcattcttatttcctttcatctagtcttccttttagttaacatgattttatctggtggtatgatttaaattcttttttatattatttgtgtatccattgtatggttttcaatttgaggttgccatgaggattgatagagtatcttaaaactcgtaattttaaactaatgacaacttaaaaattgttgcataaaccaaaactaatataaactctacactttaacttcttcctccaactttttaacttgttgtttctctttatgtcttatagtactgtttgtcttgaaaagttgtagttattatttttgattggtttatcatttagtctttctacttaagatgaatagtttacacaccacaattacagtgttataatagtttgtgtttttctgtttgcttactattactagtgagttttgtactttcaggtgattttttcttgttcattaacatcattttctttcatgtcgacaaactgcttatagcatttcttgtaggacaggtctggtgttgatgaaatccctaagcttttgtttgtctgggaaggtctttatttcttcctcatgcttaatgcatattttcactggatatactattctaatgtaatagttattttccttcatcgctttaaacatgctgtgctagcctctactggcctgtcaggtttccactgaaaagtcagctgccagatgtattggagctccactgtaaggtatttttttttttttttttcagttctcttgctggttttagagttctttcattttctctggcctttggaagtttgattgttaaatgccttgagattgtcttctttagatgaagtccacttggtgctttataaccttcttgtacttgaatgttatctttctctatgttttggaagttctctattattatttctttgaataaactttccactcttatctctttctctaccttctctttcagaccaataacttttagatttgccttttcaaggctattttcttgatcttgtgaatgtgcttgattaatttgtttttccattgtctcttctgtgattttcaaataacctgtcatcaaggtcactaattctcttttctgctccacagttctgctattaagacactctgatgcattcttcagtaggtcagttgcatttttcaactctagaatttctgcttgattcttttaaaccatttcaatcactttgtgaaatttatttgatagaattctaaattccttctctgtgttgtcttaaatcgctttgagtttcttcaaaccagctactttgaattttctttgtgaaaggtcatacatctgtatttctccaggacttgtccttagtgtcttatttattttttttggagaagttatgttttcctggatagtcttgatgcttatggaggtttgtcagcatctgggcattgaaaatttggatatttattgtagtcctcacagtctaggcttgttagtacctttctttcttggggaggctttccagctattcgatgcaacttggaccccaagaccaataacagtgattcttgcagactcataggtgtgctgacttggtggccttggataagatcagaagaattatctggttttcagaaagacatttttgttctcttctcttacttttttcccaaaaagaagactccctctctgtgctgatcagcttagaactggaggatgggtgatgcaagacccctgtggccaccatcattaggactgcactgggtcaaacccgaagccagcagagcactgagtctagctcaaggccagctgtgatcactacctggctaccacctaggttcactcaaagccctagggctctacagtcagcaagtgaggaagccagcaagggtaatgtcttgtacttcagggcagtgagtacctccatgacccagaagggttcagacatgttttctaggggccagggactagagtcaaaaaccttagaaatctactgggtacagaggctcatgcctgtaatcctagcactttgggaggctgaggcaggcagatcactttagctcaggagtttgagatcatcctgggcacttgatgaaactcatctgtacttaaaaatacaaaaattagctgggcatgatggcacatgcctgtagtcccagctacagggggctgaggtgggaggatcacttgagcccagcaggtggaggttgcagtgagccaagatcacaccactgcacttcagcctagatgacagaggaagaccctctttcaaaaaagaaagaaaaaaaaaaagaaaaccttagaaatatacctggtgttctattctgcatggctaagatggacctcaaactacaaggcaatgccctttccacttttccctcccctttttacaggcaggggagttctgccaggctaccaccaatattcacttaaagtccaagggctcttcagtgtgcttgtggtgaatgctgccaggccttggagtcattcttcagggcagtgggctcccttctactacaggacaggttcagaaatgtccaagagtctaggcctggatttagccaccacaatagcctgcttggtgctctaccccattgtggctgagctggtttctagggtgtgagacaaagtccccttcattttttcctcgcttttctcaagcaaaaggattctttcaccctagtcacaacagctggaaatgtactaggtctcacctgaagccagcatgtcttagggtgtcaccaaaggccatggcatacgaacaaggtatccctgcaggttattcagggcccaaaggttctttagtcagcaggtgatgaattgtccccagactgggtccctcccttcaaggcagtgggtttccttctggcccaaggtgtatctagaaatgtctaggagctagagcctggaatgtggcctcacaactctgccctgtgccctgtcctattatgactgagctgatatgcaagatttaagacaaagtcctgtttactcttcctgctcctgtcttgaagcagaatgaaggagtcactttcatttctgtgagctgcacagcctgaggttaggggaggggtggtgcaagccctcccttagctgccttggctggtatctccctaggtcaggtgtttccctgttccactggctctaagcccagcctagcactaggaattccataggaatgtcagtccttgtggcttagactgcctttcaactttacttaggatgctggagcattttagactgcagtggtgaggcttgccaaaactcaagttctgatatctgggatgggtaattcctttctggctgctccgaatgctccttccatgggcaggaaccagctgagcaacagtctttggtctttattgtgacagtgcagcaaaacagttcaatggcaagcccgccagtcgctgtgctagtcttcccccaagtgcacagattctctcttcacaccatgaagccactgctagaggatgggggaggggtggtctcagtgattcaaaattttcttttctatcctcttcagtactttctcaacaatatgaagttaaagccaggtactgttattgttcacctgatttttggttctttcaatcgtgctatttgatgtgtggttgttggttaaaatttggtgcttctgttggggagaggggattatccacggaggcttttattcagccatcttgctctgacctaactgaaaaaaataaaataacacaaaaataaaataaaaacatctgtcatatttttgtccttgattctatttatgtgatatattatgtctgttgattggtatatgttgaaccatgtttgcatccctttggtgaatcccacttgatcatggtgagtgatctttttgatgtgtatttgaatttcctttgctagtattttgttgagagtttttgcattggtgttcatcatagctattagcctgtagttttcttttctttgttgttgttgtgtccttgtttttattcgaagtaattttgtctactctggaatcttgctctttctaaacagaaagttagaaacacgtgaacaacttgtagacttattcaagagtagttgggtatttttgaaattgcattgaatctttatatttaggaaagttgacatattatgaatattgagtcttgagatccatgaagataggttagctctctacctttcttagaactttaaaaatttctcttagaaaccattctagtttccagtgtatacatatcatgcatactttatcagatttattcctaagtacctcatatttttaatgttaatataaatgacaaatttttgatttttatattgatttagtttcctgcattatttctaaaatgacttctaagatgtaggaacaatagacaattatgttatctacataaatataaatattttgaattctttatttcattttggatacattttatttctttttaataattcatggcactgtgagattctccagtataatgcagaatgtaactgataaacacataccttgtatctgatcataggggaaatcattaaatatttcaacattaaatatgttaatagctagatgtttttcataaatgttctttagcatgttgatgaaatacctttctgttactagtttgttaaaaattttaatcagaataaatgttcaactgtgttaaatgccttttctgtgactattaataaatatactgtgccttatgccttttttttatttctatcaatatgctatgttctattaatgtattgttagatatgaaaccaagtttgaattttgcgaatatatcccagttaatcataatgtttttatcctttttatttattgttggactcaattttctaaaataagaaaatttaagaaatttttcaactgtgtttctgagagacattgatatgcagatttctctgcttttaacgtctctcaaaaaaatcaaattcgatatgttacattttatttacattgcccttcaagatcgtttctaacttattttttactttttattttacatgtgaatatttggaagtattatttaattttcatatatttgggaatgtatatgatctggtatcagagtaatggtagctttgtagattgaatgagaaagcatttacgcttcctaaattttctggagaagtttgtgtaggatgggttttatttattcattatctggcaaaaatctcccagttaagctatctagtcctggaatttgatttatatgtagggttttaactattttttttttgttcttttaaaagtacagagctattcaagttatcaaatttatttttgagtaagctttggtattttgtgtctttctaggaattcatgcatttcattttacttatttaagtcattggtatatatttatttgtaatattctcttataatactttaacgtttcttcttgcttttcaattttggtaatctgtgactttttattctttccctctctcttttttgtaatttatcagtcaacataaagccttatcaattttgttgatttttccaaagaaccacatttgatttctgtgacttcttcgttgtctttctttctttattttttactgtttttcattccaatatttatttatggatatttattattttcttccttcttttggctttctgtttaatttactcttcttttttagcttattgaaatgtaacataagttttacatctttcagcctaacatatgttttaaaggtatgaattttttctgaaataatgctttactgcatctcattgaatttgatgttatactttcccttataaactcattcatggtagtttcttaatttgcctgtaatttatttcttctacacttgtctatttagaagagtggtgttgtttaattttcacgtttttggagctcccctattttatttattttttaagtatttctaatttaattatgtttttagtcagagaacatatttcacgtgattacaaatctttcaattttactggcatccatgttacttttcctggatcatgttgcagggatttttataaaacatggatatgtactctgctattttggaatcaatagtatttttcaaatgtcaagtatgtcaaactgactgatagttttgttcaggttttctatatttctattgactattcagttagtttttctatcaattattatgagagtaatacgtaaatctccaactctcatttaaaaattttttttctttgaattttgtcttattttgtttcattatatattgtgtttctgttgttaggtacttatatatttataactgttatgtattcaaaatatattgacatttgtgtcatcatgaaatgtcgttctttttctgtataatatttcttggcttaaaatctattttctatgatgtcaatattgcttttccatctctcttatggttgctattttcttggcatattattttctaatcttttagcttcaatctgttttccaatggtaaatcaaatgcacatttgttccagtcagaataaacttgggttatgtgtgtttttttaaattcagactgacaatatctaccatttgattaaggtgtttcagtcaatcacatttgaaataattatggatatgcttagatgtatgcctgcaattctgctattttttctagatgttttatgtctttttaattttctatttctttttactgcctaagttatattaaagagatagcttcaatgtagtgctttaatttgtctgttgattttttaactatatattttgatttttgaaaaagattgctcttgggaatcacatatgcatctttaagtgatcataatccacttcaattttatactgatttaattttggaattatataaatattttgctgcattgcagtatagatctatttcaaactattgtttttcatattacatgcatgtataaactcaacagtccaggattattcatgttttaagcaatctcattctttaagttattaaaacagaaaagttccttttttaataaaaataagtaacagcttaattatccttttctttcctgtgaatacaagttactgcctggcattagttttcgtttctcacactgtcggacttcgttaagtatttcatgtggggaatattttgtagctgtgaattctctcacttcttgtttatctggtaaagtattttgttgttgcttctgaaggatagttttattagaaattgaaatctttgttgaccttttttgtttgtatcattcaacactttaaatgtcactccagtcttctggcattcattttctgatataaagttagctgttacacatattgatactttcctatatttgataaatgtttttttgctttcagtattttcttttatctttgtcttccagaagtttaatattcctagctgtacatctctttgtgtttattccacttgagacttcttgaatttcttgaatctccagattaatgttgttccttgagtttttaaagttgtcaattatttctttgaataataatgttattctccctcttctctctcctttctgccttagactatcaatacacatgttgatatgcttaacacttttccaaaggtctctaaacctgtccatttcttcaatccattattcattctgcctttcagattggataatttctattaatctatcttttagtttactaattatttttcctggctgttttctattcttttctactctaaaagtttcatttgtttcttatttttaaatttctgtttctctattgaagttgtctatttgttgagtcattgctataataaattatttgaacatatttagaaaacttctgtaagtttttgtttgctaaacaaaacttgttttttcatccagagtcagtttctatcaactgcttcttttttcccccagaaatgaatctcactttcttcttcgttttcttgtttgatactctttcgttgaaaattggacattttagataataaacgttaccaattctggatttttgtctgaaaatttttaattgtgtcttattgtaatatgcctgagcagtagctgtaggatctgtctcccttgtggtgtgcagccactgatgtctatgtattttaattcttatttttattttttgcttgacttccttgggcccagttctctattttaatggctagccaatgatttggaaggaggttctgtgaagacatcttacacccataggattccactatctactgatcaatctgttcaggttgaggtgtgtattcaaagtgcagccagttctcaagttctacttggcttcctccccactgtgatttgggggctcttttctctgcatgtgcatagcttcctactcagccaggtgtatgtggaaaactcatttaggccttatttgactttctcatttctagggtcaacctgttaaatttgtcagtgtctgacaatttccccagtaagcatcacaactgcactgtaccaaactgtgaattgtggccatttgtaaactaccaaatttgttatttcagttgtcaaagccacaagtttatgctactcactcctatttgattccatgccatcagatatcaaagttgttgggtttcgtgtcatgttcatgtgaacaaagtaagtaatttcatcgaccgctgagagtaggggtggaaaatgggaataaaatgaggtagtaagaccataaactcctactgttcttacccaaagttatagcagtttttgaaagacaacacttctcaatttatagtctgcattaggttgactatgaagttcccaaatcattgttcgtgactgtttatttttcagctttatatttgttttatgtgattaggatttctttttcgtatcattcacttcatgacactggtagataagaaatagcaaaaaaaaattaaacttttaacttaaggatattaaaattaaggaactgtttaaaaatgcatggaactttttttgagaaactaaaaagattatatatagtcacgagggaggcactaactcggcctgaagaggaaaggaaagggaactgttatattaattattaaacagtggttatatgtacaagaatgcctgagaggagatgtatcctttggcaaagggtcctgttccaaccttagcagtctctgcagggacagagttagaaaatatacagcatcatctcactctccttcttccctttgcctctgagtagtttctctgatagaaggacttcaacaggaagctacagggcaaggacatttcttcgtgagctgcataaaagtgagaatcccagacagagaacagagggtaggaggattaaaattatagttagtgtggggaggggtagggaactgtagatacacagcatacttcgtaagtaccatcatatttgattgttttcactgctggattataatcgatttgctggaaatttttattcagaaaaaaggcataaaataagtgactatgatatttattctattatacaccatagtaaatttatatttaaaagcattgaagaatgtattttgcttttactactgtgatacccttaatatgttgaataagccaagtgtggtggtacatgcttatagtcccagccacttaaggaggctgaggtagtagaattgctggagtccaagagtttcagtttagtctgggcaacacggagagactccgttttttaaatttactttaatttaattttttttgagtcagggtctcactctgtcacccagtctggagtgcagtggaatgatcttggctcaccacacccttgacctcctgggttcaaacaatcctcctacctcagcctcctccatagctgggactacaggcatttgccaccatgtacagctattttttgtggagactgggtctccccatgttgtccaggctgatctcgaactcctgggttcaaacggttcatctgcctcggcctcccaaagtgctgggattgcaggtgtgagccaccacacccggacaagaccctgtctttaaaacaaacaaacaaaaaaatctgaagcacatgtgagagcataatgttcattgtagtaactttacagcaaataaaattaatgcctaatattgtattttgtaatcaccttgtcaacctttgtgctttctaagagtttttgaaaacctttatctccatagtaacagctggaagatttttctaatgtagtgaaatatacaggatcttttacacattcttcatgcacagaaaaaaagtatttcatttaaaaatgtctttagatctagtagaatccttgactactatatgaatgctctaaaatgtactcacttgtgttactaaacatataattttattaaaatgctttctctaaatttctcttcataatacattacatttcaagtaaaaggagagagaattcagctattctcctttgtcacttttcattaattctgtaatatgttagactatatattagaaaagaatgttccaccttcagttttctatgtgaaatcagtgtgatattaggaagtagacagtaggctagcagttggaaaattagagtcatagttatgttccctactatgcctatgacgttaaaaagttctggtgtatgtgctttactatgtatatctgacttattttctatattaacttgaatacaaagccaagatttctaactgattaaatagaagtccaagtaggtgaatttttcaggacgtaagagcaatagagtcgtgggcagtttcaggtagccatttagagtctggactctataggtgtagcatttaccttactagcagttgcacatggagacatgaatatcttgcagcagatgtgattcagaaatgcaagcaataatttagttgcagagttcaattcttcggtggttaaagaaatcggtaataagatgaaagccaagtgtacaggaaaaaaaacactagccaggattactgaggttaccaaggctgcttcttagacatataagacaaaaagtgccccacttactaattgaagaagaaggagaagagcatctgttaaaatccaagagcaatattagaattcaataatagaaacattgcaaagtttatggtgagtctccctttcctgctagagtgcaattcaaatcaatgttttctgcatatagaatgcatatgaaagacttgggtgaagttcgttttaagcctgttgtggtgagactagaaacgtagggtattgatggctcaaaatttcctgagtttagggtacctttattttgaaatttggaacaagtaaaatatgtgtcttccaacaaaacatagaatgtgtgccttgaactgatgtatttatcaccaggaatgcccttagagggcaatgataaattgcaataacacttttgaaaattcaaaagaaataatatgaatttaataatttaagttttaattatgatcaggtgaagtacagagacagaatgcaggaagatacattttagctatactctttcatattctaatgaattgatgaatacagatattttgggaagcacagatatcatcatttacatttaattaatctgcttatgtttataaaaacatatgttattcaaaatacacatacatggctggtgagtgtgaattgttatataacttttggagggtagttttgtgctgagtatcagattttaaattgcacacaccattttttccaactcttctttttagaagaagttttttaacaaaatattacatgtaatagaaaaatgaagacaacataattgtcttcattataggaacgataacataaatttgtacaatcactccatagattataccaaaatccttgagtaggtctatatgtgtaaaaataaaagttgtaaaataaaacactcacacattcacaaaataattccatctgtttatgtcttgttatgcctatgaacacaagttttgattcaacttttagaatgatgtctatgagattgtacaccctgagtggtcctaaaacagacactggagctggaggagagaaagaactaagcttccatattttattttgtgtatttttatatgtttgacttatttttaatcaacatttatttagatattatttaatgacttaagaaacaattgaaaataataacatattacatacaatttattacaaaggaataagaaaaattagatgggatatatattttttgtggcattgtgattcttacagtttcaagtaaattgtaactcaattatattttgagaaaatgtgaacatatttctgaaacatagaaaagcattcaatattaagcttgaaatagtttctttctagataagaaggcctacaattcctacagaaggagaattataccatttacagtagcaaggaatcaagagatcattttattttaccatctaaggaaaatttctgggttgctaattttactttatctaaaaaaaagaaattggatatctaatggtagatttaattggagtatgttgtgacaaattgacgtatagtagaatgctatgataacatttgtagttatttttaactactcaatgagcaatgacctatgttgaaatttgcattttaattatacaatcatacccacagaagcatgagtaaattttaattatagtttgaacaatatgcacatttagaagaatggctaaaatggatgtgctttatatgtatttgtgtcaattattgaaaatgaaatttcaaaaaataaaatttatttggatttcttacattccataaaataattcattttgttccattagcaaaaccatgaatgcattatacataccaatgcatatgttaaatatatcaaaatattaattattacttaatacaattattttaaacatttctgattatgtaatgttttaagataatcaggggtttcaagaagtagttttttcttttttttttttttttgagacggagtctcactctgtcgcccaggctggagtacagtggtgcgacctcggctcactccaagctctgcctcctgggttcaagccattctcctgcctcagcctcccgagtagctaggactacccgcgcctgacaccatgcccagctaattttttgtttgtttgtttgtttttgtatttttagtagagacggggtttcaccagtttagccaggatggtctcgatctcttgacctcatgatctgcctgcctcggcctcccaaagtgctgggattacaggcatgagccaccgtgcttccttagaaaattagaagttaatgaatattgaatagttgctgatatttcttagaagaaaaaaagtatagcagctgaatggaactgtggctggaataagaaacatggaagcaaatacttatcagcttattttgacatttagtttaattaaagcatcttaggatttccatggggagaaaactattctgctgtactttctataaagaccttgaaaaagcaggatgaggaggaagcataaccgaatacagagacagtcgacaacatgtttctactaggtgaccagggacttgttggaagtagagggataagaaatcatcatgccataggaactctacaaaagcttccagtcactcttagaataatgttcaaagcctttacaagaaagcatcagagtgcatcaagagacagaaatcacaccagttatttaactagagagaacttaatgtaaagaattttacctagatatataacatgttaaatacgtaactgaaaaggtgaaaagacacagctgacttgtgtgccacaaaaatagcagctgtaggaaacagacaccacatctggggctgcaaagatacaggaaagaggcaacgcatttgtcagtgttctccagagaaacagaaccatggcacatactgatcaatcaatcacttgatccagacaaattttaagaaattggcttatgtgagtattgagcaagtgtgaaacctgtaaaacaggccagcagacagaaagtggaggcagaattcctgtattaaggcttgagacacaatttcttcttctccaggagttctcagtttttgctcttacaacctttatgtggtttgaagagccctgccacattattaagagtaacttgctttacttagtcaactgattgtaaatgttaatcacatatacaaaatagtttcacagcaacatctgctctacggtttgaccaaacagctagcccagatgacatataaaattaactgttacagtaagaataattaaaagaataattaaaacataaaaccttagataaagtgttttaaggaaatgagattcgggcttctaagaaagagaagtcggtacttagctagtgctggtgtccctgagctcagagaagggactttatgggtcagggtcatagacttgtgtaaagggccactgacactatccctgagatgagcatacaatgaactgggttctgaaaatgtggaaaaaagcaagaacaggattcagctgctgctacagaaaggaattgccactgacaaggtgaaaaagccttgctggagtgatgctcacaggaagcacgagcaggcaggaagccacaggcaggcaataggacatggatgagaacaaccaagtcctttttcactctttcagtctctctcttgagccctccccctcagcttctcagagtgcacacagccaaagccaatcaacaagatgtcaccagtgtagtggacctgtgtttcatgtgcagaatgattagataattgtgcctttctgtggaacatattacagaaaatgcaggagcattaacagaccagaggcaggattgtggcagatttactccgtaaggctttaaataccctgccttctgcatatcactcagcattagtgcttaactattctcttcctccgtcacgcaagccccagctgtagtgatctacttgctacccatctacacaacagctgcattcccaactcagggatgtggcatttgcttttgcctcagctcataaagcttttctatcagacaggaacttgattcagtcacttgcttcatttgtttctcagcaaatgtcacccctaagctacatttttccagatactgtatctgagatatcatctctattgtcctgtgattgtttatctcactcatcctgttttactactccgcataacacttatcactgcctgaaaccacagtatacatccatttactcctttattgtttacttgacctgcaagaatacaagcttggaagggaaggaacctgctaatttatgttcactgaactttgacctataactgtgctttgcattttttcaatcctcagttaatttgttcaatgagcaaatgaatcttggcatgcataaaaggttaatatgaccacaccaattaagatcaagtaagcatttcacacacacacacacacacacacacacacacacacataaataacgaaaaacaagaaaaataataaaaatgtgctccactgggaaagctaagctgagctaagaaaatataaggcctgtggaaacagaaatcttgttgccctttcttcattgtactcttgaagcagaatgagccacagacaaaactcctcagacaccaagttaaagaaggaaggggtgtattcggcctggggcatcggcaagactcctgtctcaagagccgagctccccgagtgagcaatccctgtcccttttaagggctcacaactctaaggggttcccgtgagagggtcgtgatcgattgagcaagaagtgggtacatgactgggggctgcatgcaccagtaattagatcggaacaaaacaggatagggattttcacagtgcttttctatacaatgtctgtaatttatagataccataaccgattaggtcaggggttgatctttaactaccaggcccagggtgtggcaccgggctgtctgcttgtggatttcatttctgccttttagtttttactttttctttctttggaggcagaaattgggcataagacaatatgaggggtggtctcctcccttactctcagtatatggaagaaagtctggcagacagcaacttctcaattatgaattaatttaatttataaaaatgaaagtgaaagacattacttatcttcgcctaagttgttatgatgtttgcattaaactacttataattttgtgatttccacaaagctgcaaattacaagtaactggaatatagtcaaaagagaaacaaccagtaccactaccacagcaatgacaaaaacttagaaatacctaaatatacctgtaactgttcctttgttctcccctaatattttttctgtgtatttcattttcaccaagcaattttactttctacgtttttatttcatactgaaagtattttcttactgttgcatgcataatcactattttggtatctacatactattcacattataattctaccatatactacatttatctctatggtaaaatgtttacttcaagaaaaaatatttgactagaagcctgattagttttctctcactgctataataaattaccacaaaccaagaggcttaaaacagcacacattacataagctcacagttctcaaggccaagattcctgaaaaactaagcttgtttcacaaggctgcaatcaagttgtttgtcagactgtattctcatctggaggctccgctgtggaagaatttgcatccttgcccattaggtcgttggcaaaattcagtttcttgtagctgtatgactgatggcccagcttcttactggttgtcagttggagacctctaaattttacagaccaccctcaattctctgtcatggggccctgtatatatagagttcacaatatggctgtttgcttttcaaggccagcaggaaatgcattttagagtgtgctagcaagatggaattatatatgtgtatatgtgtgtgtgtgtgtgtgtatatatatatatgtctatgtgtgtgtgtgtaattaaatgatcaagtgacattgatcactgcccaaggacaatcactataaacatgcattttccctagtctgtcttgtgcatatggctgtttatttttctgtttcctgctatcatttttataaaacaatgttttgttctctataatttaagctttatattatgtgcaaattttgattttctatgatagagcatcaaagtggttctgctattattagagcactatgctgaatatcatggcagatgaaaatgttctacttctcagataagaatttaagattcactctaggaatagattttattttaagtatgatgaatattttaatttttatgatagtaatagcaaaattagattcagaaagggtgcttacacccatctggagtacctatatatgcttaagtacctatttatctgctttctgttcagtgttgggtgctcttattttaatttttaaatattttcccaaagtttttatcatctctgggccattataagctacatggctcacaggggccgggcaaggtggctcacgcctgtaatcccagctctttgggaggccgaggcgggcagatcacgaggtcaggagaccgagaccatcccggctaacacggtgaaactctgtatctactaaaagtataaaaaattagctgggcgtggtggcgggcgcctgtagtcccagctactgaggaggctgaagcaggagaatggcatgaacccgggaggcggaggttgcagtgagccgagatcgtgccactgcactgcagcctgggcgacagagcgagactccgtctcgaaaaaaaaaaaaaaaaaaagaaagatacatggttcccaggaatcagagtcagttgccttttacccatgctactaagactcctattatctttttcctttcatagactcctgatttaacccctttctatttgaaatatattggcttctactcttcagcctctcttccaggcatgtctgcagaaaaaaaaaaaaaaagcaagcatgattctattagttttgcattgcagccatatcaaattgacacaaattcagcagcttaaacagcacagatttctcaccttgtgttcctgtaggtctgaagatgcacatgagtctcattgggctaatccaggtgtgggcaggctgtgctcctttccaggggatctaagggagacttgtttcctagcttcctatgactggcatcctgctgttcttgtggttgacgatctgaggtcccgatttcctttctggctgtcatctgggggccattccaagactctccaggttcactgcatcccttgtctctctccatctttaaaactagtgacgtggggtgagtccgtctcatatttttaatctctgctcatttttctgtcacgtctctgatggattcttctgctttcctctcccgctgtgaagggtctatgtgattggatggatcctacctgaaattcagggtcatgtcagcagcacaaactccttcatcttaatcacacttgaaaagtccctttggcacctgtaggaacacagtcccatgttctggggtttgggagacaggcatgtgtcaggcgtactattctattgctgtgatgtaggagtgaagagcacatacagaattcagagctagacatagctccagatatttgctggggtgcctcagagagagtagctaatttttctgcacttccacgttatcatctatagaatgggcataatagttccagttaagagaggtaaacaatgaacaaatacatatttacaggagaagtaacaggttgttccatgtggaggagactgggtagcaacttttgcttgtatattaaataaaagtctcactcaaggagttatcttttaaactgacttctagatagaagtcaccagcttgggaaagaagtataagaagggtggagcaaccctgttcagaggtgaatgatcttggcctttatctagaaataaataaagtgattgtggctagagaggcatggatgatagaaagcaggatctctggtgagcttggagacataggctattgccaggccatgcagaatttgccatcagagcaagggggttggaggcaattaactgaaacagaaacacatatagttatgcagggctgtaaccataaagagataacttttttttttttttttgagatgtggttagagttttacattctataccattttcttttggtggagtatagtcataattttatatgttttttactctatttttctcagatctttcaagtaaatatagcattttttgagatgccacactggtcctaaaactgaacacaggctgtgactcagaccatgcctccagggagatagttcacactttcataggcaagataaacagattattcccacatggctgggctgtcactaccccaagatacggccttacaagcacaaagtaggtgattcatgaagtaacatcacaagtcctccaacaacaggaagaggtgtagaagcaggggaagaaagttcttgttatttccttttaatattttgttcagacaaatttaaacagactttgctaatgtttgatagccattattagcttagagttaataaaaagcaaagatatcaattgctttctagttatttttagagtagagcctcgataatacaaacaatgaaataagtaagcactaatacaaacttaggtgtttgtccaaaagaaactattgatttgtaattcctcagcctgagacagccaacagacaactgccaagcctcattaatgcattatcctgacaagtctatatgagccactgatttgtaggtaattcagtacacatagatagcttttattgatttagaaatcaacttggaaatgaaatttagcatcatgataacctataaatatttgattttattttagttgtataaaactcttagaaataattagtcaataaaataacttttagaaataattaatgacttgcactaaatgaagagtcatatatctctgatttcatacccagatgctttctgtcttctttcctctgctccagccttgctcctatatgggctaggtgtcaaatgcactgagggttctcattctctgagactttgtgctcaccctctatgccagcagtgctcttccacctgatatattcatgctaattctccaacttgcctcaagattttcctcataggtattgcatctgccccaatctctctgcttaccctattagcaactaccacatcccatatgctgatctactcttctctcctgtagaacattaaaaactgccagtggaagaaagtttgtcaatgtggttcaccagggtatcctacgtagttaaaatagtgcttggaaaataataagtgtttagtaaacacttgctgaatgtaagaataaatagtgttccataaatgatgctaataccatttatattacttccaaacacctcaacttgtatagaaacagttaatgtttaataacatactttgataataatctgtaggtttttttccttaagtttaattgttatagaaaacttaatttagggaaaatagtgtttgaatgtatgatatgtattttgtccttgggaagctcaccattaaagtttatgtcttaaggtagtcgtttagttagggtaaactataagttctctttatttgtaaattaaccataatcaatttacatttaaaattatattttaccaatgacatttccatatttctgttgaaattgtgaatctgaccattggtaataaagaatatatatgtaaatattaaattaccgataatcatacagatagttaatagtgtattacagatgagattataataaaaaaggtcggtggtaacattgttgctttcttgtaatttcaaagacattagcagatgaaatttctaagaacataataaaatagaaatctttaaatagttaggagttttgaagatttcagttacatcttctcaaaggtaaatatgtctccttataatgaattctttcaagatgaattaccgatgttttcggtgaaaatgttttctgaaattccatttataagtgtttttaaaaatttatttttaatgcacagaaatgcgactgacttttatgtattgattttgtatcctgaaacttcactgaatttgttagtctaacaatttttggttttgttttttgtgtgtggaatctttaggattttgtacatgtaagatcatcttttctatgaagagataattttagtctctcctttacaacttagacacatttattctttgtgatcaattgttctgacaaggatttccagtattatttttaaaagaagtggcaaaagtgggccaccttgtcttgtttttgatctgagaggaaaaaatttcagttttcaccactaagtgtgatggtagctgtggggttgttatacatggcctttgctttgttgaaaaaatttcctctttggcttctatgtccagttttttgattgtctttgtcataaaagggtgttgaatttttcaaatgtaatttttcttcaatttattttcttgtagaatatagttgatttatataaaaacatctgagtatcttgtagcaatgaagttctagaataggaagaacctatttaattcaatgatcaagaaattcaatttccagattccatgtccctgtatgtgcccatttctaccccacaaaaacattttcagaatgttcacaaactattattcttcacatcaattttaacataaaatatatcatgactttttgaaaatttctttctctatatcatgaagtatttgaaaatatttgtttttatatattgattttaaaatcaatgtttttattatgaaaagttgaaaaatacatacaaataaaataaagtgttggtctcataatatcaacatacagaactagtaatcttttaaaaatcatggatttgttttgtttatatcatatgtaatttttgttgagatcatacttttgtttttattatctctttttttaaactcttaaaattatactcaattactttattgtgagatttttcccatattcttttgaaatatgattttcagtggttatgttaagctatctggaagtaatcctctattaatgtaaattcattttttctatattctccctcttacaaatactaattcaataaacaggcttttgtgtttggtggtatggatttctaataatttccttagaaattctctaacagtggaattcttgagccagagatgattttctcatggctatggttatacacatagtcatatatcacaaagctcctaaagaaatataaaaaatgtttctttatagctatgttagagtaaccactactgacatttaattctaatgcctctcactagaattcatgcatttactctcctttggtgagataatttagcttttgacctctgaaagaaaaacaaaaaaaaaaattatattttttttcaacaatagcaagtagctttttataattttgtttggcagctctaaaggagagttttatctgctcatatgtcaagaatttctggttgttattgggtcactaaaatgaccaaaatggccctggatgtcattttaagtcagaagaggcataaatggaatttggtacttgaaattctcgagagaatgaagccaattccagctaagaaagttaccttggtagtactgctactagaaatataatggttttgatttaaagtagtctgaggcagtattgacatctctttattgagctatagcactctagccttgaaaaagtcatacacgttttgtgaactaacctccattccttaacatcaccgtctttcaagtttacagtacttagttcatgcattgcactttcacaactaactccattatttgtaggttagttttttctatttctgaaaaatctatactttgaaagctttcttgaaatgacaagaagtcaagttccaacggcattgaggttcatactgcaagacacaaggaaagtgactctgtcttccacacggagacgttcatagagtcaaagaaatgtcccttcctctacaccttctcttctgtggtccaaagtactcaatttattttcctgttttccttggcacttgctttccaaaagcttcagcatttcttttgctcttccctaatcatacattaactggtcaatttctctattataatatcactacagattaatgataataaccaagggccttgtctaagctcttcacatatattatctcatttaatcccatcacatgtatacactaagttcaatgacctcaacttacaggtaagaccctacagcacatgaaggtgaagaaactgagcagaactacatgggtagttgttgacatgattagctgctgggctttatcaatacatcctttcctaaatttttctgcaggcattgccccagatgtggcagatcaatgcagatacaagaggtttcccacttccctttttgtaagcactgtatttaatgaacgttgtgaaggatgctgtcagcagttctgatgactatgtcaagatgaagtcatgggtatactgatcaacttggtttaaccatcccataacacatgcatatagcaaaacaccctgtagaacaccataaatatatacaatttttgtcaactaaaaatcaataaataaggaccaaaaaagaacaaatcatttgcttgttttgatcattgtcagttacttttgtttctgaatcatagattatcatagataatcccactcacacttgtgaagtcaacttgctaaaagtaaatgaatactttaaatactcttaaatcccatcactttgtttcagtatgacaaaaagtattcaattcttgcttttaaactccaattcattagcgaatattcccaactttgtagcaaggcagttttgatagaatattttctgttttcatctaaatttgtcataaaattcttaaaaatgacaagagttttctgatatatgtagatatgatacaggcagttggaatagagataagagtacatatttattgaattatttttaaaactccttttggaagatggacaccccatgtgtgctttccttcccagtgagactatggtggtggatttttttacacagccaaaagatacacacatggcttcaaaccgattatataagttgttcaaagttttttctgatatgagaattcaaacccaggtttgcctggtctgccagcatatgcttttttgtaatattcttctagatccgtgggcttcctacatacattcttgggcattactatgtttatgagaatatatgtgctgaacttcctttatataacactcgttttactatgaatttcttcttggaatctatcaaaatatttcaaaaggatgatgagaatatttgttgcaggcagttactgaccactcattgaagtagacaacaaaggcagaagtgcaagtggagattccatagttcaatttgagaaactagatacaatgtgttattggactgtcccaagaccagctcggttgaggagaccctaacccagtagcactagatgaaataaagacacacacagaaatatagcatgtggagtgggaaatcaggggactcacagccttcagagctgagatccccaaacagagtttgactcacatatttattgacagcaagccagtgataagcattatttctgtagattatagattaactaaaagcactccttacaggaaacaaaggaatgggccaaacaaagggattgcctctggctagttacctgcagcaggaacatgtccttaaggcacagatggctcatgctattgtttgtggcttaggaatgcctttaagcggttttctgccttgggtgggccaggtgttccttgccctcattctgataaacccacaaccttcagcgtgggtgtcatggccatcaggaacatgtcagtgcagcagagattttgtttatggccagttttggggccagtttttggccagatttgggagcctgttccaaacaggactggaaagggcaaattcttttaggttattatttatgttttatctttttgagtcattgtggaaaaaatatatatatattaaggtctcatcttatatgtcattacaatccctatttatttttcactattgatgttgatgtttttatttgtgtattgattttgtcgactgcacagcttattattttaaagtggctttcttagcatcatttaatcctttttgtctgacttctactttttctgatttaaacacctctcttcattttgttccatttccaggcatgactgccattgctcatctttgtattttaaactttcctgagtcactttgttttctgtgattttttgtaggtattacaaagttgagttttgtttaatgactaaaactcaagtttatattttaacagataaatttacttttattctgaatcatagattatcatagataataaaaaaccatcatgaatggattaaagctgctataaacaaggcttgcaggagtgggtcctctcttgctcatctgtcatgtgaggacagagtgttccttttctatggaggacccagctttcacaacagcattttggaagcagacaaagtgggcccagctttccagagccttgatgataaactttccagcctttagaactgtgagggataaatttttgttctttataaattccccagtgttaggcattctgttatggcaacacaaaacagacacaacatcaattgtacttctagtcaactggctataaaccagggttcccatgaccccaccttcaggtttgattaatttgctagagcagctcccagaatgcaggaaacattttacttctaattatcagtttattataaagaatgttacaaagtccgcagatgaatagcagatggaagaaatacatggagcaaggcatgagagaagaatggagcttccatgtctccttcaggaacatggggtgctaccctccaggaacacgttcagctatctggaagcctttatgaagcctgttcttttgagttcttatggagactgcattacataggcatgattgattacattattggccattaatgatcaacccaaccttcagcccctctctcctccccaggattaaagcatgggctgaaagtcctaaccttctaatcaagccttgttctttctggtaaccagccccatcctgaagctgcctaggggctaccagccaccagtcatctcatggaaacaaagatcaaatatgtatttcacagtatcactgtattaaaaaagttcatattttctttcttccagaacattactatcttatcatgttacattttgctctttggattaatgaagctacttttttttttcttttatgagatttttgtattgacctggctgactaaaagagtctgtccttttttgaaatttaataacttgattgatttaagcctcggaattgatttttccaatttcactattcttgaaacaagatgtgttcatttaattggtagatgcaaatcatcttatagtttgtgcatttttttctgtaattgtttgtttatatttgtttcctgttaattgttctgatcttatttagggtcactaatgatgtacatggagggtctcctttgcttctcttccagaactgtcatgttctagtcaatctttttacatttatcttttacttccattttttttctcattttctcagtcctgttgttcgttctttgagtgttcatcagaatctattcttgttgtacctttcaatttcaccttcctttatgtgaatttataaacttttgtttctgcttctcttctaaaactgaataagctatatttcttttcctttttgctttactctcttacttgtggtctttaataataacaagtaaatcaaaatatatgtttatttttgcttgtttactttattttgaagtaaaacttagaatgacatgaacaaatattgaggtatctttgttgtgttttcacaaattcaggtgcttgtgtaacacagttacctatcaacatgtagaatattaccagaatattcctgcataccctctttctagtgaattcgtctcttgctcccagtggtaatccatggtctgatttttttccccacagaaagacaagtactacatgatctcatttatatgtggaagctaaaaaccttgaaatcatagaagcagagagtagaatagtagttgccagagcctgaggggaaggcagaaatggtgagatgttgatcaaagggtataagctttcagttgtaagataatttctggggatctaatgcacagcatgaggactatacttaacaataccgtgttgctcacttgtggtatatcttctttgtttcattattctacagcagagatttttttcaaatttctttaatgtatacaattttttatcactattagattttttattgcaatattttctgttgaatatttttttgttttgaaataatattttctgttcgtcatctcctttatgttgtagtaagtttacatagagactatgcttgttccttcaaatgagatgatttttttccactcaaatctatagagaaagagataactcaatttagatattaggataattctctgaaacagtatatcacactatgtaatctaacaaatccttactgtccatactcagttaattgatacagaattctgttaagatacatggtgtttgctaatcttgtatgcttctcatgtctggaggttatttaagtgtgtcctcaatgatattgactaattttagaacctgagtggtcaaatccttaaaattaaaactggagcttctgttcataaaagattcttttgctctcctcttgttacacctctgtaagatttacatatagcatttattttagtgacttcagagtcatattggttgtgtcattacctctgttcatgtaaactataaattccttattttctctactttttaaaatgctgtatggtagttgatacatcttataacccaaaactatagggacgaccaattgtctgatgaatttagctactgtgtcaaaagaaatgcataacagtgctgcttcgatattataaatacatgtggcattagtacctaggccagggcctatgcaatgatagccatttgatgtttttgttcaataggtaaatcagtggattatttttaacatctggatagtttttcaattactttcaagattaaatttctattttgcatgttgttggtaaaaaattacaggtgataaaaggtaagtaggaatttatggaaaacctaaattatttatataatcttcatatttacccaagatcataaaatgaggcttgaaatattaatttgtgtctatatctgtatttttctattattgagtgataaagaaagaatatcatgcatttactctgctttcaaagagagaaagagaaagaaagagagaaaaaggtaggcttaccttagtttaaggtttttaagaaaatagaatgcagcaatcatatgccttgagctcttaaatcctaataaatgccatgtgtgataaaggcagcctaataattaatgccaagggttttggggttatgccaaccaaatcttttctccacagttcttcagttcttactggccaaatgtcctcagtagttgagctatactttgtcttttaattgcttcatctataagatgagttgttttaaaacataatgtgacttaacaggtgtgaatagcacagaatttattttatatataaatactacagaaacacaaagcacctcctctttatttatacaaccatatctacagccaaagtaatctcaatgtcagtcacctgcacctagacctgcaggtaatgtgatgagaactgatggaatttttttacttgagagttataccccaagaagacagatgaagaacagtgaattttctttatttatgtgcaagtgaaggacaactgtcaaacagcactctactcctgaaaggagagagataacttgtcctttggagactggatggaaaggatcctaggctctctgcctaaccttttggaatgccaaagactctccaaaagtcagatacatccgaaacgtctctgggttttatgaactagagatacctccaagatttctcctttgtgagatgtacatatccagggagaaagcttcctagttttccaggagacctcagggataaacctaggaatttagtctgggctgtaacctcttggccctcttacggggataggagaagtgttgttatcttttctgctcagatgagagcaattcactagaaaaatatctccagatgtaattcttatggtatgtaaaaagaaaaagcaatgtttccagtagaagtgaaggcaaatattcttgtctttttctgtatacatttcctgtctcaggaagctggggctttgtataagcacacacagaaatctagagaagtttcatttcctcacagcaccataaatgggaacaaatatttataatgtaaatgcaacaatttttggaacaccatttcttcataggcaccaattgttatcctgattatattacattatattatagagacatgaatctagtttaaccagaacccattttgtgtgcttgcctgagcaacattctttttatttttttggaatagtttttaacacttgattgacctcatcaaattaacagtgaatgactctgaatcgcaaaaccaaaggacttattcaagggggtgatcacatgttatataggcaaattcgagaaggataagtaaagagaagccccatgggtgagaacttttatatttttaaataatccattgataggacaactgttgtattctgcttcctttattacttctttaagtgtgatttaattgaccatattgtgtaattcatcctccttgatacataaagagaaatgtgatttgttctacagaaaagcacagtgtgaatctatggtttaagagacctattcatcccatttgcagtttaatggactgactctacgctctgtagtgcagacactgcagaaactttctatactgctggaatacccttcttacccatttttgatgattagacactaaatcaatgctcacgtctgctatattttactagtctagtttttagagttatttgaagcattaaagtaactcagagtatatgactatgttaagcgatttgtcattaggaaatacttcaaaatgaggtcacttgaaataactactgtgctgtttaggaaacacatttttaagcactagttaactttcacaaacataggatatggcagtcactaaagggcaaaacaggtcaaaatacagaagtgtcaagtacattatatttatatttatagttacattctagccttaaaggatgggtaaaagcttaggaattggggtaatatatgataaaatgataaatatcatggcatgtattttattttaatagtctttttaattttatttatttatttatttatttatttatttatttatttatttgagagagggtctcactctgttgtccaggttggagtgcagtgttgcaatctcggctcactgcaacctctgcctcctgggtttaaatgaaccgtatgtctcagaatcctgagtagttgggaccacaggcatgcaccaccacacccagctaatttttgtattttagtggagacagggttttgccatgttggccaggctggcctggaactcctggcctcaagtgatccacccaccttggcctcccaaagtgctgagattacaggcatgagccaccacacccagccctatttttataatctcttattaggttaagaaaaatatattttatatgctattactattatgaaataataaataagtaaaacaagtaaatcatgtatagctgtaaatcaaatattttaaaactagtaagatgcatgcctttcccaaaccaaaattctgaagactgttatattcaaaaagaaaatgtgattatgtggcaggggaaggtttaggctatcagtgtctatttgcaggcccaagatgtcagctgtgccataattaataaaggtcctttgtctctgattcaagaataccgtgtcttctaccagtacctataaacctgtgttaagctaacatattcacttgcaaaacctcagacctttcatggcctataacaatttgtcagtgcggctgaaatgctgatggagacatagctttgcagtagaaataaagatgagggcctcattaatcattaattggatttgagagcattcatgggcattagtaataaatatattgatcaaattgttccttcaaccaggctataaagctgtcttccatttcattgcctattaatgtggagtaatttgagaaaagggtataggaagagaattgaaaagtaagttcaaaaacagctttctgaacaatgtcttctgtgtttctaatggttcttcacgtggggccatcttgctccccagtcttgcagtcagtctcaggcctggtactctgaaattgctattaagagatttatctcttttcagacaacaggtacatttatgtttctgccctgggcattaaagcaggaaaattcatagccactctgggtaaaaaccagtggaatagttagaactttacctggctcaccagagagatgagagaacaggtgcataaagcttcctaaagatggataacaagggctgtgctcagaaaggaaaagaaatatgctctgcttactagcatgaagtgtctttcaacttctgggccctcatccctccctgccttactaccttgaccccagcttccttaaggaggaatatgaatgttgaggtgggctgtgcactaaagtctctgtctttaagaggaactgatacataaccatccaaacgagctggggaactttgtgtaggaaatgaaccccaaattctatggcgctgaaacaggtacccatgttatcatcttcctattcctatggggtgaggagtgccagtatttaatcaatgggatttgggaagtgttcacagtgtaggagaggctaatgggacattgctgtttaggcctattgggattccatggaaggttgttttttattcctatatctgtgtatgcagtagaaattgttgcattatatgcctatgattctctcttccataagtgccaaaggggagtctcttaattgagaatagctgcatatattcacaaagttccccatatgctgggcttgggctaccagtggttcagctaagctgaagcctagcagtgtccactgggctgccgcagctgtccagcctcagcacccaccatgcggagtcaaacactgacatggtagtctccacagtggacaaacacaaggctgttctcatggatgttgtcaatatacccctaaataaacctcattatatttttactgacatttaatctgttgccaatagcttagctgtttggtctgccacttggaaagctacaactggcagattaaagcctccttttctgtggggcggctaactgtggcacaaatcacctttgctggtcaaattgtctgggtcatgcatccggatgccctctgctgagacttgggtcctgtcttgtgcagttaaatctttgaactcatttcatctttgagcttttcaaacgtgatttttcaaccaccttgctttatcttattaagtcagttttttaactgaaattttattgaaataattgtacatttacatgcagttctaagaaataatgaagagaaaacctgtgtaccctttacctagtttctcccagtggcatcatttttcaaaactatagtataatatgatacaatatcacaacaaagatattgaaattgataaaaacctcttcatattgtttagcttttttgtctattttaatttttgcttgtgcacattggtggtatgagtatgtgtaattagttttgtacaattatagaacatgtttaggctcatatatccaccacaagtcaaagtagtgaacatttgcagccccaccctaataccttctgttgccttgtataaacatcctcatctctgtccccacactcttttgtaaccaaaaatatgttttccatttctacaatttggtcatttcaaaaatgttatataaacacaattacatattatgtaactttttggtattgacagccgcagtctgtacctttgggattggtctaccacagtagacctgtggtatcctgggccctagtggttcatgctcctcccaaatgtaaaatacattcaacctttcaaagctttccaagagtctcaccccattttaacgtcagctcaaactcccaagtttaatctaaatcttatcatctcaaagtccaaaatgtcatcatcaaaagcatataaatcatgtgcagatgagatttcttggcataatacactaagcactgcccctgggactcaatacctgtccctctatggatctgtaaaactaaagtgacaactttagtttggccaacaaaagccactttctcgctacttcctacattcgctcaaggccctagcactctacaatcagtaggtggtgaggtcagccagccttgtgtctttcccttaggggcagtgagttttttcaggccctaggctggtttagagatgatttccaggagccagggcctggagtcagaaaccttagaaatttacctggtgctctactctacggcagctgagccagcagccaaaatgcaagacaaagtcctttcactcttccttcccttttacacaggcagaagagtctctccccatggtcaccatcaccagaggcccacagggagtgcttccaggcaattgccgatgttcacttaaggccaggccactgacgagtccactcagcttgttgagaatgctgccaggcctgggactcacccttcagggaagtgggctcccctctggcctggggtcagaaatgccatccaagggccaaggcctataatcagagatcccatgagcccacttgatgctctaacccctgtggttgagctggtacaaaagctgtaagacaaagtcccctttacttttatctctgctcttctaaagcaaaaagcatcaaaactaccacagctaggaatgtgcttggtatcacctgaagccagcaaggctctgagtcttagccaaggcccacagtgagctctgcctgggtattgctgctgattgtttagggtccaagggctctttaatgagcaggtgatgaatcctgccagaatttgctatttctctttaatgcagcaggttctcttttggcccagagtgtgtctagaaatgtcctggagctagggcctagaatgggttcctcatgactctgcctgaggtgactactatgactgagctggtatccaagttgcaagacaaagtcctctttactctcccctctcctctcctcaagcagaagaaaggactctttttcagagctgtgagctgtgctgcctggggttcgaggacagatggtgcaggcacttccttagccaccctggctggtgactcactaggtcatatgccctcaaatccactggctttgagcccagcagagcaccaggacttgcctagagttacagctcttgtggtctagaccacctttcaactttatttaagaccccagagcactttggcacacggtagtaaagcttgccaaaactcaattttgtctgctgggatgtgcaattcccctgtggctatggcttatctaaatgcttcctccgtgggcatcagctgagttctactaatgttggcaggactgacttccaatgaaaattcccaaagtcactatgctctccttccccaaagagcacagattctctcctcttgccaagctgtcactgacagagtatggaggagaggtggcacttagtgaaacaattcaagattttctttctaccctctttagtgcctctttcagcagcgtgatgttaaaatcaggtactgtgtttgctcacctgatttttggttcttatgaaggtccttttttaatgtagttattaaatttggtgttcctgtgggagggcaatcaatggaagctgctattcagccatcttgctccattccaagtccccaaatgtataatgtcttaaacactatgtaagtgtttataactttttctcaccaaacagactaaaacaggtgttcttgattggcagtcaacttccctccatagcataattcagaaatttgtcttgtagctttaccatcttccagggtctttttgtcaaaagacaataaattaaaagaataaaatagggaagccttgcctgaaagtgcatgcatcatttcagctcacatcccattggtgaaatctaatcacatggtcatatctacctgcaaagaagcatgagacatgtagtacctttgtttacctaactgtatttgtcattttaatttactaaaattatctctaaatcttagtattttgtccttgcttgcttggggctcaggtgttttacgatgattaaaattttcttgttatacaatcatgtcctttaaactcatgaactctttatatagagtaggctctctcaattcatgagtttacttttcttatttgcagaaaaaatgtcccacgaagttaattcaattaggtaacctttcttgctattatttctgtatgataaaatttgaaggttctagtatgcccaaagtgaataaatcattattacttttaaggagcttaaaatatagtcttggttaaatggcttacccaaggtcataaggcacatgaattttggaaacaggcttaggtttcaggtatcctaaatcttcttccactacagtatttagtacaatttttagtatagtactctagtagatcactcactcctattttacctttgatccaagcaatgcgcaggattggatgcattatcttattgatgaaggaaagataggttacataaaatcccagaaataatttgaattgtttacgaatatatttaaattagtcatatcaatattttatttatttttaaaataatgtatctaaaatacatatctttatctgtataaatattattttattgttcaattaaattactgtaaggtacaagagttaattaaacatcaaatagtgtaattctctgtgagataagtatcttaaaccacaccaaatattaaggttaagttttgcaagaacatttcctcaacatacttattcttataactttgctttcaaaacatgacttatctatgtgataggtagaagaattacccccaaagatgtatccacgtccataccccaggtacttctgaatatgttaccttatgtggaaaaaggaagttgggtagagatgttacactggtggctttccagatggaagaagaagagaccatgctataaggagtgcatgcagtctctagaaactagaaaacaaaaagagatggactcatctctagagcttcttgaatggaatgaagcctactgatatcttgactttagctcagtaggacctgtttcatatttcatgtagaactgtaagataatacatttgtgctgttataaaccaccaaggttttgtggcaatttttacaaccacaataggaaatgaattcagacttaagtgtctgaaagtgaggtgccactataatgtactaagcctgtaattatttataaattatatattcaaagctatcatataataaaattgattttcctggattgctttctgctatggttgagtgaaaaatcaagaagtagagttacaaaaattttttctatagcactgggtgctccagtgaagaaggctgagcaggagaaaattgtgcctctatgtcttaacagaaaataccttacaaaatagtgatatattccgatgaagaatcaaagcagttacttttgaggttttaaggtattcttgagagtcttcttgagattctgtgaatacatccctccaccctagaggaggcggtgtgtctcagtagacattctttccaacagaagaaaaccctctcaagtttgccccataagtcactattttacctcactgaggatttctccaaaaatcaaatcatggagtttagcatagagtataacagtagcagtttttctgcaccaacaaaatatcagatgtctataaagacttaaatatcactatatgagcagattacatccaactagacccaaagctatcactgttttactttacaatggttagcaaataagatcattttatgctaaaagctgaaaaatgcttgttgctattgttttttaaactttcaaattattcaattattgaggtttatataatatcattttaattgtataataacttgttctaactacaacctgatattaagaaggagacattatttacacaaaagtaaaaactaagaataaaatggaaatacaagtttaaagttctgtaagagcagttcattattgtgttataaaataatgatagtgacagaaatgcttttcagttaaaaaaaaaaaagctatttctgtatttcagtggcttctttatttttacagtggttctttactcattggcttttaccagaataggaaattgtgactaatgcctcactatgtttttaataatttgcatcccttcatatgcttcttattctttaatacacatttctgaaatatttatgggtgtaaattattgcctttttgtttttctatgaacttgtttaggagaaaaaatgtaatgccattttagcagtataaattaaaaagaactataagaaatattatttgactttattgcttccatattattttcaaatatatatttgcctaaagtactaacacatatgttattgatatcaacagaattgtgtgcaatcatgcttataatgtcctacctgcagattaatacagattactgacagaaaaaaatattaaattacacctctgctacaataatgtacattttaaaaatacttatatttaaataatatatcaagtaaactctcagcctcagtattataaactgaaatgtgtaacaattaacaagccttaccttttagtatattatgattttgtaatgttcttggtattttcaacaaattattctaatgggtttattttctccataagtaattatcaacaaaaatgtccccatctgtaatcagtatttattaaaataggtgacatgataggttttacttttttcaggaccagttatcatatatatcctcatccttcagccacttctagttcttatttggtcataaaatttcttaagtactatcattgtggatttaaacacattctaattttaccaccaaaaaagaatttgacaaattgcttgagaagttgatttagcattgcaaaagaaaacttaattagatactatggatcaattaatttgcttaatgaaaactttagctgtctgaggaatatggttacacagaaagacggaagtatgacttcctttattgtgtatggtgcatctgcctatgaaaagaaatggcttttcttgatttcctctatttataccccaggctgttttcttccctccccactgtcctattctgaacatagtacaggttgaaagacttataataacaaggtcagtcatctacaaagcctctctttcctctagcttgttaatctacattcttttcaccttactctgctaattgaaagctggctttcctgcggagaattgtttgatcctgcagttctctcaagtggtatctgatttcatttcctgtttataatcttactaaacttggagatggataggtattcttcttgctcctcagtcttttcttcatgccttcatcacacacatatgtacacattcaatccaattccaccatccacgatctcagacatggacacctatctacccatcctggtaatgattctaatctctggatcattatcaaatctctaacgtttttctttcagtactttccatatgacaaaactgtacatgaatgtttcctggcctttctgctcttgatctgctcttctttgatgaccttagtcttcatgtctccttaacacattctcatgttcaaaccccacaccttgtcattaccagtaattacaatgtgaacataatttaaatttcaaacaatcttccctagagtgataccttcaaaccttccactgtagcccctcttgtgccccaagctcataatatcccaacttcaatttcctaatccatcatctttcattttagcgcattcatcttatgtcacttatccagcttaaattccataatcaagtattatcattccccagcatacatgctcagttcaattgcttctttactcttccttattctccctgaattcagactaactccaactttccttctgctatatgcctgaactcatttaactaaacatggctgaagaaaaacaaatagccatagtgactcatcccacattaaattcatgatcactgacctgaagtacacgcctaaagcaacctgcaattattctttcttcccccagtctattctctccatttcttttaaatacatttctgctgtcaccttaagcctccaataccactgtcctcatccccattctcaaaagataattctgcttcctgcttcattgagaaaattgaagcaatcggaggagaactgaacacatctgcccacttccctgcatctgtgttctgctgtggctggaaaggacctgcacgtgctcccagctgttgctgttgctcactcaagcacattgctcagcaggtctctcctctgtccttgcatttctctccctaatccttttaatgaccaacactttctgtgctttcatttagagagagcctatttaaaagacaggctatatctactgtctccaattagcctccttcccttctctcttgaatcaaatccaataacgatttgcccccactactcctgggcaaacttcttttatcaaccccacaaatgaacactgtttcactaaatcaaatagtcaattatcggtcctcgtgataattgagtcatccatgcatttgacacagctagtcgctttcttttcatttgtctttcatgacgtaaaaattgcttgagttttttcttacacctttgtggttctctcctcttctctattaccacacaatgtctgctgtcccaggaccttgccattcactgagtctcctatctttgtacacattcacagtttcaagactttaaatatcagtcttaaactgatgagacagtcttaaactgaatagtctatctgacaagactagaccatgccttagaactccagaatggtttatcaaatttatttcttcgtattttctatttctttctaaaataaccacagtcttgaaatgtctaaaactgagctcctggttttatctccaaagcagattttctcaaaatcctatcttttaatggcctcctccattcttctgattgcaaagatcgaaaactttctatcactcttaacttccatttttatttcacaccagaagtaaaattctactttcaaaatagatcgagttaaactactctctaaagccttccctgctgccaatgtttcaagtctctatcatctctcacctgctttgctacaacagcattctaaacaggccttcttgcttcttttctttctttctcttcaggcaagcaatccagtcaaaacgcacattaaattctgtctctcctctgttcaaaccctccaatggcttgcagggtgactcagactaaagccaaagatctgtcagggacctacaaggatgtgtgcaactgaaggcacattccattttatctcattatcaactactctcttcaaacaatttttcagtaaccataaccataatggactcatcatccccaagatcgtcctggcaagcccttgtatttcagccctatccttgctgtcccctcagccttgatgcttttccttcagatatccatacaggtaactcacttcctttaagcctatactcaaatgtcccattggtgtgatgttagggcaatcgcagctacaatttcagcccttcccagtattttctgtcttcttttccttgatttatttatttatttatggttcccccttaggattcttactatttaacataacatgtattttacttttatttttatattctcatgcttccaaagtagaatctaagttacattttcacaggtatttccatctatttggtttcctgctgtgtccagtgtttatgacagaggcttgaatgaattactgtattttggagagaatgggagatggagaagaaaaaatgttcaggttaccaatcatctgaaaatgtcacccttatatgtggacactgtagatgccattatatttgatattcctcttggcaaaaaaacaaacaaccttgggttttactccttctcatgaatcaagatggcctggaattatttgaattgtcagggaaaagtcaaactcagataaagaatgcattttagataacactgaaacatgtcgacagaaaatagccatcgtatttccttttagcacactgctccaagtctacctgctttcttatgctgacactggtgtctcttttttctttcctgattgccactctccaaaaggccctggcatagtcccaaactgcttaatttcaatgtcttgaaagaagcttttatagccagccctctgtggtgacaaatcagggtaattgccgtggtctccccatttgaggggctttgtgctgctgcagtaattgctggctcagcagtggttttcagggaagcagctggcaagaggggaaggagatggtttctacagctgatataaaatgacaataggctcatttgtaaactcgcaaccaactatgtgcccttcccgaaagtgaagattacttctttctgagtgtaacagagaactcgtggtatgtttagttcattttataacttcttttccacttgaagcactttttgaaatttatttgattaagattcctcttacagaaatattaacacaggaaaaggcttgcagaaaccggacaaaaataaaattatctgataaaatgtatatcagtgagtgactcacagtaacagcagggctggggaggggagcatttcctggaagggatggagggagggtttgcttgctgccctggagagccaagaggaggctgagccctggtttccgagagggtgaacatgggtgtcgcagagtatcaatagctttgatgagacctggtctgacttgttatttgaatggctttaagcactaggaatggtgctcctgaatggggaaccatggaaggagagtaaaggatgcctccatctttgaaagtaaatgagtccatcacagctcaactgcagggctccacagagggaatccaactgtgagacaggtgccctggatgccgagggaagatagcagtggagtaaacagtggttgcagtggccacgcaatgtcatcactatgggtgcatttttgtcagaaatctcctggaaacatcaaaagcagatgtctggatttgttaggtgctgtggacctcactgtctggaagaataagaggccaggtgaaacatgaaaatgattgtacagttgacccttgaacacttgaacaacacaggtttggacatcgagggtccactgataatgtggattttcttccacctctgccacccctgagacagcaagacaaatacctcctcttcctcttcctccttcttcccagcctactcaacatgaagacaatgaagatgaagagctttatgatgatccactccgacttaattaatagtaaatatattttctcttcatgattttcttaatcacattttctctagcttactttattgtaagaatacagtatatattacatataactaataaaatgtgtgtgaatctcctgcttatattttcagttaggcttccagtcgacagtaggctattaatagtaaaatgtgggggagagtcaaaagttatacattaaattttaactgtggtgtggtagtggtaggggatttctgtcccaaactcctgtgttgttgaagggtcaactgtaatttctgagatacatgtaccctcccttgatttagagacttgacattaattcttgagttctgcagggttaggagtgttgtggggtgacagtgctaacaaaccaggcctccttggcaaataattttaacattactctcttgccttttgtaggcattttggactgttgtggcctaaagaaacacttgctatgcccaggtgctttttttttttttttttcctacagatgaggtccgctatgttgccgaggctggtcttaaacgcgtaggctcaagcgatctgcccaccttggccgcccacagtgctataattaaaggcctgagccaccctgccatccctcagctgctttcagttgtaacatttaaacttctgctagcacacacacatcaaagatcagaaaaatgttctttttaatatagaaacatgtttattttatagaaggttctataatgaaccttgaaacatatagaaaatatgtttattttatatatgttaacagttaaattcacttaattctttgctcctctcttcaattgtgtataaacttctggtaaactcatatattgggtttatcgttttagtttttctattttttatttgtaggtatccattttattattttgtaattttttttatataatttcctaactagccacctaatgtttgaacatattaagcatgatagttttaaagtctgtctggtccctccaaaatttaaatatcttatttgtgtgtggatttttttctcttgtccattttatcctctgtttttttaagttgtattcttatctccttgtgtggcttataaattttggttcaagaaaagacattgcatataaatatatagacataatttggggttcatagggatattatcttcctccagagagaatttacttttattcctggcaaaataaaataacaggtacaatttatctcactgtaatgagaggactaaggactgtgtgcttatgaagggctcgtggaacacttaggctgcaacctttatgaggtgttggttattactcatttatttttcctcctgtgttatattttgcctcatgtttttctctaggagggctcagaaatcaaatatatagtacttagtcctttgatactgctgggattctctgttttagcctctcggcaatgattttacaatgaggaaatgctgagggggaaagtgtctcggaggggatgcacatctctgagcttttcttttcccaggcagcttggctggtcaagtctgtgttgccttggtaacattgcagcactttgtaaaatgtttttgtactcgttaaaaaaagaatatttcctgttttaatcatcatccctgaagtagaattgatttgtaataaagtggtccaatatgtcgtatttggaaataccatgtttatcaagagcccatcatttctttttctctttcaagtgctaggacattttcattaatggtttcctctgtcttaagtaataaacacggttctcattaatacacagccttaccggctgttggaattataacataattagatggccttctccactaagcttgaggcagcatctctgtcctttggaaggttcattaaaatattgagaggtaggttccacccctaaagtttcttttgaattcagtaggtctgggttaagacctgagaatttgcatttccaataggttctcaaatgatgctgatgttgctggactggaaaccatggtaatattagattagcatgctgtccttcttcactttagctgaaaaaatttacagataaatttgtgggtttgttttaataaaagtaaaggaagtagtgtgctatcaaaattagactgtgagaatttgccattttttcagttttattatttattatgaacatgttgcaggttatgttgattccttcttataaaacacctgaaatgctccctccttcctattgtcttccaaaaactagggacaaatgtagaaatgtaattattatgatgtagatatatattaaaaactctttctaaagtttatatggaggagcaaaagacccagaaaaaccaacaccatactgaagtagaagagcaaagtcaggaggctcgtattatccaacctcaaatcttactataaagtgacagtaatcaaggtagtgttgtattcagtgagaagacagacaatatctcaatgaaacagaatggaaagccaagaaataaagtcaaacaagtatagttaatctttaaaaaaggaaaaagaatacaacaaaaaaggtgatgttttccacagatggtactggaaaaactggacatccacatgaggaataaaaaaataataatctagacacaaaccttacaccttctacaaacattaactcaaaatggatcatagacttaaatttgaaaggcaaataaaacacctagaggatgacataggagaaaatgtagatgaccttgggtatggtgatgacttctcagatacaacacaaaaaccataatccatgaaagaaataattaatttattggaccccattaaaggtaaaatcatctgctctatgaataatagggtcatgaacatgagaatacaggctacagactggaagaaaatatatgcaaaaggcatctgatgaggaactgttccctgaactacacagagaactcttaaaactcaacaattagaaaggaaacatccaattagaaacaggcaaaatacctgaacaagcacctcatgaaaaaaatacacacacacacatatatatatacatatatatgtatacacacacacacatacacacacaaatggcaaatcagtttcattctgttggggtattttgctagtggggcagctgtgcaagttagggcaagaggtagatgggagctctgtgctttctactcagttttgctgtgaacccaaaaccactttaaaaaagaaattctattgaagaaaaaataacaaactaaaatacattttaaaataataacaaataaattattgctgtgtaatacaagcttcacatatggggcatgttttgtgataatgatacatttaatttaaagtgaacaagcttccaaattatttatcttaaaatgatagatgtttggaagtcctcttgtcatttaatgtatttagggaaattctccttttaattctacttttttctaaaacatcctatttctattatgcctgtaattcccatttttacattttttttttagaaattaagagatacactgtttctttagaattattattttctgtgatactcataggaagaatgtactgaaactgctttatgtctcttcaactgcgtaattattatacccaagtcctggcaatgatggaaaaggaaaggtactttttggcatctgagaccaattgaaaagaactcccttttcctgtttggcatagtaaacgggaaggtgaatgtttgactgagagagcaaacatgtagatatatccctcacagatctgataatcccatttttattaggtatattctcagctcatttccaaagctaaactcagttcaaaatcataaaactgcatacagtgatgatatttctggaagaataatagtacaccacccttaatatttcagcctgcagcaaagtatagaggttggaagagacaacaaactcaaatgtcatagtcttaagagtctcgaacatattcttttttgtgattatgtacaccaccgcattcttttttttctttcttgccaaaacagaggagtcattaatagagaaactgtaagttttatcagactgaattaaaactagaaaccctgacttaattgagaaataatgcttatggggatataatttacaataactaaaatttcatcttattacaatgaccccagaatgacaatctaacaatatttgttagaatacttttttcctatacaacttacaaaactctacattatttgaataagatagtggtagaaaactgttattaatacacattgtatgacattttaaaaacaggatttaataaaatatattgtatatatagaaagttcctaaaacttaggcatacagtttaattatttaaaaaaaatcaaacctccataaacaagctacatgtcaaagagagtctattgttagccattgtgctgcctgctccctacttagtgcacaactgactttctctcctctcacttaactgttatcctgaaaggcttgataataatggtcttgctttgctatactacttttttctttccaaccatgaatgcattccaaatactatagtttatttgaatcaaatcatatatatgtatgactctatattggtttctttcagttaacatgatgttccttgagattcattcatgttgttccatgtaactataatttaataattgtacttactctatactcgtactataacacagcatgttactgtattcatctacataaaatatattggtggcacagtttattgatattttccacatcggcacatagttgggactactaaagagaatgctgctgtgaacactggtacacatacttctctagtgcacttgcatgcactgatgttcagttcacatgagaagtgaggagtccgaggtgggtgaataacttgaggtcaggagtgcaagaccagcctggccaacatggtgaaaccccctctctactaaaaatacaaaaaattagccggacgttatggtgcgtgcctgtaatcccagctactcgggaggctgaagcaggagagtcacttgaactcaggagccggaggttgcagtgagctgagattgtgccactggactccagcctgggtgacagagggagactccttctcaaaaaaagaagtgaggagtcagtctcaccagctgtgttggagcttttccattactacagttactcaccaaaatttatctctttctgtccttttaattgtagcctctttggaagataaacacaggatatacaacagtggttttaaattgcatttctttgatgagcactttggttgaatactttctctaagttgaataagccaaaatctcttttctgaaagcctcattaatgctcttgcccacttttctactggctcgtcttttttagttttagtctattattatcttatttttaaatttctattttttactattaatttaggttactcagtaatataatttattttggataaaattttatatttggcaacattgagaaatttacaaaataattttgtttatttaaaagttttgtgttttctatatataaattcatattatcaatgaaaatcatggacttgtttatcttctaaacctaacatttaatttcttttttttttctcagcacattgagtaaaagtagaaaatcattgattgttagtggtggtagtgtatattcctgtattgttactgatctccaaagaataatttaaataattcaccattaaatacatttttaaaaaatacaaatacccatatttggattataaatttaaaaaattctattttaaagacaatttctatttataatttaaagattctatcatgaatacatgttgaatttcatcattttttcttcgttttttgagtatgtgattttaatccttcatttggttcagattgtgaattatattgatgcttttaaatctcaagttatttatttaattaataaatttagacctcatataaagaatgatttaaatgtaaatttccctttttataaatattcttgtcaggtgctgttcctttagattcattcacattgttcactcattcatgtaaagttatggctggtccataaattaagttgggactgatcacccttttattctattctctggaggaccttacaagaatttagatcatttttaaaaaacaattagtagaaattaaaaagattcactagttcctcaagttttttgttggaatgttttaaattacagattacattactttaataattataggattctatatttaaaacaaatttctttctgcatctattctgacatttgtctaagaattaatatatttcatttcatttatttatttatttattttttgagacagagtctcactctgttgcccagctggattgcagtggtgccatctcagctctctgcaacctccaccttctgggttcaagtgattctcctgcctcagtctcccgagcagctgggattacaagcatctgccaccatgcctggttaatttttgtatttttagaagacacagggtttcaccatgtgggccaggctggtctcgaactcttgacctcaagtgatctacccatcttggctttccaaagttctgggattacaggcatgagccactgcgcctggcctctcatttaaattttaaaagtaacttgcaaaatatcatttataagatttttaaacataattataatatctgtaggatctgatatcatggatattagtaatttatgctgatgcttgccatgagtatttacattattattctctcttaacaattattttttgttttgttgaatacctatttgtattttttttctatttcattagtgcctgcatccaatacttcctttttttttgttttattttggcttttgggtctctccttatctctcatactttctctctttcttcctaaactttttctaaattcttgatctagattcctggattacagatgttgagacttaaaaaaatgcatatatataagatataaaagcccaaggttagcctttgttgaatccctcaagtttgatatttcatatttcattgtattttagttcaaactattttttaacttcattttgttttcttttggggggtggatggattttcgctcttgttgcccagactggagtgcaatggcatgatcttggctcactgcaacctccaccgcccaggttcaagcgattctcctgcctcagcctcccgagtagctgggattacaggcatgtaccaccaagcccaactaattttgtatttttagtagagacgggatttctccatgtaggtcaggctagtctcaaactcctgacctcaggtgatccacccacctcggcctcccaaagtgctgagattacaggtataaaccacctcacctgggcttatttatttatttattttcattaaattatttatttttttgagacagagtttcgctcttgttgcccaggctggagtgcaatggcatgatctcagctcactgcaacctccacctcccaggttcaagtgattctctgtctcggcctcccgagtagctgggattacaggcatttttagtagagatggggtttctccatgttggtcagggtggtctcgaacccccgacctcaggtgatcctcccaccttggcctcccaaagtgctgggattacaggcgtgagccaccacaaccggccttaacttcatttttgatttctcctttgatctgtgaactatgttgcttaattttcaaatcttttggagggggatattctaattttttgtgaatattgctctctcatttcattctatttaggacaccacatgtcatttgaatggcaaaacgcatttaatacgtgctttatcacctaaatataatgatataattattataaaggtgtaatcacttcttgtcatttccagtgcacttgaaaataatttatactcaatttttgttgagtcaagtgtcttaaacataataaattaagcagattgtattaattgaattgttcaaaacctctatggcttgatggatttttaactcttattttatagttattcaatgaattgtgctaaacttgttctacaattatcagtttgttcatttcttttgttgtagttccatccgtttttcattttatatattgtaaaggtatgttatcaggccggtgcagtggctcaaacctgtaatcttaccactttgggaagcaaaggaggatggatcatttgaggtcaggcgtttcagaccagcctggccaacatggtgaaaacccgcctctagtaaaaatataaaaattagccggggttggtggtgggcacctttagtcccggttactcgggaggctgaggcaggagaatcacttgaacccaggaggtggaggttgcagtgagctgagatcacaccactgtactccagcctggatgacagagtgtgactgtctcaaaaacaataataagtaaataaataaataaataataaataaataaaaggtatgttatcagatataaaaaaatctaaacattattatgtctttttgataggtttgacactatcattattaaaagtcctttttatttctagaaataatgtttgccttagatctacgttttctaataccagtattgctaaatcaattgatttttggtctctgtttggtataatttttttattcttttctttacaaattttctgtacttttatgtcttagataaaccttacagagacagaatatagggtttttcttttgcttttgtttttattttatttatttatttatttatttagtgtagtgtaaaaaacttcataagaagcgaggcatgatgggtcattcttgcaatcccagcactttaaaagtcctagacgatcagctcgcttgaggccaggagttcaagaccagcctgggcaacatagcaaaactccgtctctacaaaaattagccagaagtggtggtgtgtgtgcctgtagtcttatcaggaggctggggcaagaggatcacttgagctggggaggtcacgttagagctgcagtgaactgtgacccccacacttcagcctggttgatagtgagatactgtctaaaaaaatatattagtaaaaactttataaggttgcgtttattctatttacctgctatataactaataccttgttttgattacattctaccaccttaccttgtgccttacatttttccgccacatttgtttctttttaatctcctttgcttttgcattgtttatgaaacaaactgtttatttttttctatatgtttattttgaagttttatacatttcactaacgtagttacttttcttttatacttctaataagtgattacctgaaagatcacgacatttgctaaagtttttactttacaacagtggcccagagtattttgtacgcccttgaatgttctttggatacttttcaaggatctagaaggtcaaaactattttcataataaaatgtagatggtatttgcctctttcactctcattcattcataggtataaagttaaagttttccagaagctaaacgatgtgtggtattacaggagagtaaatgtggaaacatatattataaatcgtctgccttctattaaaccaatcattaatgtacacgtttttttttcctgtcttcttgccagttttactatgctctttgctgtctttggttctctgaagacacatgccaaagtgccttggtgtgcttatatttatctagcttttgttttgtttgtcttctgaatctgtgtattgacttctttttatctatttgtgaaaattcttagccatcatctctttcaatatatcttctgttcattccctttcttagctgtgcttgggttgggactcaagtttgaagttttgtatttctcagtgtaacacctttttctcttattctcatatatgttttttccaaacttttgtctctccaatcatcattctagaccttttttactgagccatctttctattcactaattctttctttagctgctttttaatgtgttgttaaacccaactttacgtttcataaatatttatttgtctaatttctaaatggaacattttataatctattatctcagatataccctgatgaaagtttcaattttgtatcttatattcatatacatagcaaacttaattaatgtctgtattagaaaattccaatatctgaaatgcctaaatattcagttctgctgtctattgtttttattcttcatgttattctcctgatgtacttcatgaagttttatttccttatattcttggttatttttattctcttccaagaaacaagtcttatgaaaatatattgacataagtaatgttattgtcatccagaaagaatttccattttctttagtcaggagcctgacagaattccaggatcatcataaaccatttaaagcttggcattttctggatcatctcaatggcttaaatctgagctccagtcctggcaagggcttgatgacttctgccttaactttgtaattaggatgcagacatttctgatcctaagtaaaagcagagcatgtttactaaggcctccacatgtggaagattctggactttaacattttgatccaaacctgtgagactggccaatgtagctgattctctcatgtgacatttccgtgtagaaagcacacctatggcaaaagttgacccgcatttgtattaatgattaacctctctcaattttcatattcctataaatttttcctggttgtcttttaatagcttgtaaaacatctagtgctttaagcatattcttttccagtttcctaaggtaacattagatggtgggttgtctacattctctaatatgcaactactggaagtgtaagctataatatccttttcattttaactcctgtaattattctgacacagtaaatatatattaaactaagtcatagttttctttatgggatggttatctattaagcttcatttaccttttcaaaactgtgttgttatctgatcaactatacctggccatataagcaatacaaaataatcagttattatagctggttcttattatgttattattaaccagtgaagtctctatgtaatgcatatgttagtaacctaaaagattacagaatacattatataattaaaagagcaaggcatcttggttcaaattccaattctaacttatatcaagtttgattcatttgttaagctaatttatttaaatcacaatcccttaatttgttaattcagggactttatagctcataggcttattgtaagacaaactgagataatgagatggtgaataatccaattattttagagagtaaacataattaatggaaagaagatgagatctatgagtagacgacagtaatatttcaaatcttgcatttcaaattcttgcattgttattagtcaactgtcaccacattaatgctgcaaaacaaaccatccccttactagctggaatacaacaataagtatttctttctttctgaaagtaaactgattgtcattagccaccagtttggagctagctgggcttggtccaggtgttaagctgagctctggtctgctggcatgtgttcctatcctgggtatgagtttttcatgataatggcaaaagcacaagatactaagctaactctacttgcgacacattcattaatatcctattgatgatagaaggtctcatgagccaaaaaaagaaaaaaatatctaggaggaggacttaactctgccaaccataaagccaacgtaaattatatgaagtgggaggtatatcctcccgcacagagttgtgatgagaaagaaattgaatgccacatgaatatgttgttagaaatgtcatacttatttgttaagtgtttgtgtatatgtttgactctcaagaaaatcagatcataaaaagaggagtggctcatctcacaaaatctttgtttggaaatcgatctgcctttattaagcactagaggctaaagagttgatttcaatgccatttgatatatgaatacactagcataaattgtattcatctaagatcaatgattaaaaggagggcatttatcattctcccctatcaggcacagaggagaagtggtgtgccgccctagtggtattgccataagatgtctatctgatttgctttctttactcacttcaacattctgtattaaagcacattcccaattaataaaatgtcagtaattggtaaacaagtgcgatgcatcaatgaattctattataaataagtatttttttctgtaagaattgatagagtgggaaatataatccatggcaggttggatggcataaacacttgataaatgctggtagaaacgtataagaaattcttatgagaggtttacattcatttactgaagccaaatctggtttaatgtacttttttgcatcaatcaatttgataattttatgtgagtttttaatactacatgaaaaatacctaaaatatttttaatatttgcatctaaatatttttagatataagatatctaaaataagaagttttgacagttgattgtattccattttcttgcagattgtctacatgggctggtgtgaagcccgggagcaagaccccctccaggacagagtgtactccccgaccttcctggccctgaggggctcatgtctctacaagtttctggcacctccagtacgtgttttattgaaatgtattggtcgtttccatattatcacaagagattgacaccaacttaacagcaccaaatagtataccatcaatatttttaaaaaataatatagagaaaaagtagaaatcagtttatctgatttaacttactaaaatatatattctgacattaaacatttgctttaacacccttgaaaagtctggaacttacttctttataaatagtgaacctataaaataatggatcaaattataatgccattacaaatctcatgacgacatgggaaaggagattttaagaaacattttcaagcatatgtcagtgtattttgtttatggaataaaaattaaagaaatgaatatatcaaaagtgaaataaaaaagaataaactgttttagggctatacatgaatgaacatgtttactaaactcttattttccaaggatcttttgaaagttcttttaaatttattcagcacttttaattactagtaatttattattagcaaagaataataaggaaatttcaaaatgatagcatcttatctagctactattaagtctatctcaccctatggtaatcccataggatgatgttaactctcatggtgttcaacatttaaattagaggattctatccttggcaaacaacacaaatacattctggtaagctatcatttatgacaagtcgaacttgcttatttatgttgtacaggtctctctatataaaatcaataacattttcatcttctattatattctatatcctagttattgagatttgtactagatatgtatagatacctattgcacctcaagtcttgcttttggaaacatgtaccttgcagctcagaagacacttaataaatatttattgaatataaataccaaatgccagaccagtcacttgcaggtctaataatacataagatttagaaatcatcaggtctaacttgctgctgttttaaatgtctgtctctacacaaagtttaaagcactaggaagacagaggaaaaattgatatttatatattttactctattcctactctgaataatttatttgacaagacagttaaatatagtttccaacctaagtaagtgaaataactgcattatgctttgggtatgtttgcaatgtcacagtcatcttggaatttcttaatataaatgatgtatatttaaaaaatatagctgtgttgaggtctggtattctctgtatttaactagtggtaaattaaaaaaaaaatatgagtgtggaatgtaaatacttagtatttataggtagagaatgcgtatattatttaagatatataaggacactgggcaaatgagaactgttgcacataatataaatcatttgctgaaagcataagacaaatggtaacaaagcttggaaaagaggaaacaaaagcattatgtagggtcctttatgagcatggcttcacagatgagagactagatacatctgtgaaagttttttcttatttttcactatattatgcaaatcaaatacagtggtaaataactttctaaaacaaattaaacattattttcttatcttttaaaggtgaccacctgggactggacgagagcagagaaaacattctcagtttatgagattatgtgcaagatcctcaaggtatgatcaatatgtagtcagtatttgaatggcttttcctcagcaaatagtgcctctgggctcataagcagctcatgaaaacaaatcattcatggaatgaaagaagagacacgataaagacaaatgaaagagaaagaaaataaactggacaaaaaagagaaaatatagaatgcacagaagtgcactggcactcagctatctgcttaaataacttgcaagcagactctgcagtcccaccgtgggtgagggaacagggagaagctcctcaggagttcactggggaagaagaaaattcagttgaaagtagtctgaatttaaacgttggttgttaccatgtttttttttttaattctttttttctgaataaaatgcaaaagagaaagatttgggtgagacctggaattagaaaatatagaaaatatcaggaaaaatgcaaagaaaagttttgctgttttgttcttaatctcatggcttgaccatctttttgcatatgtaaaagaacattcgattgtcatatatcagttgaatttcatgccatatgcaggattattacaatatcaagccatcacaaattctataaaatgtcacatggtttctatagcgttttttaaagaattaaaattggaataacctataaaacatgaagactaatatatattcactttctactttagggtttgtaggcttggactcaccacagattgataattaaattcctgcataaggttgaccttgtttctgtatccaaggggagctaatttccctttgctttatgttagctatttctcttcccgttaaagacttagcagagtagaaaaatgctgaaacatttaaaatataataaaatgcatcaaaagtgtctgaaggcagagagacaaaaattataattacctcaaaattgtttatagtttctgttccttatagagaactttggattaaagctgaagttctctgaagtgcaaaatccagccaaaagtatagttcattgattgctcatcactgtgcatgctttgagttcttctgtaggcgtaatggtggaaggacaacctgaaatacttgagtgtattgttagtaaagaagggtctgacaatttcttaaacagaggctagtatctgaggaaaaggagatcatacacgactccagttttctgaaataattgccaaaatggctaatgagatagctttcttttttttggagatggagtcttgctctgttgcttaggctggagtgcagtggtgtgatctcggctcactgcaacctccacctcccaggttcaagcaactctcctgcctcagcctcctgagtagctgggactacaggcacatgccaccatgcccagctaactttttgcattttagtagagacagggtttccccatgttgcccaagctggtcttgaactcctgagctcaggcaatctgcctacctccgcctcccaaagtgttaggattacaggcatgagccaccgcgccagggcgaactgtgtatttttaggaaagctactcatgtaattaggggaagaaaagaaagaaagaaaagaaaagaaggaaaagaaaagaagaaaagaaaaggaaagaaggaaggaaagaaggagggaaggagagagagagagaaagaaggaaagaagaaagaaagagaaagaaagagagacagtaagaaggaaagaagaaagaaagaaagagaaagaaagaaagaaagagagagagagaaagaaggaaggaaggaaggaagaaaaagagaaagaaagaaaagaaagaaagaaagaagaaagaaagaaagagaaaaaagaaagggaggaagggcagggagtgcacagaggggagaaaggaaagaaggaaggagaaggaagggagggagggagggagaaggaaggaaggaaagaaaactgcctcaacaaatcaactttgtctattctctatctgtacactaatacaacttttatcatagtaataacgcaacacatatttatatattcttacttagacttaaattattttctaaccactctccaagtagctgcatgatcttttaaatcctctcttttaaaaaaagctatttaaacattagaacataatgcagtttactatagtagttaaaaaggataattttaaaggaaataataaacattatgtttagctctatcaagatatacaaacaatatgttctatctctttgttacaatttttgacaaagattatgcaattcatgatctgctattttgtgtaaaaatatgtcttgagatttttttctatgacagttaatgttccttaaaaacactgataactttttgatagatttcatctatcccatcatttgcttgtattcattgagtccactttaaaattttacatttagttttttcccccacttgttattgctatcaggcatatcacaacaatcattatttgaatggtttaatagaaaattaaatgtttgctatataccaggtaacctcagcacttgttatgtggctgagaaaaatgcagaaaaagccactgctttcattgagcttgcattttattaggtgatatgatgttaagtaaatcaataaagaagacaaaaatagtaagtaaataaatgagacaaaataataatatgtaggaaggactgatatttgctcagacttttatgcaaattcttatttcctttagtctaaattctgagctttggaaaccccatgtggaaaaatattttaatgtattcaagatattaaatccatgtgtacaaattgcctcctacaagtcatcttaacttatgcggccatcagaagtgtctatgagagtgcctgtatatttacattctgaccaaattaaaatcaaagactacttctcattttaactttctatatacaattttctataagccttagtttacttgaatttttttaatacttcaagttctgggatacatgtgcagaacgtacagttttgttacgtaggtatacatgtaccatggtggtttgctgcacctatccacccatcatctaggttttaggccctgcatgtattaggtatttgtcctaatgatgtctctccccttgcccccaacctcccaacaggccctggtgtgtgatgttctacttgggaaaatgtttacataggttagtgaggcctggcgataagtattctcatacatcaaatacaatgtaaatctaccttcaattgttgtatgtaatcaaggaagtccccctccccttagtaagtacaatgctggtgctttatgctttgtggcttgacattagacatataaagccatccttcaagcattccttttcccaaaggaaaatttcatgtagcatgagaacagaggagtggcttctagattcgatgctaatggattattttcctgcatgcagattaccttctggccttctcctgtgtcaggatcactggttgataaggaagccagtcagataggtggggcaggtgagcaaataagaaggggcatcttctacagcctaaatcagagggggagtcttctacagcccagccctctcctgccatgaggtatcacttctgatgcaagctgtgcaagttgtagacttctgcctccagaaaatggatccctcaggtgaggctaattaaaagtcagatttgaatgtctggatcacagaagaacttgcctgtgaccattaatcaggaaaatcctgtcccttctgatgtgttcataatgaagctacaccagtaataacaaaaatgaagcaataaggtttatctggtacatatagtttatatgtatgtgccaggtgttgtcctaagtgcttagtatatgaattcagtttgtatttacagcaccactatctgtcagttattgttattcccattttagagatttggaaactgaggcaaaaagcagtttaagtaaatagcctaaggtcacacagctagtaaatatcagagctaaagatatgaatcttgcaatgtgtcaaaattctgtgctcttgcacatgatactacactgtctctgtctctcagcgtaaatattgataatttgggaaaaaagatgggaaccagagagccagcctggtactgatgagagagcaaaggtttcagaaaaaggaatttggcaacaaatgccacttctgttactaaaacattaccctttatgagtgtattgggcactatgaacttcagttcttcatctgtgaaatgcagctatggatgcagagggtgctgtgaagattaggaattggttaactgatttgtgaatgcatttttgtctgttaattcatatcagttacttcgagtaccttctatgtgccaagcactccactaggtattaaggataaatacaacagtataagagagttgaactcacaaaaattccagctgatgaaggagtttaggaagggcattttggaggaggcttttaatgaactgaaacctaagtgactgtgaaagggctccacagaggaagatgtgtcatggcaggggttggagtccagccagtaggaggggaggagcaacctggtccaaggaataatgtataaacttgcccagagctacaaagaagtatgtgtcccttcaacaaggcaaacaagtttgttacagctgtagtcatcttgggtatgaggttggtgttggtgtttggatggaacagatcataggaaaaggccttaataaagcacatgaactttatctgaggaacaaaggacagccactaaagcatgtcaagcatagggagggactgaggttgcccatttaaaaatcctcttcgaatgcaacgtgagatggagatgaaggggccagaggggagtgctcctgggacatcttctggtcaaccagggcatggacagcgggctaggaggagagaggcagaggagtcgggcctgaatagatagtgccctcacagtagctactcacctgcatagaccagccttcttgcaccgctctggtttgactcgttttgctctgattctagcctgagctgtaactccctaacacggcactgtagtggtgcatggctggaaaaaagacaacctgcattttcaattacagactaaaatctcaagaaagcctctaattcttcctattgttatgtcatattttcttagcctattctcttgtctaatctactggaacttatattaaacctttttcattcttttttgaaattaatatacacttcccattctcacttttaggagatgatcctacttcctacatgcaaactctctcagcattgcaaatgcctcctggcagccctatcctgacagataactatccttgctcttatctaatactaagcctcccattgggtaacagatctcaaccacacttacataaacagcaattctatcctgatgactccaaatgcatatgttctgcccagatcttgtccccgaactctaagtattcaacagtttatatttctgcctactgacatacctagtagaaatgtccatgttacacgtctcaaaatttaggatcaacaattggagagaatgtaaagcaacatggaagttagagaaaagagaaaaacaaaagcaaaaactagagtttggctatttttttagaaactcatggcaattagctgagatgatactaagttatagcacggagtacattttagcattacagacctctggtgcctgccaacaggggtgtgttgagctgttagggaaactgtcatttattcaactttgggactttaataattaagaaaatgcaaaactaggaatataaaattaggcatgaaagtgaatatatatcaagaatgagaaaaagctcatgatgcagaataaagttggcaaatgccacaaacattgaaaatctatgaaaaataccctatatttgtaattaattcactaagacacttattgagtactttttctcctatatttttggggggctgtgtattctttgatcacctctttgaataaaaaggattttgtaaaccagtgtctatgggaaaaagaagtagaccccctgcatcttgccctcatctctctgggcaccatgatcacctgcctcccagaggatacccaaggcctttagcccagggacagctaccaatggaacttagatctcatcctacagctgaattcaggagtacagttgcaatgatcaggttcttcctagtgagaggaagatcggacgtaactgcatgacttgaagcccaagtgtagtagttgttatgctaacagagcatacatggggaacatagaggagtagtgaaaggaatgtctgtcttcattcataatagatgagcagtgtatcatttgtataaaaatgtactccctatcatttggccaggaaacccttaaaaactagaggatcattttgtttgtagatattcaacaactgcctgtttcagagctagcaatagatttagcaagaacaagtctttggatgacagagattatttttttaaacagtatttttcatgatactgtttttcagcctggtattacaaataagtttacatttttgataaaatatacatagtgagcaatacagtcacactgatattcatctaaaatcatttttagaaaaaaggagaaaacatgcttggcagggttgaatgaggagggtattcagagtgaatgcaggtgggagatggggaaggagaaagagggattgatcaactaagtagatatgttatgcggaaggtgaaataggagccttatttctcactgttagagatgaaagtcataaatacagaaagaaagaagccaagaataaattctgttgtattggattacaattagaaatattggtatgcagcctcagtttgtagtgtgtgtttgtgtgtgtgtgtgtgtgtgcatgcatgtatatgtatgcagctgtaccttactctgtccccaaaatatctggggtcagagagttctcaatagcaaggagcacactcagcaaagctctccatttctcaatattattctccactgcaaaaagccagaactctgtagagaaatgtttgatggctgggttgtggcgtagaaagtcaaagatgaggctaagtcatattactgtgctaggaaataaggaggtgttcagagaatgatggagatagatgaaaagacataaaagcaactttcaagagcatctattgggcaaattcgggacaaattgagcaattctgggataaaataaatgttagcaatggattataactcagcaaataaaataggaaaccattaagtctatcttcataaaaataaagaagtgaaaaatgtgacaagggacaaagaacttacttagtttcaaagtacctcctcagaaataacttactgtaattataaaagaataaaggagaactttacagagcacaaaagtgacagcattgccttaacaaattgatcaaagtgaacacttcattaaagcaacacatcaaaaattatgcatgtctgatagggagacagactataataattagcaaaatagcaggttcatgacattcccactaaagctgggtacaaatgaaatctaactaggaggaaacatctatctaatgtaatgtaaaggagaaaaccaatgtaatctaaccaaatctaatgtgatttaacctattctagtcctgagaaaatctccaacaaacccaagtgagacacatttcatataaaatgaatgtcctattttcttcaatagtgtcaaagtcattaaagttaggaaaagatcaaggcatttttctcactgaaggcaagtagcatcacagaacaaccacatgcagcagaggattctgaactggtgagtcatgaatgaagcccaaggactagaccacatcagagtccttgctttgatgattgcattgtgtttatgtaggtgaatgccctaatgttcttgtttgtagaaggtacacacacactgaagtatgagggtgggaggtaatgaagtatcacattggtagttaacaaacagttcagaaaataagtatttgtaattcacttgcaaatgttctttaaatctgattgtattaaaaattattccatgtcaggagtttctatataaatagaaatgcaaaacaagcaaacaagaaaaagtgaacctgcctcatatagagacaacacagtaaattattatagaaatccctaaaggctaccaggcttgtacaacattctaagacagtgctaaaactgtgctcaaattaagaatagctaagaagaaatactaacaaaaataagtagaataaacaaaggcataaatagaaaaaataactttttaaaattaaaataatggaataattacatcttcaataaataatgtgtcaatttatttataacccttatattttgatatcaaatatatattttcccataccccatatttacttaaatgtgattgaaaagctaaatctaatattattatttcttttatcgcaactgcttgcattttaatagaaaagagatgctccaaattagagtatgtttcttataatatggtttaaaataaaagcaaaataaatcaatatacaaaatatagaaatatataatatacacataaattaaggtataacggaagataatacatgatataagagtatatcgatatcattattaggcaaatgctaaaggtttgggagagaccaaaatatttccagcagactgtaatttatgtgaagaatcattttacgatagaattttatatcaatggcaggtattagtagaaactattgtaagaacgccaaagtaaccacttttttaaaaagttacattttagggaggccatttgtctttatctgttttctgttgctataactgaataccacagtctgagtagttaataaggaacagaggtttaactattagctcatgggtctggagactgtgaagtccaagagcatgatgctagcatgtcgtgaaggtctaccagttgtgtcataacacagagggaagcatcacaaggagagatagcaagcatagtaactcaggtctttttcttctctttataaagctaataaacccatcacggggccccatcctgatgaccttatctaattctaattggctccccaagtccctacctcttatcaacatataaatttggttattaagtttgcaacacatacaattttggagacatattcaaaccatagtaccatcttagtaaaaagaggtgtctctgcattttctgactataattatatccattttcatttttaaagtaatttttcttaaaaaggttgattgctttacattttattaagtaatttaaaattaatatggttatttttttactgtaacactttataattaaattagtataaaagtttagtctcttcctaagctacaagcttctgaaaatatgtttttagtttttcctctgataatagaactttaattccctggtgatttttaaaaaacgttacaggccgtgcacttaggttttagtgttgctgctctgggtgagaactaaggttcagccattcctcgttctgtctatgaacatgccagagagaacacatcagaaggaagtcactgccatccacaaagctaatcccagcaacttcaaatccagcttcctgtcttaaaaatataataatcgtcattgattaaaaacataattttattttttatttttgttatctaataacattttcttggtttattaatattttatcacatatccttttgtgaaagtgactcccataaattccccatctgttatataaagtacttatttcccttttaccaagacatctttcaagtgccaagtattaattaattaattctcatgtttcaaaatttgtttcattgacctatatttgctcttaaaagttcaaagacatcattgtttcatactcttttcttgttttgtttttttttccaaggagaggtttctgattcttttagctagatcttgtctagagatacctatgttcttcatctttcgcacattattattattattattattattattattattattattattttgctttaagttctgggatacatgtgcaaaatgtgcaggtttcttacctaggtatacgtgtaccatggtgatttcctgcacctatcgacctgtcctctaaggtacctcccctgacccttaaaccctcaacaggccctgatgtgtgttgtttcccaccctgtgtccatgtgttctcatagttcaacttccatttgtgagtgagaacatgtcagtgatagtttgctgaggatgatgacttccagttcatccatgtccctgcaaaggacatgatctcatttctttttatggctatgtagtattccatggtgtatatgtaccacattttctttattcagtctgtcattggtgggcatttgggttggttccacgactttgcaattgtaaatagtgctgcagtaaacatacgtgtgcatgtgtctttatagctgaatgatttataatcctttgggcatatacccagtaataagatttaaaagaatctctgggacacattcaaagcagagtgtagaggaaaatttatagcaataaatgcccacaagagaaagcaggaaagatccaaaattgacaccctaacatcacaattaaaagaactagaaaagcgagagcaaacacattcaaaagctagcagaaggcaagaaataactaaaatcagagcagaactgaaggaaatagagatttaaaaaaaaaacccttcaaagaattagtgaatccaggagatggttttttcaaaggatcaacaaaattgatagaccactagctagactaataaagaaaaaagagagaagaatcaaatagacgcaataaaaaatgataaaggggatatcaccactgatcccacagaaatacaaactaccatcagagaatactacaaacaactctatgcaaataaactagaaaatctagaagaaatggataaattcctcgacacatacaccatcccaagactaaaccaggaagaagttgaatctctgaatagaccaataacaggatctgaaattgtggcaataatcaatagcttaccaacgaaaaagagtccaggaccagatggactcacagccgaattctaccagagatacaaggaggaactggtaccattccttctgaaactattccaatcaatagaaaaagagggaatcctccctaactcattttatgaggccagcatcatcctgatacaaaagcctggcagagacacaaccaaaaaagagaattttagactaatatccttgatgaacattgatgcaaaaatcctcaataaaatactggcaaaccaaatccagcagcacatcaaaaagcttatccaccatgatcaagtgggcttcatccctgggatgcaaggctggttcaatataggcaaatcaataaatgtaatccagcatagaaacagaaccaaagacaaaaaccacatgattatctcaatagatgcagaaaaggcctttgacaaaattcaacaacgtttcatgctaaaaactctcaataaattaggtattgatgggatgtatctcaaaataataagagctgtctatgacaaacccacagccaatatcatactgaatgggcaaaaactggaagcattccctttgaaaactggcacaagacagggatgccctctctcaccactcctattcaacatagtgttggaagttctggccagggcgattaagcaggagaaggaaataaagggtattcaattaggaaaagaagaagtcaaattgtccctgtttgcagatgacatgattgtatatctagaaaaccccattgtctcagcccaaaatctcctgaagctgataagcaacttcagcaaagtctcaggatacaaaatcaatatacaaaaatcacaagcattcttatacaccaataatagacaaacagagagccaaatcttgagggaactcccattcacaattgcttcaaagagaataaaatacctaggaatccaacttacaagggatgtgaaggacctcttcaaggagaactacaaaccacttctcaaggaaatgaaagaggatacaaacaaatggaagaacattccatgctcatgggtaggaagaatcaatatcatgaaaatggccatactgcccaaggtaatttatagattcaatgccatcccaatcaagctaccaatgactttcttcaaagaattggaaaaaactactttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaatgacgccacatatctagaactatctgatctttgacaaacctgagaaaaacaagcaatggggaaaggattccctatttaataaatggtgctgggaaaactggctagccatatgtagaaagctgaaactggatcccttccttacaccttatacaaaaattaattccagatggattaaagacttaaatgttagacctaaaaccataaaaaccctagaagaaaacctaggcattaccattcaggacatagacatgggcaaggacttcatgtctaaaaaaccaaaagcaatggcaacaaaagccaaaattgacaaatgggatctaattaaactaaagagcttctgcacagcaaaagaaactaccatctgagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagatatttatgcagccaaaagacacataaaaaaatgctcatcatcactggccatcagagaaatgcaaatcaaaaccacagtaagataccatctcacaccagttagaatggcgatcattaaaaagtcaggaaacaacaggtgctggagaggatgtggagaaataggaacacttttacactggtgatgggactgtaaactagttcaaccattgtggaagttagtgtggtgattcctcagagatctagaactagaaatgccatttgacccagcaatcccattcctaggtatatacccaaaggactataaatcatgctgctataaagacacatgcacacgtatgtttattgcggcactattcacaatagcaaagacttggaaccaagccaaatgtgcaacaatcatagactggattaagaaaatgtggcacatatacaccatggaatattatgcagccataaaaaatgatgagttcatgtcctttgtagggacatggatgaaattggaaatcatcattctcagtaaactatcgcaaggacaaaaaactaaacaccacatgttctcactcacagatgggaattgaacaatgagaacacatggacacaggaaggggaacatcacactctggggactgttgtggggtggggggaggggggagggatagcattaggagatatatctaatgctaaatgacaagttaatgggtgcagcacagcagcatggcacatgtatacatatgtaactaacctgcacattgtgcacatgtaccctaaaacttaaagtataataataataaaaaaaaatgtctggatcaaatggtatttctgatgctagatccttgaggaattgccacattgtgttccaaaatggttgaactaatttacattctcaccaacagtgtaaaagtattcctatttctccacagtctctccaccatctattgtttcttaactttttaataatcaccattctaactagcatgagatggtatctcattgtggttagatttgcatttctgtaatgatcagtgatcttgagtattttttttcacatgtttttggccacataaaagtcttctcttgagaagtgcctgttcatatcctctgcacactttttgatggggttgtttgttttttttcttgtaaatttgtttaagttccttgtaaattctagatattagacctttgtcagatgggtaggttgcaaaagttttctccaattctgtaggtggcctgttcactctgatgatagtttattttgctgtgcagaagctctttagtttaattagatctcatttatcaatcttggcttttgttgcaattgctttttgcatttttgacatgaattcttggcttatccctatgtcctgaatgatattgcctaggttttcttctagggtttttatgattttgggttttacatttaagtgtttaatctatattgagttaatttttgtttaaggtgtaaggaagtagtccagtttcacttttctgcaaatggctcaccagttttcccagcatcatttattaaatagggaatccttttcccatgcttgtttttgtcaggtttgtcgaagatcagacagttatagatgtgtagtattatttctgaagtctctgttctgttccattgcctgttttgataccagtaccatgctgttttggttactgtagccttgtagtatagtttgaagtcaggcagcctgatgcctccaacttcattctttttccttaggattgtcttggctatagagggtctcctttgatttcacatgaaatttgaagtagtttttcctaattttgtgaagaatgtcaatgatagttggatgggaatagcattgaatctataaattaatttgggcattgtggccattttcatgatattgattcttcttatccatgaggatggaatatttttccatttgtttgtgtcctctcttatttccttgagcagtggtttgtagttctccttgatgaggtccttcacatccctgttagctgtatttctaggtattttattctctttgtagccattgtgaatgggagttcattcatgatttggctctctgcttgtctattgttggtgtaaaggaatgcctgtgatttttgcaaatggattttgtatgttgagactttgctgaagttgcttatgagtttaaggaattttttggctgggatgattgggttttctaaatatagaaatatgtcatctgcaaaaagagacaatttgactgcctctcttcctatctgaatacgctttatttctttctcttgcctgattgccctggccagaatttccaatactatgttgaataggagtggtgagagagggcatccttgtctcataccggtattcaaagggaatgcttccagcttttgcccattcaatattatatctgttgtgggtttgtcacaaatagctctgattattttgagatatgttccatcaatacctagtttattgagagtttttaacatgaagtgatgttgaattttatcaaaggccttctctgcatctattgagattatcacgtgttttctgtcattggttctgtcaatgtgatgaacacatttattgatttaggtatgttgaaccagctttgcatcccagggatgaagctgacttgatcatggtgggtaagttttttgatgtgctgctggattcggtttgccagtattttattgaagatttcacatcaatattcatcagggatattagcctgaagttttgtttttttattgtgtctctttccagttttggtattaggattacactggcttcataaaatgagttaaggaggagtccctccttttggattgtttggaatagtttcagaaggaatggtaccagctcctttttgtacctctggtagaattcagctgtgaatttccctggtcctgggctttttttggttggtaggctattaattactgcctcaatttcagaacttgttattggtctattcagggattagacttttcctgatttagtcttgggagggtgtatgtgtccaggaatttatttatttttctagattttctagtttatttgtgtagaggtatttatagtattctctgatggtagtttgtatttctctggggtcagtagtgatatcccctttaacctttttttgttgtgtttatttgattctactctcttttcttcttagtttagctagcagtctatctattttgttttttcaaaaaaccagcacctggatttattgatttttggagggattttgtgtctctatctccttcaattctgctctgacctgagttatttcttgtcttctgctaactattgaattagtttgctcttgcctctctagctcttttaattgtgatgttagggtgtagatttgagatctttctagctttctgatgtgggcatttagtgctataagtttccctctaaacactggtttagctatgtcccagagattcttgtacattgcacctttgttctcatttgttttgaagaacttcttgatttctgctttaatttcattatttaaccaggagtcattaagtagcagtttgttcagtttccatgtaattgtgtgtgtttgagtgagtttcttaatcctgagttctaattttattgcagtatggtctaagagactgtttgttatgatttcagttcttttgcattttctcatgagtgtcttacttccacttatgtggttgattttataataaatgccaagtggcattcagaataatgtattttctgctgatttggggtggagagttctgtagatgtctattaggtccacttgatctagagctgagttcaagtcctgaatatccttgttaattttctctcattcatctttctaatattgacaactgggtgttaaagtctcctattattatgtggcagtctaagtttctttgtaggtctctaagaacttgatttatgaatctggatgctcctctattgggtgcatatatatttaggatagttagctcttcttgttgcattgatccctttatcattatgtaatgctcttctttgtctttttaaatctttgttggtttaaagtctgttttttcagagactaggattgcaacccctacttttttttttccatctccttggtaaattttcttccatccctttattctgagcctatgtgtgtctttgcacatgagatggttctcctgaatacagcacactgatgggtcttgactctttatccaatttgccaatctgtgtcttttaattggggcattttgcccagttacatttaaggttggtattattatatgtgaatttgatcctgtcatcatgatgttatctgattattttggccattagttgatgcagtttcttcatagtgtcattggtctttatattttggtgtgtttttgcagtggctggtacccgtttttcctttccatattttgtgcttcttttgggagctcttgtgaggcaggcctggtggtaacgaaatctctcagcatttgcttgtctagaaaggattttatttctcctttgtttatgaagcttagtttgactggatatgtaacaatgttgaatattggttcccaatctcttatggcttgtagaatttctgctgagagatccactgttagtctgatgggcttccttttgtaagtgacctggcctttctctctggctgcccttagcagtttttccttcatttcaaccttggaaaatctaatgattatgtgtcttggggtatatcttctcatagagtatcttagtgttgttctctgcatttcctgaatttgcatggtggcctttcttgctagattggggaagttctcctggatattatcttgaagtgtgtttttcagcttgtttccattctccctgtctccttcaggtactccaggtttggactttttatgaagtcccatatttctcagaggctttgttcattccttttcattcatttttctctggttttttctgtatggcttatttcagcaaggtggtctccaaacaatgatatcctttcttccatttggttgacttggctattgatgcttgtgtatgcttcacaaagttctcgtgctgtgttacgcagcaccatcagttcatttgtgtgtatgttcttctctaaactggttactctagttaacagttcctctaaccttttatcaaggtttttagcttctttgcattgtgttaaaacatgctcctttagctcaacataccgtttctgattcttttagttttttcttatctagtgacacctatttattatctttctcacactattgtttttaaataatgtcatttgcactccattttttttgacaggtgtgagtaaagcatagttttctcaaaatatttttaaataatttcatattattctgtaatttatcttataattctcaaaatgtttgtttattcttttgtttaaaaagttatattctcactattttttaaagatatttctaaaacaatgcaagattattatttaggtcaaataagtatttatcagcaatgtgatttggtaatagaaagattcagtcactttatctcattaagaatttaatatgtacacaaaagctatctaattctgttttccaatatttggagtgaaaaaaattcacacatatacaaaataaaccaacatcttatatttatctctctcaaaatatatttttggggtattatttcctcattaaagtgagtctaaaagcaatatatttatgaatgattatggatttccatgttgcagaaatttgttcccctttaagctgagtcagaagataatccaaatatactgaaaataagcactggaaaagcatagctgttttaaatcctaacattttaatttactgtagtaattttaataaaaatgtgagagtacatctatattaggaaaatctacctatcatatgcaaataaatctttatgaattgtgaataaatcgaatgcttaaaaatattatgtttaataatgacatcttccataataatatctggttagtaaaattttatatggacacccataacataacatatccttaatgtaagaaaaaagctagaaaatgggttttgttgcacaaataatttggtgccaatctcaaggattcatcccttagaatgagaattacttttaatgctctatttagcttaaattccttcaggtctatttcaggtttttccataacctttctagacttaatttgtttagatttctgtttacagaaatgttctgccttgcaaatttacatagtatatgattgtaaaactgtttgaccttccaaaaccttatattactgttttaaaagtaaaaatataattttaatgtcagaagaagcccagatgtcatctccttctgaagccttcatccactaagaaatattatggaaaagttttccagtggccttcaaattgatttagaatatatttttaatgatacagtggcatagatagtttgcagtgccagttttcaatacatcatttcactactaatgaaattaacaatattttaactgtcatgcattattttattaacaataataatattgttcttaatgagaacacatgaacaaagggaggggaacaacatacaccagggcgtgtggggagaggagggcaaggggagggaatttagtggactgatcaataggtgcagcaaaccaccatgtcacatgtatacctatgtaacaaacctgcactttctgcacatgtatcccggaacttaaagtaaaatttagaaaaaaagaaagaaaagaaaagaataataataatagtgttcttgctatttgtgctattttttttttagaataatatcaaaatctattattaacattgtttcttatggaaactcagcagcatatatcaaacattctctacctcctgttacttaacctttgcatattttaaataattgaattgatatgttctattgctcaacattcatttttagtaaaagtagagaaagtgaagattacagatatgctcagcagtaactgctgaaatccataagcacccaacttttctggaccaagttgctctgtgttcttactatatccagacaagtcctatttctggaaaatgtggttggacagggctgtaatgtttacaagtgtgtcaacatatttatattgtttgaaatggatttggagcaagtcaagtttttgaatatttaaggaacatatctacttgatttactaaccgtaagttatacaatttcatttttatttgtttttgcccttccagcttggggactttaaaattttgtccatacatgattgaaggaatgttcagccaaactttatctgaaatatttcctattaactcatatttatgtaaataataaaattagaagcatgcaaaatttacctttgggattatatcccataactggctcttgtcaaaattgacgttgttcataattttttgtaaaactattgagaaaattttttatagtgttccaattcattgtgatgaagagtagttgagagagaaataatgcactcctgtggtatgttttcttttccaaggatatatctaaagatatagataaataaacacatacatacacaactatatgtgtatatgtgtgttttatcattgtgtcttggaggtattggttaaaatggtttttaaataatagctacatttttgatagtttttaaatcaaaacatggaataatattcaattttgctgtagtattattacaatataatctattaactgtttgcactggataacagcctgtgggcttcatagaaactaagacaagttttctgactttattcatggctaccatttatttctggaaataatcttatttttgtttctgtaaatgcatttatacttcagttattcattatgtactaagtattacttagttgttgtatgtctaattaacatggattactgaattagttggtcaagagaaagagtagtgatgtgttaatagaatgaactagcctgatgttacctgaacttgaattctggcccaattaatatcaacaatatctcaatggtatattatcttaagtatcttcagaatccttacctttaaatcaggaattataattatagccacattatggggttactattatcaataagtctgtttaaactagtcactttgtaagcattcaatacatgttagtgatttctgactctaaattgcttgtggaataaatgctacccttgaagtgatatcagtcatgctaacaatggcaattcccttattttttatccagtgtcattctcactttttctgaataatataactttctggcaattctgaagacttagatttattttaccttagtccaaataggcattagaataagttgtcctcccaggcttggaatcagggaactgtcttctgagcaagtgcttgcttgacactaagaggatggatttatttctctggtggtgagatgacatttgatcatatttgtaacttttgaagattgcttttctctgggcatggtatgaactcaattacaactacatacagtatgtaaaggaaattgagagagggtcaagatcagaaataaggctactactcagtggtaggtaatatgcagaaacctgtatttgggcaaggggaccttacctggcctcccttgggccttctgttgcatggaatcaagagcagaaatggacatatagccttggcctgttaacccttagagttctcctctttctccactgccctcagtcaccagaagtcttctgaggatactaattgactccatcatgtacaattcctaaaacttgctgaatcatctgcttatgttgtatgtcagtgggagaaagaggccagtcatgcagtgcagatagcttcttcaaaaaggatagtgtatgtgacaggcaattttattgtaaaaacttgcttaataaaacaattcaaacagaatgaataagatagtattatatagtattatcctttgtccacattctcacactgaatttgcaaatcctgtcaggactgtttgttcagtacactctttatgggcttcagcctcttgacttaggggcatatagctgatgaagctgtagttggtcgataccaattatgtgaatgggatcaaaacaccaagaatgcaattttcaatttttctcattggactttaagtgttgttcttagtaggcatcattttcagattctttttctgcttggagaggttttaagcttgcacacattgaaatgtatgagagcaaagtgctacaaactagagcacagttacaaaatggtagtggctctgtctaccatttctaccaacacccttcggaggcagtctatctctattgttttccattgtttaccagcccctaatctgaccaatggtcctcaagcgcaacatcctagggctctggtgacgtggaagcattgggctgcggccctggaatgagaataaaggtgagaccagatccaggtatgtgctcgcagctccaaccagcttaaagacttgcagacagtaaatgacccgcaggtaagcagccttcccatctgcattgggaatccatcccaatgactctgagaacaggtgtttattcgctacagtaatgtgaaaacacaatgtaaataaaactaaacaaatacttaaatttcgtttggtttatcttctcccttatacttttgttttaggagaaatgctttcaagtaaaaaaaagtcatactcatctcaacaaaagattaaatgccatagaaaatatttactaattgatctgataatttttgaactaatataataaattatagacattaaaattttatcaaatttgagtgcagaaataataacctattttggccagaataccaatttgctttgtatttacataagattggaattatgcaggttacatgcttatgtttttttgatgttgaaatattaactaatacattgaacattatagaggatatagtttttttttaaatgtcatttatggaagagaattacatacaaaaggagagagggatgtgttttattacatatataaataatggctctgagatacaccatgctcaatcattttcataatccatttttccagtaatgttaagtaaataaaaacatatttcattagggtatatgtacacatcgcataattttatatagtttaaaactattcattgttatttgtagttcttatacataatacataacctgtttactatttaactgaaatgtgtaaaactgacaacaatgctatttttggattgtgagaagaaatttatttttgaagtattttttgagtgttgtactattttgtaaaacaacgagagaggaggaccgaaagcctcagaatgagccagcaatgctaagaattctttgtcaaaactcactttttaggaattcccaacctatttccaactgccttgcattaaatgccatttatatgccaatgattctaaatttattcagagctctcccttgcatttcaaacaaatacttttagtgccttctggatgattccatgtggatgcctaatgaatacctcaaatacaaccaacacaacatgtcctctgactctgcagacacacacctcagtcaagagatgttctgacttttcagttgctcttgcccaagaccttggagtcactcctgaaatgttttatcatgacccatatctgacacatcagcaaaacatatctggaaccactgttgtgacactggtgttagaaacaaatgcttgttccttggtaccaaaaagaagaaatagcacttgaacataaatttaattttctcggcaagacaatctttacttctatagaagggtgtgacttgcagatggagtaaaggtgagggcacacatggacagggagggtaaggggttcttattcctgatgtaggtagtccctactgctgtgtcattcccctattggctagggttggaccccacagtgtaagctaattcttattggctattttaaagagagcagggatacaagctggagtggcggggtgggtagtttggtgggaagggcagttacagaacaggtgactcaggatgattcaggtcagagcaggtgaccagaggtgactcaggtcaaagcaggtgaccaggggaacagatgtgaactactgattagagctggtgggaaagttgtgaaactagaagcaaggggtcaaagaggacaaggaagttaaactttaaaatagagaatcaaagaataagagagctgaacatactgacacactgattccttgaagagaaacttggagttcactatatctaacactggttatcctcagccctcaactgtgtcagtctcacatttcccacctggttcccactttgacctttgcctcctatcagtttccagtttgactccaagtaaaatacaaagttctcagggccctctgtaagatctgtcccccaacaccctcaggcatgccctatctgctctagtcttttgctacccacccaataactcagaccaattccactgttctgtttaggcatacacaagcctgaggtcctttgaatttgttgccttcctctccaaatagcttaaatagtttactcttttacttcacgcctattttcaaatgtcacctcctgaagatcatttttcctattatgctttataaatggcaatgccccaaaggatagtactccctactgcatttaaccagttttatcattgcctgacatattatgattaagcattttcttatttgctttatggtttgtcttggtcccactcaaaccaaagctccacgagggagagatgtcatctgttttgcttagtgctatgtccccacactggaacagcgcctggcacacagcaggcttgcaatccattttttggttgaatgcctactatggatatttctgtagcccccaaataaaacactttctgaaatagtagtgagtagtgagaactttgcttgaaaatatttccccgttgaaagttatttgtatttgcttaaaagaaagaaataactataggcatgtatggggtgggggtaaggggaagacagtatctaatgggactgggatggaatgaacattctttagtcctgagtcattctttagaagaggactcagaagccaggccaaagatgatatcatccatattaatgagcactaattgaacagtttggccaaaaacttcccctttatctgacaaaatgtgcaggactaattgaacacattttatgagaggttttgctgccagataccatttcccacaaagatctgcaatttttacatctccctaggcaagatactaatacagtatactagggtatataaataggagagcaatttcaagtgacacaagtattccctttatatcccatggtggccagatccatatgagtccattctgctactttatggcttttactacttgagggatttaggaaaagtggaataagttgcagtggagggacactaagataattaaatagctaaaacgtagcacctgtgaggaaggtccagtcatttgcttcatttgattttataaagagaaagctgaaaggtgatttcataattgtcctcaaggatataaaaggttacttttcaaaaagtggtgaccacctgtttttaatcacaattgaagaaagattaggaaaaaaattggtataagctgctatgtgaggataaagttttcaaaaaggaagactggaacattgaagaacagattctacatacaaattattaaagattaagaactgtaatttcattcttagtagacatttaagtgtgggtttgtttgaattattttttggaggcagggccaaatgaccaaccataattcctactgtttgtgaccctctgatatccccacttacataaacaagtagtatttccccctcactggatagctatttctctggaaaaccacatgctctctgcctgtgtgttttctaaacatgaatttgagaacgttttttattatgatacaattagtctcagagatagaatattagagttcaaatctggaagatgaatcttagaactattaatcctggtttggattaatctcactaagcaattttgaaagtaatctattcaacaatattacaagaaattaattttgttttgtgtgtctcttgtttgtttgcttttctggttctaggaatgctaatttatggtagtaaagcttctttctgtttcaataataatgtcttagggaaaattctgtctgatgtcaatcaaaaaaataatgaaaactgatttaagtatattaaattaaaaattcaagaatgcaaataaaatacaatgataaaaagggttttaatgataattacattctacatatgatctatccatattttaagaaattatcatataaaaaagtattttccctttgaagttgcacaacatttttctttttttttgtttttgtttttgttttttttttctttttttttattatactttatcttttagggtacatgtgctcattgtacaggttagttacatatgtatatatgtgccatgctggtgcgctgcacccactaactcgtcatctaccattaggcgtatctcccaatgctatccctcccccctccccccaccccaccacagtccccagagtgtgatattccccttcctgtgtccatgtgatctcattgttcaattttccatatgtgctacttacctttactcaaattcacctttttcttacttaaaaaaaaaatagagcttcacttctccaagcccagtggaaagctaaatctaagacttattaagttagtgaaggaaattaagccatgacgtgtagatagatttaacaaataaatcagtaaggatgctataaacaaaggggcatgttagaagaacaagagcatggttgtggtcaatgtattctctgcttatgacaaacataggaaaataaccttgcttttcctccaagagattggttaatgtatttgtttctgaatgaggtaaatgctagtgacatgagagacgctgctagaaagaactatgccatttaaactaccagtcctccagggtaataatggtgtccaggagtttatccattatctaccttatataagcccctttgcctccatagatttccaagcctaaaattgctaatctttgaatatgttttctaactctgataatacaaaaaactgtggatggtggttatattttttaaaaaacatattttacctgtaaatttcagaatctctgagttttcaatatttgaacttgtttgtcatttggtcttttcaaaccttaattttttcaaaggcagagtggaaaatgaaataatttccataaaaacatttcataatataaatcatattcttcaaatagaaaatattattattaacaggaacaataaatacatatctatagagatcagtatttgtatttatacagctattttaagctgtcactgaattcagacacttttgtgggcacacacacacacatacagcacatgatctctagagaatggaggaagagtcagatttatctatgtagtacacaattctggtgagcatgttttcatttcagtgttaatactgttagctaattgtgttaaagatgaagtcttcttttctctgccttatatatattgtattctaccatgcaatatcacactgtgttatagagacatgtgtgtgtgtgtgttcttgggtgcacgggtaccaaacatgtacgggattcagtgttagttagatatgctctagttttgtagtagtagtctatttcaattatggtaaatgttacaattattagtcacattatgagatattagaaatattatggactacttaatatgttcaagtcactttttctaagtgatatacatcaatcaattcttttaatattcacaggaacttaaggcaggtactatcaggcagtatcatctcctgttgaaaatgcctacactaattcttaacgagataaaaggagtggtcaaaattgccttcaaacttaagctgaatgtctccaaaactaatgtttataatttttaggccaagtattaatagcttctaaagcgggaaacttatcaatgtgtttgagacctatttccctcattagataaattaaattatagccaactttggtggattactataaagattaaactagagacagtatttgaagaatatgtcaatttatattagggattctttcctaagaagaaggaggaaatttaaacttgtattctcctttctttttctcaggtaaagcaactaaaactcagaaataaagaattaatttgtatatatgaatatttatttggttttaaaaataatttttaaaatatcccaaatgtaatgttttatttacaattatttaaaaatttatttaaaattaataattgtaaaaataagttactttttttcagtggttgaaaatgttttcaggtataaagtagttttatgcaatcaaagttgtcagcttgaaacagacaattataagtaatagaaatagactatgaaatagactattgtaagctttctggtaaccaaatagcaaaaattgcatgacctgcacaaaataaacatgaagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcagtggcgggcgcctgtagtcccagctgctcgggaggctgaggcaggagaatggcgtgaacccgggaagcggagcttgcagtgagccgagattgcgccactgcagtccgcagtccggcctgggcgacagagcgagactccgtctcaaaaaaaaaaaataaaataaacatgaaaacaattcaaaacatatgactatagaaaaccatgaaaccacaaagaaagacagcgagagatgaaaaatgaaaaaaaaatgaaataaacaaacaaaaaatcgcagaaaacaactaagtagcagtagtaaatccttaactatcaatactaatcttgagtagaaatgaattaaattctccaataaatgaatgaatggataaaaacaaaacctgactatatgctgattaaaatacatgtacctcccttttaaggacacacatggaagaaatcgaaaaagacatttcatgcaaatagaaattaaacagaatcagaggtagcaatacttgtattaaacaaagcagatgctgaatcaaaaactataaaaggagacaaggagcaacattatgtagtgataaagggatacgttctttttttattattataatttaagttttagggtacatgtgcacaacgtgcacgtttgttacatatgtatacatgtgccatgttggtgtgctgcacccgttaactcgtcattaagcattaggtatatcttgtaatgctatccctcccccctcgccccaccccacaacagtccatggtgtgtgatgttcctcttcctgtgtccatgtgttctcattgttcaattcccacccgggagtgagaacatacagtgtttggttttttgtccttgcgatattttgctgatattttacagtcccaccaatggtgtaaaagtgttcctatttctccacatcctctccagcacctgttgtttcctgactttttaatgatcgccattctcactggtgttagatggtatctcattgtggttttaatttgcatttctctgatggccaatgatgatgagcattttttcatgcgttttttggctgcataaatgtcttcttttgggaagtgtctgtccatatccttcacccactttttgatggggttgtttgtttttttcttgtaaatttgtttgagttcattgaagattctgtatattagccctttgtcagatgagtagattgcaaaaattttctcccattctctaggttgcctgttcactctgatggtagtttcttttgctgtgcagaagctctttagtttaattagatcccatttgtcaattttggcttttgttgccattgcttttggtattttagacatgaagtcctcgcccatgcctatgtcctgaatggtattgcctaggttttcttctagggtttttatggttttaggtctaacatttaagtctttaatccatcttgaattaattcttgtataaggtgtaaggaagggatccagattcagctttccacatatggctagccagttttcccagcaccatttattaaatagggaatcctttccccattgcttgtttttgtcaggtttgtcaaagatcagataattgtagatatgcggcattatttctgagggctctgttctgttccattggtctctatctctgttttggtaccagtaccatgctgttttggttactgtagccttgtagtatagtatgaagtcaggtagcgtgatgcctccagctttgttcttttggcttaggattgacttggcaatgcgggctattttttggttccatatgaactttaaagtagttttttccaattctgtgaagaaagtcattggtagcttgatggggatggcattgaatctataaattaccttggacagtatggccattttcacgatattgattcttcctacccatgagcatggaatgttctcccatttgtttgtatcctcttgtatttcattgagcagtggtttgtagttctccttgactaggtccttcacatcccttgtaaattggattcctaggtattttattctctttgaagcaattgtgaatgggaattcacttatgatttggctctctgtttgtctgttattggtgtataagaatgtttgtgaacattgattttgtatcctgagactttgctgaagttgcttatcagcttaaggagattttgggctgagacaatggggttttctagatatacaatcctgtagtctgcaaacagggacaacttgacttcctcttttcctaattgaatagcctttattttcttctcctgcctgattgccctggccagaacttccaacactatgttgaataggagtggtgagagagtgcatccctctcttgtccccattttcaaagggaatgcttgaagtttttgcccattcagtatattggctgtgggtttgtcatagatagctcttatttttttgagatacatcccatcaatacctagtttattgagagtttttagcatgaagcgttgttgaattttgtcaaaggccttttctgcatctattgagataatcatgtggtttttgtctttggttctgtttatatgctggattaaatttattgatttgcatatgttgaaccagccttgcatcccggggatgaagcccacttgatcatggtagataagctgtttgatgtgctgctggattcgttttgccagtattttactgaggatttttgcattgatgttcatcaaggatattggtctaaaattctcttttttcgttgtgtctctgccaggctttggtatcaggatgatgctggcctcataaaatgagttagggaggattccctctttttctattgattcggatagtttcagaaggaatggtaccagctcctctttgtacctctggtagaatacggctgtgaatccatttggtcctggacattttttggttggtaagctattgattattgcgtcaatttcagagcctgttattggtctattcagagattcaacttcttcctggtttagtcttgggaggatgtatgtgtcgaggaatttatccatttcttctagattttctgatttatttgcatagagatgtttgtagtattctctgatggtagtttgtatttctgtgggatcggtggtgatatcccctttatcattttttattgcgtctatttgattcttctcttttttcttctttattagtcttgctagcagtctatcaattttgttgatcttttcaaaaaaccggctcctggattcattaatttttgaaggtttttttgtgtctctatttccttcagttctgctctgatcttagttatttattgccttctgctagcttttgaatgtgtttgctcttgcttctctagttcttttaattgtgatgttagggtgtcaattttggatctttcctgctttctcttgtgggcatttagtgctataaaattccctctacacactggtttgaatgtgtcccagagtttctggtatgttgtgtctttgttctcgttgctttcaaagaacatctttatttctcccttcctttcattatttacccagtagtcattcaggagcaggttgttcattttccatgtagttgtgtggttttgagtgagtttcttaatcctgagttctagtttgattgcactgtggtctgagagacagtttgttatcatttctggtcttttgcatttgctaaggagtgttttacttccaactatgtggtcaattttggagtaggtgtggtgtggtgctgaaaagaatgtatattctgttgatttggtgtggcaagttctgcagatgtctattaggtctgcttggtgcagatctgagttcaattcctgggtatccttgttaactttctgtctcgttgatctgcctaatgttgacagtggggtgttaaagtctcccgttattattgtgtgggagtctaagtctctttgtaggtcactcaggacttgctttatgaatctgggtgctcctgtattgggtgcatatatatttaggatagttagctcttcttgttgaattgaaccttttaccattatgtaacggccttctttgtctcttttgatctttgttggtttaaagtttgttttatcagagactaggattgcaacccctgcctttttttgttttccatttgcttggtagatctccctccatccctttattttgagcctatgtgtgtctctgcacgtgagatgggtttcctgaatacagcacattggtgggtcttgactctttatccaatttgccagtctgtgtctttcaattggagcatttagcccatttacatttaaggttaatattgttatgtgtgtatttgatcctgtcattatgatgttagctggttattttgctcgttagttgatgcagtttcttcctagccttgatggtctttacaatttggcatatttttgcagtggctggtaccggttgttcctttccttgtttagtgcttccttcaagagctcttttagtgcaggcctggtggtgacaaagtctctcagcatttgtttgtctgtaaagtattttatttatccttcagttatgaagcttagtttggctggatatgaaattctgggttgaaaattcttttctttaagaatgttgaatattggtccccactctcttctggcttgtagagtttctgccgagagatcagctgttagtctgatgggcttccctttgtgggtaacccaacctttctctctggctgcccttaacattttttccttcatttcaactttggtgaatctgaaaattgtgtgtcttggagttgctcttcttaaggagtatctttgttacattctctgtatttcctgaatttgaatgttggcctgccttgctagattggggaagttctcctggataatatcctggagagtgttttccaacttggttccattctccctgtcactttcaggaacaccaatcagatgtagatttggtcttttcacatagtcccatgtttcttggaggctttgttcatttctttttattcttttttctctaaacttctcttctcacttcatttcattcatttcatcttccatcactgataccctttcttccagttgatctcatcagctactgaggcttctgcatttgtcacgtagctctcatgccttggttttcagctccatcaggttctttaaggacttctctgcattggttcttctagttatccatttgtctaattttttttcaaagcttttaacttctttgcctttgttttgaatttcctcctgtagctcggagtagtttgatcatttgaagccttcttctctcaactcgtcaaagtcattctccatccaactttgttccactgctggtgaggagctgcattcctttggaggaggagaggcgctctgatttttagggtttccagtttttctgctctattttttttcccatctttgtggttttatctacctttggtctttgatgatggtgacatacagatgggtttttggtgtggatgtcctttctatttgttagttttccttccagcagacaggacccttagctgcaggtctgttggagtttgctggaggtccactccagaccctgtttgcctgggtttcagcagcggtggctgcagaacagcggacattagtgaaccgcaaatgctgctgcctgatcgttcctctggaagttttgtctcagaggagtacctggccatgtgaggtatcggtccaaccctactggggggtgcctcccagttaggctacttgggggtcagggacccacttgaggaggcagtctgcccgttctcagatctcaagctgcattctgggagaacaactactctcttcaaagctgtcagagagggacatttaagtctgcagaggttactgctgtctttttgtttgtttgtgccctgcccccagaggcggagcctacagaggcaggcaggcctccttgagctgtggtaggctccacccagttccagcttcctggccacttcatttacctaatcaaactaacccggcaatggtggtgcccctccccaagccttgctgccaccttgcagattgatctcggactgctgtgttagcaatgagcaagactccgtgggcataggaccctctgagccaggtgcaggatataatctcctgatgtgccctttttttaagcccattggaaaagcgcagtattagggtgggagtgacccaattttccaggtgccgtctgtcacccctttctttgactaggaaagggaattccctgaccccttgcacttcccgggtgaggtgatgcctcgccctgcttcggcttgtgcacagtgcagggcacccactgtcctgcacctactatctggcactccccagtgagatgaacctggtacctcagttggaaatgcagaaatcacccgtcttctgcatcactcactctgggagctgtagaccggagctgttcctattcggcaatcttggctcctcccccgggataagttctttaagagtgtgtaacaattgtaaatatataaatgcacccaacagtaggacacctaaatatataaagccaatattaaaggacctgaaaagagaaatgaattgcaatataacaattatagaggcttcaatattggacagatcacccagacagaaaattaataaggaaatactggatttgaacaatgcgttagaccaaatgaacctcataacatttgtagaaccttccacttaacagcaacagaatacacattctgctcaagcacatatgggacattctctaggataaatcatttaagccacaagacaagtctcagcaaatttatgaagattaaaatcacatcaagtactttttcaacctcaataatatgaaactagaaatcaataacagtaaggattttataaattcacaaatatatgaatattaaacaacatgctcctgaacaaccaatgggtcaatgataaaattgaaagatacatttaaaaatttcttaagacaaatgaaaatgaaaacataacataccaaaacctatgggatacagaaaagcaaatcttatagggaagtttatatcaacaaccacctacattagaaaaggagaaagatttcatataagcaacctaatgttacacctcaagaaattagaaaagcaagaggaaacagtccaaaattattagaaggaagaaaataataaagaacataaataaacaaattagagactagaaaagaaagaccaaggaaatgaagtttttttttttgaaaaaatgtatcatattcacaacctttagctaaactaagaaaaaagataagagactcaaataaataaaaccagggattaaaaatgaaatattacatctgataccacagaaatacaaaggatcataaacaaatttatgaaaaagtatatgccaaaaaattggataacctagaagaaatgaatacattctgggacacatacaacctactaagagtaaatgctgaaaaaataaaaatgtgaagagaacaataatgagtgaggagactgaattagtaataagaagtctcccatcagagaaaatcccaaggcctgatggcctcactgttgaattctatcaaacattttaaaaagaactgatgccaattttctaccaattactccaaataattcatgagggaacacttccaaactctttttatgaggataacattaccctgataccaaaggcaaagacatcataagaaaagaaaattataggccaacacactttataaacataactgtgaaaatcctcaacataatactagccaaccaaattcaacaacacattaaaataatcatttaccatgatcaagtgggatttatccctggaatgcaaagatggttcaacatttgcaaattaataaatgggatacgccacattaatgaaatgaaggacaaatatcatataattattttataaaacacaaagcatttgacaaaattcaacattcttttataattaaaaaaaaaaaactcccaacagattagttataaaagaaatgtacttcaacacaataaaggccatatatgacaagccaaaagtcaacattattctcaacaaggaaaagttaaaagcatttcctgtaagacctgaaacaagacaagaatgcccactatcaccactcgtattcattatagtgttgaaggtccaagccagagaaattaggcaagaggaagaaataaatggcataaagactgaaaaagaaaatgctaaattgtccctgtttgcaggtgatatgatcttatatgtaaaaaaaaacccaagatccccccactcacacacacacacaaaaaaaaccgttaaaaatagaaacaaatttaggaaagttacaggatacaatatcaacacaaaaattagtagtgtttctttacattaacaaccaatgttttaaaaaaatcaaacaataccgtttataatagatacacaaaatgcttagcaatagactgtttctgacagtcaagtatagtttatttactgagtagataagccaaaatattaataattattcctaaatgaaggaattatgagtgacttttaatttttgtctgttttttatttcttatttatttatttatttatacttaggaagtaccagtgtatatttcttacatgcatatattgtgtagtggtgaagtgtgagcttctagtgcgcctattacccaaataggtaaatttttaatctttacccatattccaccctcttactctttgaagtcttcaatgtctattattccattctatatgtccaggcttacccattgtttacttcccattataagtaaggatctacagtatttgactttctatttctgagttatttcatttaggataacggcctccagttccatcaatattgctgcaaaagacataattgtattctttttaatggatgagtagtattgaattatatatacatatatgtatatatataatttttattattcatcacataggttgattccatatgtttgctattttgaatagtgctgtgataaacatatgagtgcaggtcatgttttgataaaatgatttcttttcctttggatatatacccagtagtggaattgctagattgaatagtagttctatttttatttctttgaggaatctccatattgttttccataaagtttgtaccaatttacatttccaccaacagtgtataagcatttccttttctctatatcttcaccaaatctgttattttatgacattttagtaatagccattctgactgggataagatggtatctcactgtggcttaaatttgaatttatcttatgattggtgatgttgagcattttttcaaatgtctgatggtcacttgtatgttttcttttgacaaaatgtctgttcatgtcctttgcccactttttaatggggttatttgttttcttcttgttgagttgtctgagttcctcatagattctggatattagccctctcttagttgcatggcttgaaaatatttttttctcattcttaggttgtatatttactttgtcagttatttcttttgctttgcagaagtttttaatttaattaagtcctatgtttgctttgaggacttggtcataaaatctttgcctaggccaatgtccagaagacatccctaggttttcttctaggatattaatagtttcgaatcttatggtctttaattcatcttgagttaattttttatatggtgattgataggagtctggtttcattttctgcatatggccatccaattttcctagcaccatttatgaaataagatgtcctttacccagtgtatattcttgttgactttgacaaagttcacttggctgtggcatcacttgactgatggctttatttctgggatctctcttctgttccattgatctatttgtctgtttttatgccagtaccatgctattttgcttactatagacatctagtattatttgaagtcaggtaatgtgatgcctccagctttgttatttttgtttatgattgctttggctaatttggggtcttttggggttccatatcaattttagaatttattttctaatctgtgaaatatgacattggtactttgatagacattgcattgaaattgtaaattgttttgggaaatatggccattttaacaatattaattctattgatccataagtatgagctgttttgtcatatgtttgtgtcaactataatttcttttatcagtgttttgcagtttttctggtagagctcttttacctccttgcttaaatgtatttccgggtttttttggaagttattataaataagattgccctcctttcaactgcattattgttgctgtgtagaaaagctactgatttttgtatgttaattttgtattgtgaaactttattgaatttattcatcgaaaataaaagttttttggtgtagtcttcagattttttgagatacatgattatatcatcagcaaacaaggacaattgactttctgttttccaatgtggatgactttggtttatttctcttgcctaattgttctggctagtactttattactatgttaaataggagtggtaagagtggacaaccttctcaaagtccagttcttatggggaatactttcaacttttccattttcagtatgatgttgactgtgggtttgtcatatatgacctttattattttgaggtatgttccttctatgcttcatttgttgagggttttgagcttgtgctcttatgaagcgatgttgaattttaaaaaattctttttctgtgtctattgagatgatcatatgatttttggccttaattctgtttaggtaatgtatgacatttatttgtgtgcatatgttgaatcattcttgcatctctggtgtaaaatcaagttggtcatgatgtaatatctttttgatgtgttggatttagtttgttgagaatttattgataatttttatatctgtgttaattagggatataggtctgtagttttattttttgttattgtgtttctggctgactttggtgtcagggtgatacaggatttgtataataagttagggagaaattccttttcagttttttgaaaagtttcaggagtattggcaccagttcttccttgtacatttgctagaatttggttgtggatccatctgttcctgggattttctttgttgggagacttttcgtagttgggagatttttttattggattttaaatccaatgttgttatttctctattcatggtttttatttcttcctgattcaatcttaggaagtagtaagttttcaggaatttgtccatttcctctaggttttctagtttgtgagcatataagcataagggtgtggactcagtactgctaccttggccaagaggagtgagatgtgattctctctcatgcccccatttttggtggggctcaccaccttctcaactttgtcagtaggtttggctgttcacttagttagtgcagtttacttctagttgtcaacacaagctgccccaggccttaggagtcactgcacagcccaacactatgcctcccaaacaaatcccctcctgtactggtgggggaagggggtgaagtgaaagatggggtgagcctggttccagcatgccaatggctggagcccatgccatacttgattctcggttctggctgtgggaacctcttccctgcttgagcaccagatccccaggatactgttagagcctctttaatgacaaaggctgccactgctgctagttttcaggactgtgcacagcttgcaaagagctaggatcaagaatggtgttctgttgtaggttccaaggtctcgggaagtgcatgggacacttcccagagcaggtacttcttacagtctcccagccacatcccaaggtagatctagggcttagaaaagtcatggtgctctaccgtggcctgaattatatgattctatagtgggaaattggaccacagaaagatactcactcaccctctcccatattgggaatttactctcttctcattttcagccagtcccacagccacacaggctgactgttcttctttttctggtcagattttggagtttcttcgtgtgttactgttgaactcctgtgttctctcttggataatatgtttgtaaacaaaaaagttactgaggtggatcttaatcaattagagatttattttgccaaggttgagaacatgcctgggaaaaagaaacacaaatcacaaggagatctgtaccctgtgcttttttttaaaaagggttctgggaacttcaatatttaacagggaaaaagcaagcaggaagaggaagaaagaaaaaaagtctgggtaggcaatgagataagtggtcacattcttgtgaggatcttactaatgagcagaaaagctacattttacataaagtaaacatgaaattacagctttttgggaatgaaaggaaggcagttttttcatgactaactacctaaacttagccctttggtatagtgagtttggggtcccaatatttgattttgctttcatatgtgcaaagtgtgattgtctacacaccattgtcattcttctaagtggatgaagtaccctggaaaagcatctagtcagccatcttgaaaaaaaaacctgttgtttctttgtaatattgctttataaatctgagagaacttggaacaaatctaacaaaatagaagatacttctggagaagtgagaaaattgagaaaaatgcaactgatgagttcttgatatgtttagctattattattatcattactattattaaatgatactttccagttggcaaaaaagtattctggaggctattctttctactggggcataagtcaaactatgacaaaagagaaatgcatgcagagagcaagccatagaaggcaagttaggaaatgatacgaatatttatctgtatttattttattgaatcaatactgacaacaaaaatttccaacattaagtacttccaagtattagatactaagcaaagaattaaatatagtatcttatttaatcatcagatcaattaattatttccactttagtgatgagtgaaggaagctatatatatggtaatcaacttgacaaggattacctattaataaataaaagagaggagattcaaatcaagacagaattctgaagctagaacttttgttcttatcaccttataacagctcctgcatgtgtgttagagagagaatgagggtgagaaagaggaatatatacattcttatttaaacctatgtggataatcgtgtaaatactccttattatactaatacttctagtcaatgccagtctctaagagtatcttatttagtttttcagttagttatatatatattattacttgcatataacttgataatgactgcaaccgtaaaggaacacaatcttttgaaatgttataggcagcaaaggtagaaactctagtaaaagaaatctagtgtcaatgattttagatgattatgttgaaagtagatctttaaaatgattgagctatagtcacttttcactaaatttctgataaaggaacccctgctttttccaaagtttctcctcctcccacccatccactcttagccatctaaagcttagagtctatgctgcccccttctcacttaactctccaatatcttttcctggcaggtgcattctatgaatttcttagcaggatcacctggtctttttcaggcttgcaccaggttgctcttgcatttgtctttaagtccttgatggtactacagtctctccctacaatacaactttccccctcctactttccctcaagatgatttatcgttccttattctgcttccttagcatgttacctctatagcactgtcatatgctcgttattttaacatatttctctccctcactaaaatgagacctgggtgctcagatgccatttgcagtgtgagtcagttcatgagaagtatattataaataacaacaggaaatggcaagaagttttcagagatgctgaaactatatttgcagagttgattagaggatgctttgtctgagagagagtcacgacttgggtaatataacagaagatcttaaattgagttttaaaagagcaaaggagtaaagttttgctaagagaatagaaaatcttacatgaagtccattttaagatcctattgctacatgtgatttatgaaaaggaaaaaataacaaaattttctgactaataatgacattagataatattttttattataaggaaaatgaagggcaatttaataaaccataaaattggcaaggtttctggaaactgcaacgtttagttatagatttttgccaatttatcaatttaaaaagctaaggtagatgttgaaatatctgcagtataaagagagggcatactaaaatttttgctatagtagcttgtcattatactgtgttcaagtccaaaatttataaccagatcaatcatcccatgtccttccctagcttcagctctcaatgtttctgcctccttttctttgaatttctgaaatgcctgacttggccccagccagtcccatccactctctggaaagaacaccctttttctatactttatctttgatattctactcgttttcagccactgtttaaaatttacttcctagagaacatttctctagcttttcaatctattgtgatataatacctttttcttcctcttcttcttcttcttcttcttcttcttcttcgtgttcctcttcctcttcttcttcctcctctttttcttcctcttcttcttcttccttcttcttcttcttctttgccttcctcttcctcttcatcttcctctttttcttcttctttttctttttcttctccttcttctccttcttcttcttcttctttctcttcctcttcctcctcctcctcctcttcttcttcttcttcttctcctcctcctcctcctcctccttctccctcttcttcttcctctttttgagatggagtttccctctggttgcccacgctggaatgcagtggcacagtcttggctcactgcaacctcctcatcctaggttcaagtgattctcctgcctcagactcccacgtagctggaattacagggatgcaccaccatgtccggctaatttttgtatttttattagaaatggggtttcaccatgtgggacagtctggtctggaactccccaacctcaagtgatctgcccacctcggcctcccaaattgctgggattactgacatgagccactgcgcccagcctcttattttttttataatggcatttacaataatttgtactaatatatttacttgtgtagttattatctctcattgttccctccatagatattataaccccaaaactactaaaaagtatttataatttatcattagattgtactctcaaacatattatgttttcatttttttctcccttcagacagagtaggaaaatcaataagcacagcatttatcatccttttagctttctgagcatctactggcagcaagggtcagagctaaattctacaaccctggaagtaaatgccttccattagctctcttccagcaattataagaatgcaagcaggaaacaatgaaaatagttattattttttaaacatttgccaaagcagagaattccatctaacattttgggtgtttaataatgatacacttacatccctccttatgagaaatgattacagataccagtgattaaccctttgacaattttcagtacactgcatagatatagcatatatacagtcatttaataactgagatatatttcaggaaatgcctctcagttagatggttccactgttgtacaaacaccacagaatttgcttgcacaacctgagacagcataacgtactgcacagcgaggttatacagtacagcctatttctcctaggttacacacctgtatagcatatgactgtattgaatactgtaggcaaaagtaacataatggtaagtagttgtttaaacacatctacacatagaaaaagtaaagtaaaagtacagtctaaaagatttaaaaaaaaaatgatacacagatacagggcacttaccatgaatggagtttgcagaatggtagttgctctgggtgagtcaatgaatgagtgatgagtaaatgtgaaggcctaggatgttactatacagcactatagactttataaatactgagcacttagactacactacatttataagaagtatttttttctgcaataataaactaagcttagcttactgtaacattttttactttacaaagttaattttttcaactttggccttttttgtagaagtgcttagcttaaaacacaaacacattatgtagctgtacaaaattattctatatccttattctctacattttttttctacttttaaatttacaaattacttttttatttttggctttttaaaatttttataaaaaataagacagaaacacacacattaaccttggcctgcatatagtcaggatgagttccatcatcacatcttgtcccactggaaggtcttcaggggcaataacacgcatggagctgtcatctcttatgataatgatgccgtcttctggataccttctgaaggaactgcttgagcctgttttatagttaactatatttttaataaatagaaggagtacactaaaaaaataggagtacagtaaatacagtaatatttactgtattactataatacagtaaatacataaaccagtaacatattctttcttatcatcattattattatgtagcatacatcataatcgtatgtgctagacttacacagctgtcagcacagcaggtttgtttacaccagcatgaccacaaacacaagagtaatgcattgctctatgacattacaacggctatgacattgctaggggataggaatttttcagctcccttataaccttataggatcaccgtcgcatatgcagttcatcattaacccaaacatccttatgcggcacatgactgtatttaaaatgctatatctgacatgttgcattgggttactctgtttcataaattatttgcttcacttttttttctcatgttaatgtctcttaaattggaatatatgtaaatttgtgaacacttcagttgaaaacttctggtaagaccaagaaattgccagcatcaaagtcgtttttttgatacaatgaaatacagttacacaagtaaggtaaataatgcgtttttttttaagcaatattattgctgtagacaaattagactcattttctttttcatttctcatggagaagaatattttggtttgcttataaagttccttaaaatttacaaacatgttcacaagcattatttaatttcaacatcataacagttatgtaaggaagggaagagatagtgtgtcacccctttgtagagtaataaaccaagtcttgtatgttaaatgctttggtggttatattgttagtaagagatgaagccagaaaccctaacttctattttatggacatgcttcagtgtaaagacagagaagtcatgtgttggggctttgaagcccggagttctggtataatgtctaatgaagacttggtgaattcgcagagtgttgtctttttacctgtggcttctgcaccttggtccagtcaggaatggccaggttagcaatgtgaagtgatgtgtgccagcctgtgtaactccaggttttcaccaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacaggtgagagtctgtgggactgcaggatgtgtggctccctcagatgcatgaccacttccctagagttctaatatcattccaaagtagtgtaaaaatacagttctgggaatcttgacctcatatacattctataattagccatttttgtttagtgactagtaatacagctctgaataaaattttaatttttccacgacttgatctttccaggctatttcctactactaattaaaaatatatttctaattttaattagacattactctgacttaaatctaatatagaaaatactctgatttaatgaattgttgacaaggtcacttcctgttctccaaatatgacctcctaatttccagcctgttggcgtcatttactcacaatgctctttccctttgcctccatccttcaaagccacacagagtttttgagactttttatcaaaggtcatatcatccaggaacatgtccctgatttccagtccaccctgcctaatgcttgccaatactccttctacaactatcctgttcaaacaactcttcttctcacttttgaacacaatataatgtacttttctggtttttttacagataagaaaacacaaactaatcaattgtattcatactactcatgaaaagcaattacatttttacatgaagtcattaacacatacaacaataaaaatcataaaagtaatacatctgattagaaatacaatataggaaatagattttaaaatagtgtagtttagtgataaaatttatactgtgttttctacttatttatagcagcatctataagattcttctatttatttgtcttttttttttaaggattgcacacactcagtctgttttgtattgcagtgacatgtgcttgttattccctgcactaaattataggttgtttggaattatcttatcatgtgccaaccaaagtccagtgcattttgcacatcatgagtattcaacagatatttattgaactttgtttcttaagtgtgaagttatacactagatcaaactttatagagccctcagcttctgtcttcacaagaccattgaacaaaacagcctcccaaagttggtcctgtggctgacctcaaacagacctgtggacaaattaaaaggttttcatgcgcttgccacatgcaaatagatccatagagcaaggacctaaatacacacatggacacttaattttgaaaacaaatgtggtgaataatctagcattgactatactggaatgtttgcgtaaaacaggattgttggatacatatattttgaacatgttgaactgatttctattttctgactacaaacctctgtaatcaacacatcaagttgtaccagtatgacattacaatcaggggaagaggacagaaagaaaactccaattatagtttttttaattgttcagttgactcttttcaataactctgcttttatcttcatgcacctaaaaagtcttaaatagccaaaaaatagtttccacaattagaacctcaattcaaaaaaatagatattatatcaaaaatggaaacaaaactatattaaatatgattttattctgagtcaagatccaagaccatttaaagcattaaaatataatttaatggaatgtaagttgacagttttgttattgaaatttatatttttaggtttctaaaattattatttctctacaatagtccacttcgcttggaaacagctacatggtaattttaacattttggttccaatttagtattttattttaagtctcctgatatttataaattagatagagataaaatctttgaatctgggctttgtattctgtaaactgatattcagtgaaatacattggcctatttccttacccattcacaatgccagtgtaagataaacatcagaagtgaaaggtaaaacatttaatgtctttttagcttttagttgttctacagattttataactcttatttatttaccacataagaaatcaatgaacacctttgtagtattactttcaaatttaaagtatgtgaatatatttacatgaagaaccttaacacgtttttcttctatattcttaatttatcacttccagtaaagttgatagggaattaaataaagaaggaatataagttctatcgtaaaacaagcagaaagaaaaaaattaatgaattgactttcaaagtgttcctcatttaaacttccttaaaaaggataatttatgtattgatttttctctgtataatttgtttttaaggaaacaaattaaacaacaaattaaatatttcaatattaaacatattaactatacgcatgatatgctattaatattataaatgatagaacttgagtctgtatataaattgagacttcaatgagtctcaatttatagcacatctatttgtttcaatttcatgattattgagaaaatctaatttaatttgtaatgctgaacataataaaaaaattttaatacactgcaccgaatttattttcacctgacattttcttgtttaaatgacagtgcttgaaataagcaaaccattatgtctaaattaggagaaaattttatggccttaaacattccttaatgttgataatagttttaataaagtgctaataggtggatgtaagcatgcacaatgcttatgtattaaacaaatataattactcctgaaaatggacttttgaggcccattaagtatgttctttagtctgctttttttaaaaaaatgtaactctaaaagaataattttgcattattataatttttctatgctaataaggcttaaacacatgaatgtaatttttggtgaaggcaactcgatgtatttagtcatgattacattcagaatgggattcaattaatgtagttttatacacagtactataaaaacaaatacaatgcaaggataggtgttaaaaatttgcttcagataaacttctcttcctttttttcttctctctctttgtctctatttctctctcatcttgtacatggatcacaaatatttttcatgattggaatatcccactacgatttaaaattaaatgcaaataaaactggcttatagatgtaacaatacatcatgtcgtatataaaccttaagtttttatttcatatttgatttatatcctgttttctttatatttcagtatccgtatttactatgaaaaattaggctgggcacagtggctcacgcctgtaatcccagcactttgggaggccgaggcgggtggatcacgaggtcaggcgttcgagaccagcccagccaagatggtgaaaccccgtctctactaaaaatacaaaaattagccaggcacggtggcgggcgactgtaatgccagttactcaggagaccgagggaagagcatttattgaacccaacagacagaggttgcagtgagccgacaccgcaccactacgctctagcctgggcaacagagcaagactctgtttcaaaaaaaaaaaccccaaacaagaaaaattataatattatctgatctcattgtgaaaagtaattacttgttgatttttaaagaattatctgtagttataaacaaataaattggaaagtggtaaatatctgtaggaatatctcgtgcaatatcgaagaacagagtaagactgttaagatcaagatctattcttttggcttggttactgaatctgtatttgtgtgcatgagaatgtggtttaataatatccatgaaattgatatcctgagaattcaagacagtgctatttaacaatagttctcttttagtttaatgaaaatggttggctacagtaaataacaacttaacataaacttgcctacacctaaaactttttatattatataccacctttattgtcaacacagcaaagacagacagtgtagcacaatgtacagacaaaactagagggagcaggattggaaactcggcggggcatacaccttggcaagttaaataaaacccaacactctcagcttctgtttcattaacattaaaatgttgataatactcccttctttatacaattattgttaatattaaattagatattgtatgaagtacttattgcagaagctgtaacatagttcataatattgatattgcatcaataacatgaaaagtaacaatactttctgttctacctagtgcaagacctatgcatgtgtgctagaaagtcatctaatgggactcacaattgatttcagcacaggatttatctgctttgatgctgcaacaaaggtaatgtgttcaggtcagctctgagaaatatgctgcaaacattctaattgaagaatgatttaaatgcctcataactcctttcagcattttaattgtaatcgtgtcaaatttaagatcttcgtttttgttaatggaagataaattatgcttcgatctgaaaaaaagtttgaatttttaataaaacatatgtagtaccacaaaactataactatgtgaaagtatttatttataagtctatctatgtatgtatctatctatcaatcatttccctgttttttaaagatatgactttataattgaagggacattttcttccccaaaaagcagtttttaaaaaacatgtttctttatactttacctgcatcaacttctgcaatacaaaaagaaagaaaacatgttgtttttttaaaaaaaattatagctgacatgttagaattattgaatggtgaaaatttaaagtttagtttctagccagggagtaggacttttataaacacttgacttaataaggattatgcactatgaggtgctcttttcccaaagtgtacatctctgggagtgatgcacattgaatgacagagggtgcctactcagccagtcatacctaaaaaaatccaattttgattattatggaatgacaaatgacaaagccaaagcattgcacattattatcattatttttaattggaagcgatcttaaagctcaactgatccccattcaactgctaatctccttctagtcactgctacagtttgtgacttggaactgttgtccccatggaagacatcctcttccctctcattgaggatctcagttccttagatccattccatttcctccttcatcaaagtatggcttgggtataaattgatttgttccttctcactaattttaaggattcatgagtaatcctttaccagaacacacatattttatctagaaattaagttttgtgtaggattttctaaagcaaatggcaacaaaataaaacagtgatacgaatgtgtaagaaagatggagtgtaggaggcagtgggggttcttgagttgggaaagatgaatgtctaatggtgggatccaggtaggatgccgccctgtgttcattcaccttgtgaatcttcatgactcagcagttggcattgtcctgcaaaatctcacattacttaaacatatagttatttttattttaacatggtaaaattagacagcacacatttgctggtcagatttggccatctaatgtgttgccttcacatcatgacaaaggaatactttgtgaataaggaattttaaatgccaatgactcttgaaaactttcaaatgaggctgccataaactattcctattactaaagttttttttattaaaatgttcatcaaatcaagataggctcctgagtattaaattaatttgataaattaattgaattattaaattatcgattaaatgagtaataagttaattttataaataaatttagaaacaaatttcactaactagaaaagtcaaagtctgattttaaaaagaaaacgctattgccagaattgtcaccaaactctagtacacgaatgtataagaatcttacattagcgaatgagaaaaataaaattcacatgaatatatttctgagtatgcgaatctattctgagtttattttaaagctagcataatacagacctatgtcagtgtcctgttggctctgtataataagggagaaaatcatgacaccaatgtcctatctgacattcctgtctacttctgctgggtgttctgggaacgagtgcgtagtcaggagtgtctaagtgaatgattatgatgccatccagagaaaacagtttagtaggaaatgagaatttaatcagtccaagcttgatactcaaggaaagcaccagaggccttcaggaatagtagtcactgttctattttctgattctttcattggaagcatctaacttcaaggtaatctcagaattgggaaaggctaaaaggaatctacacattaatcaagaaggttatattatccatcactgattatacttggagaatgaaagtaggagctattaatagttatgtcagacataaggaggaggacaagcataaatggagattcctgggcaacccactgagctgggctgactgcaagaaacttgcaccccttcatcagatgaggctggaagttatttttaaatatgataaaaaggtaattgttacatacaaatcaaaacatgctttgtctaatgttttattaaaataaataatatctagttattttctatctattttttctaagtaatatgaatgtgaaaaatatctttaagactatatgtccaagagtttttgaatgtttggattcaggagagtttaccctttagctgaacatgctttgtccttctgcacttcatcttgatcaagtcctccaactttgaagttactacagaagcaaaccaaaggtcttgaaataaagaagagattccaggaaaggggtggactctattctgggtcattatttgagctccatataaagcaaatagtgtattcttaatacatcagtgaaggaaagaattgctgcatctctcttattgcagggaatgagagtcggcatgattttagattacactggtatgctaaacgtttggatatagagggatgtctgggaatgtcgagctaattctcattacttaccacctgtgcttggaagttcccagagtaaacgattacccttgacttgccagagcataagacgtattaaatagcattctgttccctatacttacatttacattagtagcatatcaagaggtgatacattcttcagttcccttactgttgctgagtgattccctccctaattcattactgtacagctcagcttgttctttgtaattctcttccttattaaaatgtagcattttcactgttagagaagggtattattattattatgtcaaagtataatgttaaccatacttaaataatttacatagctaaaagcataatcttgttgccattatattcttttaaaaatgtatatgtgcattaattaattttatatagtgatagagttcctagttaaacagaaacctcatcagtggcatctacaaaacactcatttaatttgtgaataaatcttcactgaatgcctgctgtctcttgagagacatgggagggcatacacatcagtcttcacagacgtttccttgaagtggagacaaggaggatgaaactatccagacagatatctgtaagtgaggatggacatggaatttgagggaagaggagatgagaaatcatgtctgtgggtatctaagagccagatttgaaaaaaggtccagttaagaaattggaagtgattctaagaacagaggaatacctttagggtttgagacaaaggaaagaaatgatcagatgtgtgtttgagaatcgaaaactagtggaataatgtacgactgaaattaagacaatctgggcaaaacccagattccaaatgtgtttttagattctttttcttattttttattttttattacactttaagttcttggatacatgtgcaaaacatgcatgtttgttacataggtatatatgtgccatggtggtttgctgtatccatcaacccgtcatctaggttttaacccccacctgcattaggtatttgacctaatgttatccctccccatatccccacccctcaacaggccccagtgtgtgatgtttccctccttgtgtctacctgttctcattgttcaactcccacttatgagcaagaacatgtgttgtttggttttctgttcctgtcttagtttgctgggaatgatggttttcagcttcatccatgtccccgcaaaggacatgaactcatccttttttatggctgcatatactccatggtgtatatgtgccacattttcttgatccagtctatcattgatgggcgtctagtttggttccaagtctttgctattgtaaatagtgctgcaataaacatacgtgtgcatgtgtctttataggagaatttataatcctttgggtatatacccagtaatgggattgctgggtcagatggtatttctggttctaggtccttgaggaatcaccacactgtcttccacaatggttgaactaatttacactccccaccaacagtataaaagtattcctatttctccacatcctcgccagcatctgttgtttcctgacttttcaatgatccccattctaactggtgtgacatggtatcacgttgtggttttgatttgtatttctctgatgaccagtgatgatgagctttttttcatatgtttgttgcctacataaatgtcttcttttgagaagtgtctgttcatatccttcatccactttttgatggggttgtttgtttttttctctcaaatttgtttaagttccttgtagattctggatattagatctttctcagatggatagattacaaaaattttctcccattctataggttgcctgttcactctgatgatagtttcttttgctgtgcagaagctctttagtttaatgagatcccatttgtcaagcttggcttttgttgtaattgcttttggtgttttagtcatgaagtctttgcccatgtctgcgtcctggatggaattgcctaggttttcttctagagtttttatggttttcagtcttatatttaagtcttacgtttaagtctttaatccatcttgagttaatttttatataaggtataaggaaggggtccagtttcagtttcatgcatatggctagccagttttcccagcaccatatattaaatagggaatcctggctgggtgtggtggctcacatctgtaattccagcactttggaaggccagggcgggcggaacatgaggtcaagagtttaagaccagcatgaccaacataatgaaaccttgcctctactaaaaatacaaaaaattagctggatgtggtggcaggcacctgtaatcccagctactcaggaggctgaggcaggagaattgcttgaacccaggagacagaggttgccatgagtggacatcgcaccactgcactccagcctgggtgacagtgtgagactccatttcaaaaaaaaaaaaaaaaaaaggtggggggagggaatccttttcttattgcttgtttttgtcagatttgtcaaagatcaaatgactgtagatgtgtggtgttatttctgatccctctgttctcttccattggtctataaatctgttttggtaccagtaaccatgctgacttggttactgtagcctagtagtatagtttgaagtcaggtagcacgatgcctccagctttgttctttttggttaggattgtcttggctatatgggctcttttttggttccctatgaaatttgacctcttcaaggagaactacaaactgctgctcaaggaaataagagaggacacaaacaaatgaaaaaaaaaaattccatgttcatggataggaagaatcaatatcatgaaaatggccataaggtccaaagtgatttatagattcattgctattcccatcaagctacccttgactttcttcacagaatcagatttcagatttttgaaatctgtcctccactgggcatttgccactctatcacattcctgagaaaaaaatacatgcatggatgacaaagtcaaagaataacactatgaattgagggaggaaaatgatcagagtgtaacctgagaacaaagagacatcagtacaattgaaagttaacgttccaggaggtgggtgtggagaggaaagctggagaaacagattgggccacatgatcaaggtccagcacaggctcaaccacaatctaatttacacagtggaaagaccattctagctgaggtacagcttgcatcaagcaggtgggggcaatacttaatgggtgcttatgttttccctcaatgactcattatagaataattttgaactttggttttgtaaaaaccaaaaccaaaaacaacaacaaaaacaaaaaccgtaaaaggtagatacttgttatgggcacctccattttatgtttttgttttcgctttacaaaattccatgattctaaaaaagtttgaaagttattctttatataataagtatgggcgtccaacaaataacacctgagtgttagtagttaaaataagaatgaaggcattggaatcccacacctgagacctagcatttactcctcctgctgcaactcgggagtcacagggctgcacgggatgtcactgtagcacaaagaatattcatactatgtaaatatccattgtgattattagaacatcataaatttgactcttaaacatgggtaagagtaaaagacagcattactcatatcattgctggtctctagaatactaggtcccccaaattgttatagtctgattgcttttattattatttaatgttttaatagttgaaattgagaatggctatgatagaatacttataaaggcttctttacttcaatttatttaagagccagtactgacacatagcttgttaaaaacattttttggaaatcaagattggttaacagatctatgaagataataaatatgaagtaaaaggaaacagtcgtaagaatgagctctatcacaggttataagctactgtatactattatataatgattttatggtttattttctctttatctcctttattagccttaattgaatatacattaaaagcattgttatggaggatgtttgttaaaacccactcacatgtatattgaccttcattttgcaaacttacattctgagaattaagaggcaatcaacgtaatcttagctgaaatcacttcattctggtttttcatattttttctacaaaattagaggacttaattattttccaaaataattatgatttacaattaaattcactgttaacacattaacattttaagttcatgaaataccttaatctttctaatccacttaatcctttaaatcgacactgatttctagaatctttcaaggtaaaatttgaattgaagttaatatggcccttttaatttttaaaaatctttgatatggctttgataaactgaaggagctctgagctactgtttctcccaaaggtgtatgaccctcatgtacacacatgtgcacacatacacacactttattacacatctttaggctttttatataaagcatttatatgatcataatatgaattccatagcttaaacttctcaacatagaattaaccttttatttcttaaattttatgttattattccataatctttcaattatttcacatcaaagacagttactaaaaatattaaaaaaattgaaacatcaaaatgaattctttcttgaaatgtctcctgtgtaagtagaaatcttcactatacaagttataatatagttctgacaatattcacataaatcttagcattttaaaattatatatatattttttctttccaattgtgttacagctcaacaatacaaagagctgtttgatgtaatttttatgttcttcttcagataaattatttcttctttgcttttagggaaatgaagaacattgtatttattgcaaaacgaactcagacatttagggaaactctcaggtacttgtttcctaatcttcaagtatttcaaagatagccctaaagtaaatattcaaaaaaatttaaacaaaaaagtattttgaatgacattcaaaaaaacccaacttttcatgcaatatgttattgtgtaatatgaaaaataaaattccctgcctttcttattctttttttttttctttttgaaacggagtctcacactgtcgcccaggctggagtgcagtggcgcgatctcagctcactgcaagctccacctcccgggttcacgccattctcctgcctcagcctcctgagtaactgggactacaggggcccgccaccatgcccggctaattttttttttgcatttttagtggagactaagtttcaccgtgttagctaggatggactcgatctcctgacctcgtgatccgcctgcctcagcctcccaaaatgctgggattacaggcgtgagccaccgcgcccagctcttactcatttcttgatatacaaggacattatagagcattgtgaaaattaacacataattcactgctatgtttataattcaaatatagaaaaaacaaaatcaagaaagattcaaaaggtctttggctaatatatacttttcatacccttaaattttatgtcttgttttccttctccttaaatctttacttttttattctttctttctgtggcttctgatatattttatttttttctggattaatgtttttatgattaagaataactgacttcaaacttttctcatcgtattttagtttacctttgcttaaattatcatttttgatttccataaaagttttgtaactcaaagtattatccttcaaacctgcatgaattgaatgggaatgatataactttgcttttccttacagcgttattctaaaattaaatgagatagcatgttaaaaataataaactgtaaaacataaggtagagattctgaaacatctgagcattatttccagctagcccatatttcaatagatcttgtctcaaccacaacatatcctttcatctataactagaattttatcatgctttttctttctgtttcaaattcctcagaacacatcagggagttgcttctgcaaatcatacagacacagtgagcctcattttcttcatctctaaaatggatatcttaataacacttttctcccaggcttatggtaaagtgtaagcaagaaaatgtgtgtgaagtgttttgcacagtgagacttgcatgatgaacccttagaaagagatgaacatttctgcccctcacacactgtgggatagtcccacccactgcagtacatgagtaccagcgaccctttgctactgtgctaccatcctcaagatgtcgaaggggcactgtgttttctgtaagtcttgatcaaccagtcagcagagttaatgtctgttacatttcagtccttagggtttgtgcttttggaggtctctgtccttttagcccaatgaagattgatgttgaacaagtagtcgtgagtttaaatggttcttagcaaagagagttcaggataacctggaagctgcaaactagattaatgggccattagcaatagttggaaaaaaatacatttcacttgagaatttgtaggtcctgggtgtctaagtaggcacacggtgaaggaagattgaaaggcaagtgtgaaatccctgagacttgacagaacactgacagaggaggaggaaaattaggggttgggaagggcacacaaaagtaaaatagtcaggcaccaaatctgaggaactttggacttcatgttgaagagttggcacttacatcagcagtggcccaagtttgccatgtaacgcataatgactatgcatcactgccttacgaaagtaaacatttgtttctcgtgcttctgtgggattcagaagattgatctggacaggctaatttatacggctgcagttcggatggttctctcgaacatcctctgattgttccttattcttctctaagaatgaggaggttagcccaggcatgtccttttcttgtaaagggcaaagggagaagagagaaagccctaatgcgcaattctattttagtctctgtattgggaacaactgcaaaatcccactgtcagtcaaagcatgtcatgtggttgaggccactatcaagtgggagggcagatcagcccggtccatagaatttgcatcaataaagttcataattaaattccagaagtcatattagtaaatgtgaagaatagtgtggcctcaaaaataaaactatacagatatttattaatttgtcagttattttattttataaagtgcttaatctctgtcagtgggccagcctgcagacaaccttgaggagaacagagacagtggttgtttcttagattgcagaatgcatttacttagatgtacatctctgaggatactcatttgtttttctctttagaatgtttactatccattgaactggcaactgtgtgttcatatgttaaaaagaaataaatagaagagtttattcctacagaaaattgataatacaaattattagtgtgattgaattttatcatgtttgcagaaaaaagcaacaataacaagttaaacaaaaacaaaaataacctttgccatgatttgaatgaatgtgttccttcaaaattcatacattagaacctaatacctcatgtgatagcattaggaggagagcctttcgggaggtgattaagtcatgtggctctgtcctcatgagtggaattagtgcccttataaaagaagttgaagtggtgccctagtcctttttgcccttcctccttctgccacgggagaaggcagcaacaaggcactattttcgaagcagagaatgacctttcaccagacaccaaatctgccagcaccttgatcttggacttccagtctccagaactgtaagaaatacatttctattgtttctatgttattcagtcctggatattttgttatagcaggaggaacagcctaacatgctcttagaatccaagaaatctgtaccaacaaaacaaagttttttgctattttcatcacacagatggcatgtaaactttctgaaaataaaatctgtaggttaagaataacaaacagcataccatgaccagtagtatgtggaaatgtgctggtgctttctttaccacatgaatttggggcattcttttgaaaaattttacatggctatgattaaaataaatattgtaatacatcaacttaccagattgatatcattaaggtattataaaattaatctataatgtttgagttttagaaaaattttaatagaaaaagattaacttttctccttaatagatttcaaataaattctcaaagtgaagacctgtatactcctctgaattttttaatatagttgatgaaatatattttttttatgtgaagttaatttgaagggaataaatttagatgaaatacatttgagggagaagttctgagcttgattagacaatttagttcaatctttaatttaggcaactggcccaatgataatgcattcctgttctattatgtccagttcaaacatgcatgatctctaagactccataataacgacatttcaaaagtgtgttcaacattgagcttgctgtccattttagtctcacacctttgtattcccatctcaactatctaaataaatccagatttaattctatcctcttgccttatccttacccttgccatttagccttttaataactttctctaaacaaatctaaaaggtgttccctcttttccattttcaatattactaacttagctaacctcttctcatttgtattaccacaatatcttccaaataggacttgtcaatttatttattgaagacattcttattatgcatcaattatgctacatgactattgctacatactaggagtataacaacagatgcagtccctcccctcaagaagtctacagtctaatgaaaaggacagatctagaattgggtaggtactttcatgcagtatggagaaaagtctaagcattatgagggcctagttacagactcaagagggataatgccaaatagaaataggatttggtgggacagtttgatcaattgcttaaacagaagattcatcaagacaatttgcaaaggataaaaggtatgtttacggttattgctggacactcatgagtcaaatatcaaataccaggtgatttgtgatgtgagaagagtataaatagatactgccttcaaagcattattgttgtaatttttaacatgttctatagaataagttataagctacataaatcgttctttcaaatgttgttgtttttgttttttacctatgtggtaaaaagctacttttattgcacataaaatagttaacatagggtttagtttacctttatatgtgaaagttgcttcagtttctttaaacagaaatttttctctaggtcatgaataattggacctgaaaacagtgagctggtaaggaaatgaataaagaatgtgctgggggatttttaaccttttttgttcaacatgtaagcctttcattagcattaatacaacttcaccttccatttgtacattattaatgcattacagttttgaatggtctgcatccaaggaacacttgatgtcatttgaaagtgaatttattcattaacctgtgtcccttagttgcagccagctttgtatccctgttttctgatggagctagcagccagctttgtacctgtattgtaagtgtcaaaaataaaaagttagggcaagctttgtttcctcttcccttcccactgacattctctaggttactggcattttcaagctttgagccaattttacaatgggccttactcaaatgaatagcttatgggaaacttttcacatatggtggagacaaattcttaaaatagcagcattattataagaagaagtgatgactcagagcatgctatgaataaattgctttcctgggtttagtgtcttattctaaatgggactctaagtctttcctctattttaagaaagaagtcaggcattagcaataagagtttatttataatcatgttcaataaatgagtctgatgtttggttagggaaatcactaaaaaggtaggtcagaataaaagaagaaatatatgtggaaaatgacagacttagttgtgatttctacttcttagctatgaaatgtggtgaacgtgtatggtgcttcctttattgtatactgggaaattgcaataactctagctattgcatagctcttgcagggatcagagataacataggaaagggcccagcacagtgaatgcccattttaataaataacaaagatgttgcttcactgaaagaacagcagactctcagaatgcatcacacacactaaatgaagtattttcaaattacttataatctgtgcttgtgttcagccatcaaatgattcagtgtcaggaacaaatgatggattacatattatatgcctcattctcttaatatgaaaaattctgcttgataaaatttcaacatttcatcttcaattgcacatggattaatcattacttatgatcacattgtatgtatgtatatatatacatatatatgtatacatatgtgtatatatatatacgtatatgtgtgtgtgtacatatatatattgaggtgcagtcttgctctgtcacccaggctggagtgcagtggtgcgatctcagctcactgcaacatccacctcccaggttcaagcaattctcctgcctcagcctcccgagtagctgggactacaggtgtgtgccaccactcccagctaatttttgtatttttaatagagacggggtttttaccatgttggccaggctgattctgaactcctgacctcaactgatcctcccacctcagcctcccagtgtgctgggattacaggcgtgaaccaccacacctggcccacattgtataattcaatgtgattgcattgaatccaaggttctgtaatgcttacctgtttgcatgcattccttcaaataagatttatctcttatagatagtagctcataggcaaattattcttctgcagaacgtatttttcttttatattctttaattaattatttaatcagcccttagattgaaacagttttaccacatacatggcttttgccattgacagtcttcaatgattctgttatagtgaactccagtagtaaaagtgctgggatttgttgtgttgttctttcttcatctttactttcaggttttgcgtatgggaaatatttaattgtattttaaaattcaagaaaaattatatgcttatcatttcatataaatgtccaaggaatatttttaatgaaacactgtttttgactgtcaaaaacaaacaagttttaataaatcaataggtatcttaaatccattaacactatatgtaaatgtattacatattctattctatagtgcatattttatcacttctcaacttgcatttcatgggaaaaagaaagtgcttgcataaacaatgttaaatgattttcttttatgaaaatatcctcagactatcgtgctaatgaagctcaccaaacgtacgtgaccacatttgacttccttgttctggaggagcaagcaggagcttcacaggtccatggaaagacatgggaaagtaaaaatctggtctgtaattacttaatataaaggttttgggtcaaattccaggctttaaaatattcaaaaatttcatcatacattgctattagttttgttcatttatttatttcttttgctctctcctttcgacttgatctctaccaagttcagcaaattaagactattactaatggcaggaattattcaatccaaattcaaggtcctttgaccaaagttctcgagagaagacagagaccattgggcttgcacagtccagaaaatattactggctgttttcaccatgccttctctaaagttgggcatttcataggcttttataagctctcgttttagtatatgtttcccccacttcccgattacaggcctccaataacatgacaaccacataactacagggaaatgaagtgatttttcttcattaaaattgattctgttttaatatgtttattttacaaaagttggaattattgcacgtcccctgcatgccagtaactccattaggacccagggcttcaacagtgggtcagttagactgactggaagctctcattacaaggagaggtgcacagcaggagggattcatggcaatgaggcctatggaaaaaaaaaaggagaaaggtattgacagagaggggtttcagaaggtcttttagtagttttgcaggaaaagactccctaaggcagtaatatttgtagtgagaccatagcaagaatggaatagctatgaaatgagtaggagtaaaaaggtttcaaagagaggaaatgagaagtgttaaatcagaggcatgaaagggctttgctatttgcttttttccaagaacataaggagggcagggtgaggaagagggagcgagagaataaaaaagataattctgattgtagtgtagaaaataaattcatgtttactttatcaaaagcttttattccatggtgttatttgtatttaacatttgctttgtattttaaacaatcttagttacattttttatatttgatatcagaaacaggaagggtcactggctgtggaagatatcacagatataatatagataatcacaaacaaagcaacagaggtgccaaatgattttaagtaaggaatctctgtttgggaaaggggtgggtgtcggagacatatttaaatgttttcctcttatctgagttccgtatagttttagttgaatatgtggtctcctcgggctaataataagtaatgtggccatgcaatttgctgcccaagatgtgataataaataattattagctaacaaattggtttcctggtattggttcacctgtaagattattttgtcaagcattatttttaaaagactgttatctctaaaatataaacatatactaggcacactaaagagaaactgagagatatttcattctattaattatctaatcattaataagtagactaatcatttttggtagattatttttggtagaggatcacagtttgttgagatgcaattatgaatggcatgttcaccaaaatcaattcaggtgcacttcaggtacatatgttttttaatttagaagaatttgatcttgctacaactctgtgctctattaattgcatatattcatattatcagtgtatagtaaataacataaccaatgttaaaggtttagatgaatttatggtagcattcaaaataatagagatagtttaatttgatagaaataaatttctaaaacttttattctacaaatgggatggaaaaaacagttattagagttaacagatttttttaaatttgaagcattaatagaaagaagacatcatttaattatctgtggatttattctactaatggagacaaataaatatcattcggctcactttgataagaaaacttcatattcaaaatgagtatatttcatttatatggagaatcgttggatcaaaataaaaagttatgcataaagaatgatttgtaaatataccttctccatctaaatatattagatcaacttatttgggcgacgttttgtttttaaaataactactaatcctgtatttcaagcatatgctaatttgttccatttggcttttatgcaatcagttattcccatggtgaatgggtgaacattaaacaacattttgtgcaattgcatacttcttatcaactttatgatatattagaattcactagtcaatttttcatttaatgctcaccttacttttttaacttaactaaagttgagtctaaaacatcaaactgtaagataagtatatatagttctatattataatccaaaataatataaaagtaataaatatagtcttaataatataataaacaacaaaacgtcttttacaagcattcaggttactgcttacaaactctacagaatggccatttatcctctttcctgtccatattttaagtacgtgacacctctaatttcctctgtttttcaccgccccgttgaaagattgcctgatgccagaggacaggttgcagcaagcaggctgttacaccaactggctcatgagcagaggtgttgaatacttcccctgcaatagacctgaagaaacaagctgcctttagcacctcatatccagatgcacttagttttatcagcaagtaccatgtctattgcatttttgctaaccaggagaatattctggtttgatataaattttgaccaccaaaaacaaagccttgtgccgatgctgctgaattacagaggtgcatcttctctacccacgcttcctgagtgtgactgtaggattggcaaggctctttagtattccacacttgaaaaagaaatgaacttctacctactctgtcttccctctcaggttataacacaataatacacatcttcacattttatccttcttcagtgcctagttgtgtacaggtatgtgacatgtggtatgtgtgtgtacaaatataatttccatttggagagctaacttcctaaacccacattaacatgttattaaccaggaactcctcattgcattaaaatagtgcactgaaagagctcataacaaagtcattcataatcttctcatcaatatcactaatttctaaaaattaataaataaaatattttattactgtttattacacaaggtgctatggagcagttagtaaggacacatatttcagccagtagtgtgtttttgaaaaagcttccctaaggagttatgattttcctggagactgaaacataaaacgagacatgaactggccgaagttgggggagcgctcaagtggggcccctcaggcagagtgggcaacaggcaaggtggaaggaatgagcaaaagcatcatgatttgtgaataatcaagagttgcttggctggaacagagtacagttgaaagtcagtggcaaaaatgagattagaaatttgaggctgggcgcactggctcacgcctgtaatcccagctctttgggaggccgaggcaggtggatcacaaggtcaggagatcgagaccagcctggctaacacagtgaaaccccgtctctactaaaaatacaaaaaattagcagggtgtggtggcggacgcctgtagtcccagctactgaggaggctgaagcgggagaaaggcgtgaaaccaggaggtggagcttgcagtgagctaagattgcaacactgcactacagcccaggcgacagagtgagactctgtctcaaaaaacaataaaataaagtaaaataaaataaataaataaataaaattgagcaaggctaaatcttgaaggattttgtgtgtcttaacaaggatttaaatctgatcatgatactaccattgaaagatgttatgtagcagaaatatgatttaagttgaaaaaagggaagggagtgggcttacattatacaatgtggaatgtcaagagtagagaaaataaattaattttgaatttactgtgaatacgcaagagagaaaaggtatctaaactatattagtggtgtataatgataatgatgacatagagattcatgaggtgtgtgggaattagaattaacagaattagaggcagggagtctgatggtaaagttgattttattttcaaatgtaatgcttagaagatggagtaaaagtgctgacaatccctaaaataaattaaagaagagagtggttgaggggaagatgaaaattcacttcaaatatatcaattttaatctctatacaagctgtcttagattgggttccgttaagagttttctttgagagagctttcaacagatgatatttctagatgctgggagtccagcagccctcccaacagatgtgagcagagaaccacaatatccactgcagtgcacatctcccattccacagccccactggctttttatgctaaagtgggcccatccaggtgcattttggattctcactggccctggattctcactggtccttctgtagaaaacaagagaagggttagtgagatgataaatagcccctgctgctatggctgttgtcaaggccataactgacaagcatcatcccctcctccactcctcattcttgattggccctgtcattaccataacatctgctgctctgggaagtttgcctcctgggctaactcacactgtcatcccaagagctgatcctgtggctatggatgctgatttattcccactgaccattaaaagtgacaatggcagcataaacatttagcagagttattgcatgccaaataagttcttcttcaccttcctcctacctcctgattgtgttaagggacaattatccctgcagaaggtgactccttaaactgtttactgatctcttggtacaaagtgtttagaagcaccagaaagcaccgtggcttatggcctccacttgcacagtacagagttgtcagcacaagatgctcacattccccatttgagcagctgggaaaggtgatagctgcaacctgtcctaaatccacctcttcgttctctgacccatgtagtctacctacctgccagggacacagaactgtgtattggtcagtgattccaggtctattccaccacaccttgggggtggtgtccccttctcatagtatatctcctagatgaaacactaactatatacgaagaggccattgaactgtctgtcctcttttgcccaaactctgagggtgatgcagcgccgagggcaccactaggtgtcttgatgatgctccagcacctcttttgttgtacaatggttctgtagggatgaggagttacaaagactcctgcaaaaattctgcaagtcctaaaatgttgaggcctggtgaacaggaaaggcaaactcataccagagtgtgtgtctattcatgtctaaataaattaatgcctctttggggtgaaaagagcccaatattatcaatctgccaccaaatagttgattgatttagccacattggtggcaccttgagcactcatttttggcttctattggtgacagattgaacattcagctgtggtagaagctggatcctcctgtgtgcatgaggagtcaggttgggctcatgtgtggcccgcatttgttaatgcattctttatgccaatgacagagccaggctgttgtaaaatctctgaagtattaggagtgctcattgtttggggctttttcctcggacccctttttccctaatgtgatattttagtaatcctagatccctgactgggtcaaatctttcacctctgtccatgaatcacccatattcttatctcattccacttgtatttgcagaaaatggatacccagatgcactgtccagagttctgtgcagtggggagcattttctcctcacttatgttttaagaacaactaactgaggggctgttgaagaggaaacctcaatatttagcttgcatgctgagcctgtctatctgtgagcaaatcttcgccttttgttctatcttaggtcaccatagggattgtcccttaggtggcatatttgctagttgttgagtggtgcaggtcctaggctggtgatgagatggacacctgggctgccagcttggatagcttgctggtgccctgtggcttggctcatccctgattccaggtgaatacattacatactacaactttttacattgccctgctgtaccttatagcttattaggcagacagagtccaaatataatgtgtagccctggatacatgggatacatgtaagcatttctctctacaagggcctctgactaagaaatggtaagcagatttgctggagatggaatcacttttctccagagaccaaagaggtctatattgtgattctcctatgagggcttcacataaatttcacacaggttctttctttggaatagacacttctaatgtcatagagtttggcaaattaagttaagcccatgtctacctcccctccagtgatgggggtctcttttgtcagccagctagcaggcaatccatgtccaatatttcatttttgcctttgtattgagaactacacctagcatgagctatgctagtttgaatttcatagagtagtattcacggcagagaaataggtttgtgagttggtacactcaggacacacctgtatgtaaagaggaagggaggataggcaagaaggataagctgacccacaggtaattgtacctaagggctagtcatacttaaggggaattctgaagctttgattgtcctacagagttatcctaacagaaacaacagggtcagacatttatatttctatatcacctaggacttcaactgtgaccaaggaattcattatgatgggtaaaaaggcaaatcggcagcagcaggtaccccgagcagctgggagatgggagtgctaaccctgacctggagggagcaccccgtattcactacacggactgcgatgctaaaaagtagttggataagaaaaaatgagagcgattgggaagagaagatagatcagtttcagaggagactggaagaaaaaaatttcaatccagaatattgtacaaatatactttggaaatgataaggtttaattaattttgaatgaaagaaagtgatttgaatatatgaaagtaaaactatatttggaaaaacaaagagaaccgtggaaagacatgcttagttttctctgctaagtggagggggctatgccacatattgagtgaggccgaggggatgaaggcattaattagtgtgaaaaagaacactgctatttaaaaggctttgaaataatcaaattagtgaaagcacatatctcttcaaaggatttaagcattcacagtaaaaaattatttctgcttttattatttcacactattttggcactactcagcactctgtttgctctgacattaggggcattacatgacaaaagctttatgcattaacgaagatgaacaaaaagattataggagcaaatggaacaagaggatgtgttttgcagacgtgatataacctagaactagcagtcagcatatgtaccattaatggcattgaaaaatcattatagacattcataaggatatgttgtctcaaaatgctatgaattttatgacatgtttaagatgaaataaaaagaatttttaatgaatacagaaagatccatcataaaatatgaaggaggcaatattcatcttcagaaagttcttacttctgcttccatatcctcccagaagcatcaccattagtacttgtattcaggtgacttctgacattcaagtttgccatcagcttactgttctattggaagaacgctactaaactagtttgaaataatagaggaaaaaactttgcaatctacaaagcgattttatgagcattattatttcacccctttttacactcacctttaaagtagaatagtcagacattattacttctaatttacagtaaaatatgatcaggctctaataaattaagaatcttgcccaaagtcatgtggcttataagtagaatataaaattcagattacattttagggtttgtggctctgagctcagtattcatctttatttcagtacactgccaacaacaaaatacatgatcattcctgggatatatgcattgtaataggggaaagcatcttaatttcctgatgatggagttcaggccagtgcctggagaagagggcacaaaaggagataaacaggagagagtggtttctggtctttagaatccccttgatctcattcgatgtaggcaactactgattatcctagagtgcatgaactttaccagtatgagaaaaagggagacaaattggcatatttttttgagagttttagtatcattatgcaaattagtaaattctacacatattttatacagatctcattactatatcttgatttactttctacctgattgaaaagcttttgacgccaaaaattcttgctcctgtgtttcttactagcacctggtttctaaccaaatcaaagtgaattaaataagccatcccactctacacgtacttctaacagcttactcaacactctcctgtctgggtctacctcagagccagctataaggcatttacaatggcactcacaatttgcattacagagcaatgtaaactacatgctatcaaaaatggtgatgtctgctcatccttttcatcattaatattcttaacacaattgccatagtgtttatcagaatcttaggaacaaaatattggtaaaagaaataagactgccaataagtccttgagtttagccatttttcagaactttataactttcattgacaataattttgacttaggttattccaaattggccttagtaaatttctttgagttttacaagtttacacaatttgcctacgttcttgtctcttttcctagtttactgcattatcttttagctgacaagtccttcagttaagtatattcattaacttctttatatccatctttggggtatcctactgatagccaaggattcatgcttcatattcaaaaatgtatcaaacctctttcatatgactctaatacacattcttatagccagaggaactttattatgagtttttaaagtctgttcactcttaaaagtacatctagttgaaatagcaaatacctgtttaatagtgtaattactatatataaaatatcatttcaaatttataattataatttgagaatttcaaaaccttgcatttatagttaagccaagctaaaaataaagtatcttgtccaacactacacagtaggttaatgtcaaggcgtgctacaaacagtgaggtactttggcagacattttttctctatttgttacaggtgtctttgtttgttttaacataaaataaatttcacgtccttatgtttcccctaacattatattacttgcatttttccgtatatctacataatactcatcagcattattttaacacaaaatgtttagaattttcattttttgatattcattaataataaggtgtttaacatattcctttacattttatatattgtatttccatacaattaatttttataaatggaatttctggatcaaataatattaacattttaagggcttaaaatatatatttaaaattgctgtactaaaattttacaacgtcatcaacaatgttatgtaaatattttttccacataaccttactagctttagttaatataattttcagtgatctttactaatataatgatgaaaaaaacagtctctgtaatattaatgcagtcttcttgatttctaatgaggttgaacaggttctcctatggttgttaacaaaaataattgtttttccttttttaaaaaataacatctttctgcaatattttttgtattttgtgtatttttttcaacttttattttagatacaggaggcaaatgtgcaggtttgttacatgggaattttcatgatgctgagattcaaggtatggatcctgccactcagactgtgagcatagtacctgatagacagtttttcaacagacaaccccctccctacccctctagtgttcttcagtgtttattgttctcatatttatgttattttatgctcaatgtttagctctccttacaaatgagaacatgtggaatttggttttctgttttgcatttaatttgcttaggattatggcctccatctctatccatgctgttgcaaagggaaagattttattcttttttatgaccatgtagtattccatgatgtataggtaccacatttttttttccaatctaccattgatagggacttgggttgattccatgtctttgcaattgtgaatagtgcagcaatgaacacatgaatgaatgtatctttttgatagaatgatttatagtcctttggatatatacccagtaatgggatatctgggctaaatggtatctctgttttaacttctttgattaatcatgagactgctttccacagtggtggtgcaaatttacattcccaccaacagtgtataacactctcttttctcttcagccttaccaggatctgttgtttttgacattttaataatagccattttgacaagtgtgaaatggtatctcattgtggttttgatttgcatttctctgatgattagtgatgctgagcattttttcatgtgtttgttggctgcttgtatgtcttcttttaagaaatgtgtgttcgtgtccttcgtctattttttaatggagttttttcttttctttatcaggtgcttagagtttttcttacattttatcgtattttatactatatagcattatgactattatttttcttttaatattggttaatatgcattaattttactaaatgaatttgtaatttcttattactgtcatgtctaggacttcatatatttccaaaattactaaaaattcacttatataattctatgtaatttttctataacttagattgcttaaattactttactttttgaaatatgagagatttgctttaaaggaagttatgtgatgaaaaacttaactttaaaatattttttccaaagacttaattgccccaaatagttttattgtgaaagggatactatataaaatatatataaaggaaacattgaagatgaattgaaatgactggatattgcttttcaataacttgcataggttaatgtagtaagaaacaaactatagacatttatttatacagagactattgcttctcggccttttggctaagatcaagtgtagtatttatatagagactgacatcttcaggatagtgacagtatctttttcattctaattatctagcaaaatactcagtatatactagccacttcataaatatctgttgaataaataaattttttaaatgaaattctatattaatttattctgcctcaatatcattacatattacttgaaaattctcccatcattattgacatatctatgattttaatgtttcactatgtatttttaaaatataaaaattttaattagtatttgctttgaatggattttgaactatgttgtttccagaatcttttctttctaaatggtggcactttctctctctctttcgctctctcatctctttctctgtctctctctctctggagatatatatagatatgtatatatggacatatatatatctctctatatatggacattatatatctatatatatggacatgtatatagatatctatatatatggacatatatatagatatctatatatatggacatatatatagatatctatatatatggacatatatatatctatatatatggacatatatatatctatatatatggacatatatatatctatatatatggacatatatatatctatatatatgtccatatacatatatagatatatatggacatatatatctatatatccatatatatctatccatatatatgtccatatatatatatctcaaccatgcaacttgtaatgttaaacaattttacaattcagtggctttaattaatttacaccactgtataatcattactactatctgttcatcatccgaaacagaaactctgtaactattaagcaataattactcattcttcctgcccgacatattggatttaaaaaatgatctaactgtatgctgtacacaagaggctaacattggatctaaagacacaggtggtttaaaagagaattgttgagaaaatatattccatgcaaatgatagccaaagaaaagctaattttctaaactaatattagacaaaaactcctccaatctaaaggagcatgttctaaaccaatgaaaggaagctaagaaacttgaaaacaggttagaggaattgcaaactagaatagccagtttagggaagaacacaaatgacctgatggagctgagaaacatagcacaagaacttcgtgaagcatacacaagtatcaatagtcaaatcgatcaatcagaagaaagggtatcagagattgaagatcaacttaatgaaataaagtgtgaagacaagattagagaaaaaagaatgaaaaggaatgatcgaagcctccaagaaatatggaactgtgtgaaaagaccaaacctatgattgattggtgtaccagaaagtgatggagagaatggaatcaagttggaaacactctttaggataatatccaggagaacttccccaacctagcaagataggccaacattcaaattcaggaaatacagagaacaccacaaagatactcctcaagaagagcaccacaagacacataatcatcagattaaccaaggttgaaatgaaggaaaaaatgttaagggcagccagagagaaaggtcgggttacccacaaagggaaacccatcagactaacagtggatctctctgcagaaaccctacaagctagaagagattgggggccaatatttaacattcttaaagaaaaggattttcaacccagaatttcatatccagccaaactaagcttcatacccaaaggagaaataaaatcttttacaaacaagcaaatgctgagagattttgtcaccaccaggcctgccttaccagagctcctgaaggaagtactaaatatggaaaggaaaaaacagtaccagccactgcaagaacataccaaattgtaaaggccatcgagactatgaagaaactgcatcaactaatgggcaaaataaccagctagcatcataatgacaggctcaaattcacacctaacaatataaaccttaattgcaaatgggctaaatgccccaattaaaagatcaaaaaacacaaagaagggcattacataacggtaaagggatcaatgcaacaagaagagctaactatcctaaatatatgcacccaatacaggagcactcagattcataaagcaagttcttagagatgtacaaagaaacttagactcccacacagtaagagtggaatattttcacaccccactgtcaatataagaccgatcaacaagagagaaaattaacaaggatattcagaacttggatcagctctggaccaagtggacctaatagacatcaacagaactctccaccccaaatcaacagaagatacattcttttcagcaccacatcgcacttattctaaaattgaccacaagattggaagaaaaaacactccccagcaaatgcaaaagaatggaaatcataacagtctctcagaccacagtgcaatcaaattcgaactcaggactaagaaactcagtcaaaactgtacaactacatggaaactgaacaacctgctcctgaatgactactgggtaaataaatgaaataaataagttatttgaatccactgagaataaagacacaacgtaccggaatctctgggaggcagctaaagcagtgtttagagggaaatttatagcactaaattcccactggagaaagtgggaaagatctaaaatcaataccctatcagcacaattaaaagaactagagaagtaaaagcaaacaaattcaaaagctagcagaacacaagaaaaaactcaaatcagagcagaaatgaaggaaatagagacatgaaaaacccttcaaaaaatcaatgaatccaggagctggttttttgaaaagagtaacaaaatagaccactagccggactaataaagaagaaaagagaaaagagtgaaatagaaacaataaaaaacaataaagggcatattaccactgatcccacagaaatacaaactaccaccagagaatactataaacagctctattcaaataaaccagaaaatgtagaataaatggataaattcctggacacatacaccctcctaagactaaaccaggaagaagtcaaatccctgaatagaccaataacaagttctgaaattgaggtagtaattaataacctaccaaccaaaaaaagcacaggactagatggattcacagcagaattcaaccagagttacaaagaggatctggtaccactccttctgaaagtattccaaaaaatagcaagagagggactcctccctaactcattttatgaggccagcatcatcctgatagcaaaacctagtagagacacaacaaaaaaagaaaatttcaggccaatatttctgatgaatatcagtgagaaaatcctcaataaaatatgggcaaacgaaatccagcagcacatcaaaaagcttgtccaccatgatcacgtcggcttcatccctgggacataaggctgtttcaacgtatgcaaatcaataaacgtaatccatcatataaacagaaccaattacaaaaatcacatgattatctcagtagatgcagaaaaggccttcaataaaattcaacacccttcatgctaaaacccctcaataaaataagtattgatggaaagtatctcaaaataataagagctatttatgacaaacccacagccaatatcatactgaatgggcaaaagtgggaagcattccctttgaaaaccagcacaagactaggatgccatctctcaccactccaattcaagatagtattggaagttctggccagggcaatcaggcaagagaaagaaagaaaggatattcacataagaaaagaggaagtcaaattgtctctctttgcagatgacatgattatatgtttagaaaaccccatcgtctcagaccaatatctccttaagctgagaagcaacttcagcaaagcctcaagatacaaaatcaatgtacaaatatcacaagctttcctatacaccaataacagacaaacagagagccaaatcatgagtgaaattttattcacaattgctacaaacagaataaaatacctagggatacaacttactaagaatgtgaaggacctcttcaaagagaactagaaaccactgcttgaagaagtaagagaggacacaaacaaatggaaaaacatccatgctcatgaataggaagaatcaatattgtgaaaatggccatactgcccaaagtaatttatagattcaatgctatcctcatccagctaccattgactttcttcacagaattagaaaaaactacttcaaatttcatatgaaactgaaaaagagcccacacagccaggacaatcctaaacaaaaagaacaaagctggaggcatcatgatacctgacttcaaactatactacaaagctacagtaaccaaaacagcatggtacttgtaccaaaacagagatatagaccaatggaacagaatagaggcctcagaaataacaccacacatctatgaccatctgatcttccacaaacctgacaaaaaaaaaaaagcaatggggaaaggattccctatttaataaatggtgctaggaaaactggctagccatacgcagaaaactgaaactggaccccctttttacaccttatacaaaaattaactcaagatggattaaagacttaaacataagacgtaaaaccataaaaaccctagaagaaaacctaggcaataccattcaggacataggcatgagcaaagacttcatgactaagacacaaaaagcaatggcaacaaaagccaaaattgacaaatgggatcttgttaaactaaagagcttctgcacagcgaaagagactatcatcaggatgaacaggccatctacacaatgggagaaaagttttacaatctatcaatctcaaaaagggctaatatccagaatctacaaggaacttaaacaaatttacaagaaaaaaacaaacaaccccatcaaaaagtgggccaagtatatgaacagacactctcaaaaaaagacatttatatagccaacaagcatatgaaaaaaagctcatcatcactggtctttagaaaaatgcagatcaaaaccacaatgagacaccatctcacaccaattagaatggtgatcattaaaaagtctggaaataatagatgctgaagaggatgtggagaaataggaacacttttacactgttggtgggagtgtaaattagttcagccattgtggaagacactatggcaattcctcaaagatctagaaccagaaataccatttgacccagcaatccattactgggtatatactggatgtggggctgggggagggatagcattacgagaaaacaacatagataatggattgttgggtgcagcaaaccaccatggcatgtgtatcccagaacttaaagtataataaaaaaataaaataaatacaacgtggcggcatcactccatttgattttaaacagggctatagtaaccaaaacagcatggcactagttcaaaaccagacacatataccagtggaacagaatggggaacccagaaataagaccatacacctacaactatttcatctttgacaaacctgacaaaaacaatcagtggggtaaggattccctattcaattaatgatgctgagataactggctggccagttgcagaagaaattggacccctttttttgcaccatataccaaaattaacacaagatatattaaagacttaaatataaaacccaaactataaaaactctggaatacagcctaggcaataccattctagacataggactgggcaaagatttcatgatgaagatgccaaaagcaattacaacaaaagcaaagattggaaaatgggatctaattaaactaaaaagctctgcgcagcaaaagaaactatcaacagagtgaacagacaaccaacagaatgggagaaaatttttgcaaactgtgcatctgacaaaggtctaatatccagcatctacaaggaacttaaacaaatttacaagaaaaaaaaaacagccttattaaaaagtgggcaaaggatatgaaccacacttttcaaaagaagacatacatgtggccaaaaaacatatgaaaaaaaaaaaaacctcaacatcactgattattagagaaatgcaaatcaaaaccacagtgagataccatctcacacctgccagaatggctaccattagaaacaaaacaaaacaaaacaaaacaaaaacaatgctgacaaggttgtagagaaaaaggaaagcttttacctggttggtgggagtataaattagtttaaccattgtggaagacagtatggtaattcctcaaagacctaaaaatagaaatattatttaacccatcaatcccattactgagtatatactcaaaggaatatagattgttctatcataaagagagatgcacaagtatgttcactgcagcactgttcacaataacaaagacatggagtcaatctaaatgcccatcagtggtaaactagataaagaaatagtggtgtatatacaccatggaatactaagcagccataaaaaagaatgagatcatttacattgcaggcacatggatggagctggaggccattatctttagcaaaccaatacaagaacagaaaaccaaacaccacatgttctcacttataaaaaggagctaaatgatgagaacacatggtcacatagagaagaacaacatacactgaggcctatcagaggacggaggtttggagaagggagaagagcaggaaaaataactactgggtactaggcttaatacctgggtgacaaaataatctgtacaaaactcctccatgatgtaagtttacccacataacaaaccttcacaagaacttttcttttttttctgaggcagagtcttgctctgtcacctaagctggagtacagtggtgcaatctcagttcatcgcaacactcacctcctgggttcaagcaattcttcttcctcagcctcctgaggctggcattacaggtgtgtgccaccagtcctggctagtttttgtatttttagtagagatggggtttcgccatgttggccaggctggtcttaaattcctgacctcaggtgatcttcccgcatccacttcccaagtgttgggattacaggcacgagccactgcacctgaccaagtacccctgaacttaaaataaaagttaaatgtaagaaaaagataatttaacagtttctcacataacaaaacatactgttaccatccaaatcttattccatggtatttactcaaagtatctaaaaagctatgtcctcacaaaagtctgcacatggatatttagagcagttttattcataattgcccaaacatggaaacaaccagcattcactttagtatgtgaatggataactaaactatggtatacctggaaaatggaatattattgagcatcagaaaagaaaagccatgaaatggcatgatggaaacaaatgcacattactaagtgaaagaagtcaattggaaaggattatatactgtatgattccaactatatgagattctggaaaaggcaaaactgtgaagatggtaaaagaccagtggttaccagtgattgtgggaaagagagggatgagtaggtggaccacagaggatttccagggcaatgaaactactctgcaagacactgtaatggtagataaatgttattacacatttgttaaaatccatagtatttataacaccaaaagtgaacccaaatgtaaacttaggactttgaaggataataatatcaatgtaggttcgtagattataacaaatgcaccactctgtttcttttgcttattatttctgtgaacatgaaactgctctcaaaaataaaatctattattaattttaaaaaaatcatacacacacaaaattaaccaactggatctaacagacatatgcatgccatatattcaaccacagttgaatacacatttttctgaagggcacatgggacattcttcagattagaccatgtgttaagacacaaaatacgtcatgatagattttaaatgattgaaattatacaaaatatcttttctgctcacaatggaatgaaactaaaaatcaataacagaagaaacactggacaatccagaaagaaatggaaatcaacacactcctaactgtcaactggataaagaagaaaacaaatatttagaggaaaatgaaagtgaaacacaaacataccaaaatatatgagacaaagcgaaagcagtactaaaagggaaacttgtaggagtataagtatatatatattaaaaaagaggatgaaaacaaaaactcatctaaaaataagaaacatcacaaatcagtgacctgacattacatcttaaagaagtagaaaaagacgagtagactgaaagctagctagaaaggtgaaaacaataaagattatagttgaaaaaaataaaatagatactagaaagtaatgaagaaaaatcaacaaaattaaaggttggttccttgaaaaaataacaaaatttataagtctttagcctgattgtctcaacaagaagacccaaattactaaaatcagaaaaaaagagaagagacattttgataatattgtaaaaataaatggattaagagacaattttatgagcaattgcatttcagaaatttgataacctagatgaaatagataaattcctggaaatatacacactgccaaaagtgaatgaatctgtagctattaaggggattgaatccataatcataaatctgtcaacagagaagaggcctggaccacatagctttattggtgaattttaccaaacattaaaaaaatcaaagttattctcaaattcttaccaaaaaaaaaaaaaattgaaggagtgggaatgctttgtaagtcattctgtgaggccaacattaccttgacaccaaagccagaagaagatgctacaagaaaagaaaatagtagctcaatattcctaatgaatattaatttaaaaaactctcaaaaaatactagcaaacagaactcagcaacatattaaaaggattatacaccatggccaagtagtatttattaatgaaattcaaggaagattcaatatatgtaaatcaatcaatgtaatacaacaccttaatagaatgaagtttaaataaaaatacaagaatcttctcaattaatacagaaaaatacacttgtcagaacgcatcaacctttaacaaaaaaacttaataaactaggaatagaaagatatttgaaatatgaaaaacgacccacagataatattatatccaatgctgaaagactgaaagttttctcctaaatcaggaacaagaatacttgctttgacttcttctgtttgacatggtattattgacagttttagccagagctattaggcaagaaaaaaaaaaagccaaagaaaattgaaaattagtaaaattatctctgctcacagatgacataatcttgtatgtagacaactacacacacaaacacacacacatcagatgtattaggccattcttggatcagtataaagaaatacctgagactgggtaattcataaaggaaagaggtttagttggcttactgttcttcagcctatacaggaagcacggtgctggcatctgatggcttctggggaagtctcagggagtttttagtcatggtggaagatgaagtggaagcaagcttgtcacatggcaaaaataggagcagagagagagagagaggaggtgacacacatttttcagacaggatttcctatgaacccagactgagagctcacttattgccaaggggatggcccaagccattcgtgggtgcagatctttcagatatctgcccccgtgatccacacacctcctataaggcccctttccaaacactggggattagatttcaacatgagatttaagcggggacaaatatccaaactaaataaccacacaaaacctgttttggctaatacataataatagcaaagtcacagtatacaaaatcaacacacatacaaaaagagttgtgtatctatacactaacaatgaataatctggaaaagcatttgagaagacaattttatttacaataacataaagagaataaaataattggggatatacttaaccaagtaggtgaaagtcttgtatactaaaatctacagaaaattgatgaaagcaatataaaagaaacaacatcctgtgtttatgaattgaaagacatattattattaagatgacaatatgatacaacgcagtcctcatcaaaatgtcactgatattttttgaagaaatagaaaagtccgtcttataactaacataaaattttaaggatccccaaatacccaaaacaatcttgaaaaagaacaaaagttgtaggtctttgacttctgattacaaaacttattacaaagctatagtaattaaaatagtgttgtcctgtcatagagacagacataaaaacatggaatagaatagagatcacagaatgaacctcatatgtatggtaaaatgattttcaacaagggtgccaagaccatccaatgaggaaagagcagtgttttcaactaatggtgtttgttagtaaaacaaaatactcacctgcaaaaggataaagttagaccctggccttataccatactcaaaaattaactcaaaatgagtcaaagacctaactgtaagagttaaaatgataaaacttgtagaagaaagcataggggaaaagcttcattactttaaatttggcaataatttctttgctatgacgccgaaagctcaggcaacaaaataaaagatagataaattggacaacattaaagcgaatgacttttgtacatcaaagggtactacaacagagtgcaaaggtcacccacagaatggaagaatgtatttgcaaatcatatatgtgataatgggttaatatccaaaatgtataaaatgcttatacaactcagtaacaacaaaacaagcaactcaattcaaaatagaacatgagtagatattgcaacaaagaatatatacaaatggccagcaagcacacaaaaagatgaccaacatcactagccattagtgaaatgcaagtcagaaccacaggagttaccactttacattcattgggatggcaaaaatcagaaagaaaacaaacaaagttgttgatgaggatgtggagaacctcataaatggaagagtaaccctttctttcacattgctggtataattataaaatgatgtagcctctgaaaaacatttggtggttccacaaaaagttgaacataagttaccatatgatttaacagtgcagcttctcagtatatacaccaaagaattgaaagcagggacttaaacagatacttgtacaccaatgttcatagaagtatgactcacagttgacaaatggtgaatgcaactcaagtgtcggtcgataaatgaatggataaacaaaattgggattttcagacaatggaatattatttagccatggatgggcctcgaaaaccttacgttaagtgaaataagccacacacaaaaggagagatgttttatgattccccttaaatgaaatacctagaataggcaaattcttagagacaggaagtagaataaagggtgcctggggcagtggggaaagataagtgaagacatatgattaatgggtacagagttcctgtttaggatgaaaaaaatattctgtaaatggctagtggtaatgattacacaacattgtgaatgtatttaacattcttcaatcatacatgtaaaaatcattacgatgctaaattttatattatgtatattttaccacaccaaaagaaaatgtgaatgttctttttatttttataattgttaatgttaaataataatttgaaattagaaaataaggaattatagataatgtaaaaatacatgagtatattctacttaattttgactgttcttatacaaatgttttagtaataaagtaatcaagatatggagttttagtactctaaaagtcatgcttttcttcacatagatctatgttgaaataaactataaaactgtgttaagaccagctaccccagctgaacgaacacacacaacacatcacactcaaatcacatgccttaaatgaaagcctctcagggatatccactggcatcattaacaaaaaactgtgagtcctttttgattcaaagaaaatctttggcctatctattcatgagaaaaacatcgaaaacattacaataggtgctagtctacaaaatacctgacaggactcctcaaagttttcaagtacagtctgatgaggaactgagaacctgtcacagccaagtggagcctaagaagtcacaatgaataaatgtaacatgacaccataacagaaaaagacattaggttaaaactaaagatatctaaataaatgatagaccttacttaataatctgctgatattagtttattaactgtgacaagacaccatactaatgtgagatatcattaattgggcaaactgggtgtggagtggatatgaactttctgattgtcttaacatttttgtaagtcatatatatgtataatatatatttgcatatacatattgtaaatatatataatatataatatattatattgtaaatatatataatatatattatatatatacacatatgctttttattttccctgcaaaacatctttagacttgtaggatgggttcaatgtcattatgtagtcaaacaataaatgcaagtttacttttttttagtgcttttgctcttctgcagattgtatgctatctaaatatgctattgtgatattggatgatgaggtatagtcaaaaaaccttatagacttctggaaggaattctgatctagtaagaaatgaatttcattataaaactattagctccagattaacaccccctcaggtattcttggagctacaaatctggaaaagtagtataatgcactgtaggcctatataaattgaaaaattgtctcctgaaagggggtagcagaaaatattgacttcaatcatgaagggttatgcttcagtaattccttgttgcatctttctgaaatgatgcactgaactagtagaattgttcagaccatggacttaaactttttcttgagcgtgctactcatattcctccacatttgtcaaactaagggtgcctcagaaatctagcttaagtactacaagtttttttgtgcatgtgtgttttactcttaaaaaattggcgtataaaaattaatatttaagaacacatataaagtaaactgggtactaggattctaccttatcatatgcttaccttatgtattagttatacaattaaggtaacattctattattttatataatctccatgtcgaattttccttttacctctgttactttaattcttaaattttgatcttgttttagtattaatctgttgaagaaaaatgccaaaattttaatttcaaaaacaaaaattttcacacttcgttccttccttctttctttccttcctctctttttctctttctctctttctgacagggctcactctgtagtgcagtggcacgatcacggctcactgtagcgtcaaccactgggctcaggtgattctcccatctcaatctcccaggtagctaggcctacaggctcatgccatcaagtccagctaactttttgtcttttttgtagacagggtttcatcatgttgcccaagctgtgtaagacacaatttttttttaaatgtaaggtacattttttccccatgtaccaagataggaaaaaagcaaaaacacacactttattgagttgaaggtgaaagttgcagtttttttgtctggcattgttaccactcaccattaaaatacatatgtacaaatggagaccatgggtaatgtctcctaattataaacctgtaatatctaagctgaaaatattaccacgaggaaaagttatgcatatgaatatttactgtggaattgctggttggagataaacattttctcactccatttacccttaaatgtatttattggaacctttaccaatctcattttctcagtgtcagtgtgagataatcttggagaacaggcattttaccaggaattattttacattttgctaggtgaaggggtactactttctcattagaaactctgcttaaagaggctaagaccttaagaaatctgggttttaaggatcactggtgatatgttaaaattggtattcaggatatgtttaactataacttgctcttcatatgacagtgtgaatgtattgacataagtgctaatttacaggcatacctcattttatcatactttgctttattgtccttcacatatactgtgtcttttacaaattgcaggtttgtggcaaccctgcattgagccactctatcagctgtttttccaacagcgtgcgcttactttgtatctctgtgtcacattttggtaatgcttaaaatgtttcaaagctttttaaattacatttgttatggtggcctgcaattagtaatatttcatgttattattgtaattattttggagcaccatgaactgtgcccatataagatggtgaataattttaaccaaaaagatgtgtgttctgactgctccactgaccgtttcccacctctctccctgtacttaggcctccctattcccacagacacaataatttgaaaatcaagctaattaataatcctgcaatggactttctaagcattcaaatgaaagactcacatgcctctcactttaaatcaaaatctagaaatgattacgcttggtgagaaaggcgtgttgaaaacagagataggctaaaagctgggcctcctgtgacaaacagttaagcaagttgtgaatgcaaaggaagagtttttgaagaaatgtaatactgctactccagggaacacatacatgataagaaagtgaaacaggctttttgctgatatggagaaagtgttcatggtatggatagatcaaaccagccacaacattcccttaagccaaagcctaatccaggggaaggctctcttttcagatctatgaaagctgataaagatgaagaagctgaagaagaaaaggttgaagctagcataagtttgttcatgaggtttaaggagagaagccatctctacaccataaaagtacaacgtgaagcagcaagtgctgatggagaagctacagcaagttatccgaagatctagctaagatcattgataaaggtggctacactaaacaacagatttttagtgtagataaaacagccttatattggaagaagatgccatctgaaactttcataggtagagaggagaagtcaatgtctggcttcaaaacttcaaaggataggctgcctctcttgttgggaccaatgcagctcgtgactaaagtatagccaattctcatttaccattctaaacatcctaggacccttaagaattgtgctaaatctaccctacctgtactctaaatggaatattaaatcctgaggaacatctgtttacagcatggtttactgaatatgttaagtccactattgacacccactgcttcgaaaaaacaattcctttcaaaataatacggctcactaaaaatgtaccaaattatccaagaactctgagggagatgtgcaaggaggctaatgtcttcttgtctgctaacacaatatccattctgcagtccatgaatcaaggagtattttcgactttcaagtcttattatttaagaaatgcactttgtaaggctatagataacatagataaagtgattcctctgatggatcttggcagtcaattaaaaactttctagaaaggattcataattttagatgccattacattatatatgattcatgggaggaggtcaaaatatcaatataaatagggatttggaagaagttgaatcaattctaaaccctcttcggagacttggagaggttcaggacttcagtgaaggaagtaaatgcaaatgccatggaaataacaagaaaactaaaattataactggagccttgaagatgcaactgaattattgcaatctcatgataaaactttggtgagtgaggagtttcttcttatggaggagcaaagaaagtggtttcttcagatggaacctacttcttatgaaaatgctgtgaatattgttgaaatgataacaaaatatttagaatattacattaatttagttgataaacagcagcaggatttgagtgaattgactgcagttcagaaattctgtgggtaaaatgctattcggctatattgcaggctacagaaaaatctttcatgaaacagtcaatcaatgcagcagacttcattgctgtcttattttaagaaattgtcacagccaccccaaccaccagcaatcaccatcctgatgagccagcagctgtcagcatcaaggcagcaccctccaccagcaaaaggactacggctcactgaagacttgaatgacccctggcattttttagtaataaattatattttaattaaggtatatacatttttttaggcttaatgtcattgtacacttaatagactacagtatagaaacaaacatcacttttatatgcattggggaaccaaacaatttctgtgactcacttcattgcaatacttgctgtttcgtggtggtctggaacaaaatccacaaaagccctgaggtatgcctgtatataccccgaggtatgcccgtatatgcttttatctatcacattttattctgaaaaagatgtgagacatatactctgttctttctttactattttatcagcaacaatagcttaaataggactgcactcagaaaatatttgactatatcagctatgttttgttgatctatttagaaaccataagaaatcatttaaaaaatatttgaaacaataatttgttaaaagtattttctatcacatatttaatgagataaaggtatgctaagataaggtaaaacaaactacatggtgtgtgatcatgtttgaacacacatacacaattttcttctttaatgatttatatctttggtgttttactttggacatgcatgtttttagtttcaggacataccaaagagtgaactgctgcacctgctcccaggaaatatgatttatgatacaggatagacaaaaacttgttatagacaattcccacttattgccaatttcaccttttatatctccatttttgttatttggaaaggcaacagatttctgttactttctgcttcagagaattacatttgtagaatatgtttctgaaagaggctctactttccaagatattacagactgatgcagatgatggctctataaaatgcttattctgcatctcatgaaagcaccatgtcagtttttgtcataagggtttattcaagctaatatgtcatcttaataaagcgaaggttattagttgagcttcaagatgaagttccagaatgatcaattcaaaatcactttgtcacttctattgaaaaggactcaatgaaacatacagtgcttattgactgtgcacataagacaagatactaagagcaatttatttttatgcatttttgcaataattatttcatggataaaatatttctgaaaattaaatgataatattgaatcacaaatgttaacatttgataaatatttttaaatttcattttaaaatattgggacatagtactaactttgtatgattaacttttaccatttaaaaaagaactatttcttgatttgaaagcagatattaattccaccgacttacattgttttttttcccccctttaggctgtcctttggaggtataaattctctcagcttaaaggttcttcagatgatggcaagagcaaaatcaaatttttgtttcagaatccagatactaaacagattgaagcaaaggtaaacccaagaaattcatcacataacacctctaactacattaatgccattaaggaacaaagaggggaaactttcggggaatcacaagaccaaaaacacacattctctgctcatcttgaaatatccgtcatggccagaagaataaacttactttaagattttattggcaacttttcacttaaaggcagcacttaaaataaattacacaaaactaattgcatttcttagttttaattccttatgaactgcatttttgtcacactaaaataacatcctgggaactaaagcagtcctttggtagtttcattctaaataataatttaaaatactttgtaaaaatctgactatatttacataaatttatatatttacattttatttacatatattttttcacatattcaaaatctgcattattttcattactataatataaaattgacaataacaatatttgcattagaataaattataaatgcattatcccagtatagagaaaagggtaaataacaaagtgaaaaaattgtatctatggacatgaaagctcaatataatttttcaactatgaattaacattaccatatttctattatacccctttacttattaaattcagggctaagaagccttagcctgacattcagaaccttcccaggaatgtcccttgatgatatttttggcaaagtatcctgtaacactgctctatgtttagattagacactctccttcttttaacaaggtgactccttgtagcctgatgtatcttctgcttttctctcaactgttttccttagctttttgtctgagtatctctcgagatgtcccattcttgtctcttacttgtctttggactcatcttttctgcctcttcctagttcacaggttgtgtaatgtgggaactgtgtcgttcctacagcgggctcctttgccactgcatgtgtttccagggggttgcctcactttgtctcccatcagtttagacaaatgccttgctaacttcttccactccctttattttacatgcctcacaagtttttagcttacatttctaacacagcctcttccctaaatatagacccatctctgcaccggccctttctctacctctcgctactgctcctcttctcccacctcagctaccactgatcaatcatttactttgtgccaaccacttattttgataatatcaaagaatgcattactcttgtcaaattttttttacctttagctcttggtatatttcttaatctttcaaagcacagcacaaattttaatactggtgaaagatgttaatattgtcagttctgtattattctggcatttattctgatggggaacctcaaccaccagttgctgacagcggtacagtattcagttgcttaccccaacactttttaatgagctaacaaaccctttgcaaaggaacaagagtgataaatgcaatctaatggctactaactatggtatttagatattaatttagtgtagcgtgtattatacatgcaattaattatactgacaagtatactagaaattacctgtcagctactaagcattattcattcttgtaatttttgtgtttttaagctttctctcatatgtaattcattaagagatagtgtaagaatagatatttggttgagtgtaattctcgaattgataggaagtaattatggaatagaaaaaaaaagtagtcttaaaaataatgagactgtgacatttggtgagttgttgaaattctttaaagtcagcatctccctttataaaataaaagaaaataatacctccataggtaatactgaaaatacccaataaaatatgatgactatttaaacaacaataatgctagacaatcagaatgttggccagccctacagaattgtttaaccatacttgtgtgtatcacctgaacattacctctgctgacataaaaattgtgtaagaactggaagcaggacatttgctaactattgtataacctctataaccatgacttgtgagcagtaagctaacataccatcacaggagcaaaacaatcgtagtgtagatgttcttgtgtggacataagcttttatttatctgggataaatgcctagaagtgcaaattgcaccatagaatagaaaatgtttgtttagttttaaataaaatgccaaattatattctatagtggctacagaatatagataacattttatatcctaccaataatgtataaaagatccagtttctctacatccctgcaaggtttgggtattgtcacttaaaattttggttctgctcatcatagtcttcatttacatatccctcaagtctgataatgatgaacaacttgttatatgtatgttatatcctctttgttatatgccatgtatgttatatcctctttgttgagaagatttctcttcctgtttcttgcccatgttctgacaatattgttagattataattttttggtgccttgtctctgtttttctgttaattgtgctagaggtttttcaaagaactacattaatttttactgatttttatattgtggtctgtaatccattcaatgaattctgcccttttaatatttgcctattttttagttgctttggcttttattttgctctcatttttaatttttttgagataatattttagatttctgatttgaagtgtcctttctaatataggatttagttctataatttccttgttagcactgcatttgctgcatccccaaaattctgacatcttgtgtttctattttcatcggttcaatatgtttttatttcccttaagtctttctctttgacaaatggatttttttcctttccttttttaaatagactttagtttttcagagcagttttcagttcacagcaaagttgagtgtaaggtacaaaaatttcctgtataccacctgtccctacacaagcacagccccctctgtagtcaacatcccccaccagagggggggatgaagttatagctgatgaacttacagtgacacatcattaccatccagagtccatagttcacattacagttgactcttggtgttgcatatgttatgggttttgatatatatagtggcagttatctgccattatagtatcatagtcgtttcactaccctaaacatcttttgagctcttcctattcacccctatcttccccccaccccaagaaaccactcatttttaaaacttgtctccgtactttttcctttttcaaaatgtcatatagttggatcatacaatagttacccttttcatattggcttattttacttagtggtatgactttaagtttcttccatgtcttttcatgacttaataactcatttctttttagtactgaataatatccaattttctgaatgtacaacagtttatttatccattcacctacagacagacttctttgttacttccatgttttagaaattataaacaaaactgttctaaacatccatattcaggttttgagtggacataagttttcaacttctttgggtaatatcatggagtgtgattgctagatcatatggtaaaacagtgtttagtttttttaaaattgccaaactgtcttccaaagtaattgtagaactttccatctccatcaccaataaatgaaagttgcttttgctccacaatctcaccagtaactgttgttgtccatgttctggatttggaccattctaataggtgtgtagtggtatattattgttgttttaatttgtatttatctgatgatatacaacgtggtgcatattttcatatgctaattttcatctgtatatattctttggtaaggtatctgttaaggtttctggcccatttttaatattttcatacgctaattttcatctgtatatattctttggtaagatatctgttaaggtttctggcccatttttaatattttcatacgctaattttcatctgtatatattctttggtaaggtatctgttaatgtttctggcccattcttaattggaatttttgttttgatatcattgagttttaacagttctttgcatattttccttagcatcttttatctgctatgttgtctgcaaatatttttgtccaatctgcagtgtgtctttttgctctcttgagaatgtctttcatagagcagaaaattttaattttaatgaggtccagtttatcagtcgtttcttttgtgcatcatgcctttggcatagaatctaaaaagtcatcgcaaaagtgaaggtcatctagactttgtactatgttatcttctaggagtttttaaattattgtcttttataattggagctgtgttccatttggaattaatttttgtgaagggtgtaatatttctgtctaagttctttcttttttatttttctgcattgcctgtggatgtccattttttccaggatcatttgttgaacaggctatatttactccattgtatttttttgctccttagtcaaagattagttgactgtatttatgtcggcctatttctaggctttctcttctgttccattgatctatttgtctgtttctttcctaacatcatgctgtcttgatgactgtagctttagagtatgtcttgaagttttatagtgttaatccttcaactttgatcttgtttttcaatagtgtgatggctattctgtgtcttttgcctctctctatatattttagaatcaatttgtcaatatccaaaattacttgctggaattttgattggaattttattaaatctgtagttcaagtttggaagaactgacatccagacaatattgagtctccccgtccatgaatataaaatatattccatttatttagtacttctttgatttatcagagtttgatagttttcctcttatagaatttttatgtatttaattagctttatattaacttacctgacatgtgaccgagaatatctttcccttttttataattttagtagaaaatctttggatttcccaccgttaagtatggtatcagctcttggtttggtaggtaatttttatcaagttgaggatgtcccccatctattcctagtttactgagagtttttatcacgcatgagtgtcggatgagttttctggatctattgatacagacatgtgatttttcttctttagcctgttgatttgatgtaatacattaattgaatttcaaattttgaataagctttgtatatcaactatgatagtggattcttccatttcttcttgaagttctgtcagtttagccttacatatttgtatgctctattatcaggtgtatacatgctaaggattgttacgtcttttttggataatttatttaccgttgcttaatgtccctctttttccctaaacctttccttgttgaagtctgtgccacctggaatcaataaaaactattgctttcttcaggttagtgttagcatggcacatctttctccattcactgacttttaatccatatatgcctttaacattgaaagtggatttcttgcagataacatatcatttggtcttatttcttcatccattttgacaatctttattttttaataagcacatttaagaccactgatgttaaaaataatttttgatacagttggatgaatatccacaatatttcttatccttgtgaatttattgcccttgttctttattcttattttagtcttccatgttttacagcttttgtagttttaacacttaacataattctattctctctccttattagcacaacagttatatattgttttacttttattagtggtagcactaaaccttgtaaaatatgtttacaactaaaccaagtccgccttcaaaacaacactacactgattcacaggtggtgtatcttataataacaaaatcctcctaattcctgcctctccttccttctattattgttgtcactcattttgcttatacacaatcctatacaatctaatacattgttattattttgaataaactgttatatgttagataaataacatttcatttgtttctcttttttagaatttgcattttctgcatacattgcttatttgttcttgcatgtggtctattttatctattaaagcttgtggtatattaatcatagttgtttcaaatgcttgttctaataaatccagtgtccctgccatatctgcacctggtcatgcttgccctatctctgtaaactgtgatgtcttttttccgtgtattatgatttgcaatattttcttttttaattgtttttattataatttaagttcagagataaatgtgcagaatgtgcaggtttgttatataggtatacacgtgccatggtggtttgctgcatccatcaacctgtcatctaagttaggtattcctgctaatgctatcccttccctgccccaccccacctcttgacaagctccagtgtgtgttgtctccttccctgtgtccatgcgttctcattgttcagctcccacttacgagtgagaacatgtggtgtttggttttctgttcttgtgttactttgctgagaatgatggtttccagcttcatccatgtccctgcaaaggacatgaactcatccgtttttatggctgcatagtattccatgatgtatatgtgccacattttctttatccagtctatcattgatgggcatatgggttggttccaagtctttgctattgtgaacagtgcagcaataaacatatgtgggcatgtgtctttatagcagaatggtttataaccctttgggtatatactcaataatgggattgctgggtcaaatgtatttctggttctagagccttgaggaatcgccactctgtcttccaaaatgtttgaactaatttacactcccatcaacattgaaaagcgttctccacattctctccagcatgtgctatttcctgactttaatgatcaccattctaactgacgtgagatggtatctcattgtggttttgatttgcatttctctaatgaccagtgaagatgagcattttttcatgtctgttggctgcataaatgtctttttttgaaaattgtctgttcatatagtttgccaatttttgatggggttgtttgtttttttctcataaatttgtttaagttctttgtagattctggatattagtcccttgtcggatggatagattgcaaaaattttcccccattctgtaggtggcctgttcactctgatgatagtctcttttgctgtgcagaagctctttagtttaacgagatctcgtttgtcaattttggcttttgttgccattgctttttttgtcttagtcatgaagtctttactcctgcctatgtcctgaatggtattgcctaggttttcttctaggggttttatggttttaggtctttgtttaaatctttaatccatcttgagttaatttttgtataaagtgtaaagaaggggtccagtttcagttttctgcatatggctagccagttttcccagcaccatttattaaatagggaatcccttccccattgcttgtttttgtcaggtttgtgaaagatcagatggttgtagatgtgtggtattatttctgaggactcattctgttccattgatatatatatatattggtaccattggtatatatatgtatatatatgtctgttttggtaccagtaccatgctgttttggttactgtagccttgtagtatagtttgaagtaaggtagcatgatgcctccagctttgttctttttgcttaggattgtcctggctatgtgggctcttttttggttccttatgaagtttaaagtagttttttccaattctgtgaagaaagtcagtggtagctggacagggatagcatggaatctataaattactttgggcatgtggccattttcatgatattgattttttctatccatgagcatggaatgttttcccatttgtttgtgtcctctcttattccctcgagcagtggtttgtagttctccttgaagaggtccttcatatcccttgtaagttgtatgcctagttgttttattttctttgtagcaattatgaatgggagttcactcatgatttggctctccatttgtctgtcattgcttataggaatgcttgtaatattttcacatttattttgtatcctgagactttgctgaagttgcttctcagcttaaggagattttgggctgagacaatggggttttctaaatatacaatcatgtcatctgcaaacagaaatattttgacttattctattcctatttgaataccctttatttcttttgactgattgcctggtcagaacttccaatactgtgttgaataagagtggtgagagagggcatccttgtcttgtgccaggttttaaaggaaatgcttctaggtttttgcccatttagtatgatattggttgtgggtttgtcataaatagctcttattattttgagatatgttccatcaataactagtttattgagagcttttagcatgaagggtgttgaattttgttcaaaggccttttctgcatttattgagataatcatgatcaacaaaatggatagacctctagtcagactaataaagaagtaaagagagaagaatcaaatagacacaaaaaaaatgataaaaagaatatcaccactgatcacacagaaatacaagctaccctcagagaatactataaacacctctatgcaaataaaatagaaaatcgagaagagatggatgaattcctggacacgtacaccttcccaagtctaaacgaggaagaagtcaaatccttgaatagaccaataacaagttctgaaattgaggcagcaattaatagcctaccaaccaaaaaaagtccaggaccagacggattcacagccgaatgctaccagaggtacaaagaagagctggtaccatgccttctgaaactattccaaacaatagaaaaagagggaatcctccctaactcattttatgaggccagcatcatcctgataccaaaacctggcagaaacacaacaaaaaagaaaatttcaggccaatatccctcatgaacattgatgcgaaaatcctcagtaagataccggcaaaccgaatccagcagcccatcaaaaagcttatccaccacgatcaagttggctttatccctgggatcaaggctgtttcaacatacacaaatcaataaacgttaattcttcacataaacagaaccaatgcaacgttttcctgattcagtcaggcatgacgtactgaataaaaggtgctgttacaaacttgccttcagtaatgttgtgttaaggtgggggaggggagtgttctacagcttgtgagtaggactcagtcttttagctggcctgtgcctctgaactgtggcttcacatatgctgctcagtcacccccgcttaggttggacaggatggctggaaggggttggagtagggtatttcccttctccaaggtgagttaggctctgataaaacaccagcaagttaggctcaggttacctagtttctcttgagggcaggccttgctaagaagaacatagtgcctgagctatttttttttttcatgatctgtggttttctttttaattatcttgtcttatgatcacacataattttaaaacttgtgtatatctcctctactttaatccttttaagttggcaaaagcaccattccaatcacaaatacacagcagttctacagttttatgtttctgaatggctgtttaaagacaatcctaaattataacttagtttgacttagattgtgaagaattcaagaatgaagtttaacttactactattttaaaagcatgtgaccttacagatcaataaaatgtaagaagtgttaaataatctttgatattacacataaatcacactaaaatgcctttcaataagtaaaaggaaccattttaaatatagggaattctaattacactggcatagttaaggccaaaaatataaagtagacattgctaccttatttatcttcaacccttgcctttaagaggcaaattaacacaaaacacaagtgaatcttgcttggttctgagacagtgaagaaatttcccccgtatttaaatatactcacataaccagttatataaatctaaatataaaaccaatctccagtaagttttaagatggtactcagcgtctttgtgaaaagttgaacattactaatgaagtctaacatatctttagaaggggtgaatagcgatagcatttactgaattggaattactattaaaattcaaaaactgaacatattcatttaaccacaagccagtctttgttttaaatcaggactgcccaacaaaatattctgtcagtcattcatgatctgaattctggtgtatgagatctcttaaagtatggtggacataaaaaactcacgggacattctgttttgtaataaataaggcagtggccaactcattagtagcttttttgagataagctatcaagtctgccctttctaccttcttaatgcaggcaaagatcatttttgttccaaggatgtgcttcttgggagtctccaaatacaccatcagtgtatcctctccccaggtgatgcctttgttcttattagcatctgtgtaagagaatccaacagcctgacctgtcttctacccgaagagaccatggagattaggcccagtcttgtgcttgcctcccttttccatgatgtggcactggacacacttctgaacaaagatcttcttgcctttctcaacatcacccatatttaattctcttttaagtctcttgagcaatgaaggttcctgctccgaagccagacgtcacactctattgccttagctatttttaaatgttttcccctcctaccagcagcattggggatttttctccaaaatccactatgagaatctggtcaagatcctggaagtaaaaattacagaagtgtggagacactgataactatgctcccctagagttcttatctctcagacttgtccacactgagcctccagcaagtcatcaatgatacttcaggcttccccacctcagcaccggtttctgcagaggtttttactcagtgatttctgttccaacaatccgtgattcttggaatatgactgtctgtccttccaattttggggacagtggttttccccaatggagataaggagagttgtcgatttttcagttcgtttggctttttccttgttgccaggatggggtagaaacttctaggttcttacacattgaactggaaacctgaagcccctgatactcagaattttagaaagggggtgtttagtttctaagtatttggggatttatctttctagagttgatttttagtctgattccagagaacatactctatatgatttcatttttttcatcctctgcatcatatatcatataattttgattgaggaagacacaaatatatggaaagaactcagaatggcatagattctcttctggcctctcttttattttattggttgatgtgtctgtttttattagtattatactgttttaattcctagctttgaaatacagtttgaagccaggtagtgtggtgtctccagctacactcttttggctcaagattgcctttattgtgtgtgtgtgtgtgtgtgtgtgtgtgtgtgtgtgtgtgtgtggttttaagagaaaagcatgaaagataattctgtgttcagggattggaaaaattaatgttgttaaaacgtctatattacccccaaaagattaatagattcattaaattttttaccaaaatttcaattttacttttttagagataagctctaaaattaatacagaaacacacacacacacacacacacacacacacacacacacacacacacacacaaaaataaccaaggcaattcctatacataggtataggaattaaaacagcagaatactgataaaaaaaaatagacacactgaccaatgaaacaaaatagagaggccagaaaagaacctgtgtgattatgatcaattgatttttacaatggccccaataatacaaaatgggaaaagaacagtctccaataacagggtgacaagaaaatggaattttcatgttcaggagaatgaaattgggttcttatctaacaccatatataaaaacaactctaaacattatatgactttggtctgggcaatgactttttggatttgcctccataagctcaggcaacaatagcaacaacaacaaaaaataaacaaacaggattatatcaaactctaaagcttcctcacagcaaagaaaatgaacagagtgatgaggcgacctatatcatgggagaaatatttataagctgtacatgtgataaggtgttagtaatcaaaatatataaggaactaaaacaacttcaaagtacaaaacaaataacccattaaaattgggcaaaggactcattttgagacatttctcaaaagaagacataataatggccaacatttatgtacatgtgaacctatgaagcaatgcttaacatcactaatcattaggaaaattagaaactcaatgggctatcacctcatatctatcaaatggctattatcaaaaaggtgaaagataagtgttggcaaaaatgtagaaaaaagggaacccctgtatgctgttggtggcaatgtaaatttatacaagccacgttgtaaactgtgaagagctttctctaaaaactgaaatagaaccaccactctgtgtagagccagcaatcccatttctgagtatatatgcaaatgatttgaaataagtatattgaagagacatctgcaatttcatgttaattgctactccactcacaatagccaacacacagaatcaacctaaatgtccatcaactgataaatggataaataaaatatggtatatgtatacataatggaatagtattcaaccttaaaaaagaaggacattatatcatagaagaatctgggggacattatgctaagtaaagtcagccagacacagaaagacaaatgttcccacttatatgtagaatcaaaaccatggaactctcagaagagaagtagtatttacagagactggagaatagggggaatggagagattttggtcaaaaggtacaatgttttgttagactagagtaagagatgataagtatctgaggggaaaaatgcccaagcttattactgggcctttgcaggcatgagtgggtatggggccatggcttttctgtagcatttggctaaagaatatcaattattgtataacagtttctgtcttgctagactgcccctctcaggtcacgtggctagaaggagtaggcttctcttaggtttactggtctgcatccattggtatttctgggctgccagcctctccactatcttgtttgggggatatgacacagagaggcaaacccagagaacttgtcacgtgttgtgagggtcctggggtctctgggttcttagtctgcctgcctcttctctctctttcagggtgtccttacattcattttatgtatgttgtccagggtttgtgatgatacttaggaagaggaataaggaaaagtacatctattctatctccaacatagtactatgtttatttttaaactgttaatgccattttttaaaagaaaaattatttgacttattttgattactctgattgttagtttctcactcttgataaccccaatgaatagtgacaaaaaatatttttaaagttgacagtggaagtaaaattatcatgtggctcttgttgtaactgctgagtagtctggagagagaacttttaacatgtagagacattgttatgtaggcttattttgtaaaataatgttttctataatgcaatgcctagatttcaccttatttttacacatatatgactcaaataagagtagattttatatgagtaaacaatactgaggaatttacgtggcttaagataatttaacccaatttaatttttacacagttattttaaacctcaaatgttaaatataaaatacctgtaaactgctgctaaattatgagttgcagtggattctattgaaggagagactggaaacccaggacagtttgttctggtggaggccactgtctgcataacaagaagctggttgtctccatacctcccttaccccattagttaccattcaatagaacatttttcatcccgaaaatattgaacaacattcattcatcaaagtcaaattttctatttcttgctctgatctctctttaccagactttagataggtaagctaataggtaactgtgagtgatgtctaaaagtactgttactaagatggtttcttacagtatttcaaaattgtatgtggcttgtgatgcaaattattttttgccttgcttactgctgatttgggaataataattgaaggctatcattttcacttaattttatatagcttaatagctatttgcgtgtaaagctttcatcagaacgtattataaatgaaatgtttgagtatttaagatttcattatgagaccaggcttgttttagagggatttaagattatactttacacatatttctacagaaaacaaaacattattttgggggtagaagcaaataatatttaccactttgttctcctgtgtccccatctcaaatatattgaaggcaagagaatatacctatttattaacaattaatgccaaaaattgttgaacttgtttacagaaacttattggaagattttacttatctgctgcccatatgtcctcccatgcatccaagaattccaacagtatgataagtaatttgcaaatctttgaaaaattctaagatataatatatttaataaagtgctacattttaaaatcaccatcttgatatgatatatttttgaagttatgattgtcaataaaagatcatcacccaaaagaaataaattattaataagtgaagagattttatttcatcaaagttaaaaagaaaaggtgagccagggtgtgaaatatgggtctgaaaatgtggttaaatgtggaggctgttacaacgtttctttccttttctaaggaaaataatctaagcagtggtgaaaatggttcagaatagacttagaacttaccatatgtgataatagggaaatactttcaacaaaacatgcattagtttaacaattcatatacatattcccagggcaaatacatcataaccagagcttatttaacaagaaatatggtttctttggggaatattattgcatgagccaccatatgtattacaacattaaacattccaaatagtgcttaattcattggttgtgagaaagcgtcagaaatactgaagaaaatcgtgtgggtttacataggaattgggagaactttgttttatctttttgctgttgttgttgttgatctatataagactaatgtcataatacaaaaaaccttttatactttcttcctctgatagcaaaaattcataaattcttacttcattactcagaaagcttaataaatttcccatctgttttccaaagcctaattaaacttctcagaacttccctagtggaacaggggagtggttcccaattgaagccttgagcggtattatagttttttttgacaagttacaaaagcttattttattgccactgataacttaaaagttgtttctatatataatattcatttagacactaatacagctaggcttactgatatattctcatagtcatttataactaaacattctgagtcacaatacttttctttactgcctctaatattatatgtttatgtatatgtattttttcttaaattataattggacttaacatggagagaaaatcccctgatttcaaaacgtgctgtattctacacacattggtgtagctttattcattgaatttcatgataattccccttatggaaataatgttaaaatatttcctaaactagtgtacacagcatattcgtctaaactactgagtttgagatctgaaagtcatgctagtgcattttgtacagtacataagagaagggaaagaaatttgcttctctatttagtggaacagtgcagaacttgggaagatttttaaatggagctgatcatcggaggctccttttccccaaacatctccttgccccaagtccccaccatctcaggtactacagcatcataagagaaattttcaaatatattaagtattagtgaaattcaagtcagaaattgaggattgactcccattaatactactttctggctagtctctataaatcttcattttctcattgtaaattgtgccttaaagcacctaccttaaagggtcgctctagagaaaaaaaaatgtttctgatttgaacataaggattgaatacataacaaaattaatggaacactttggatgctcagtttttcaaagctcctgactgaagaattcatgatgtgttgatgtttggatttcagaagaagatggctggtaatctaaatgaatccctgtttggcacttgagtcttataaataaggtcttttaatattcacaaggctgggtaggtatttgggatcaaggctctctttctgtcttgtaaataaaggatcagctttcagtctatctggcttttcacaatttgtgactctatctggtatctgaaaccaaaggttttctaaaattccaagatccctttccctctcatttccagctgtacaaagcactggctgtttagactacagagaagacaaaatgaggatgaggcagagcatctgcttaatagcacaggtcctgcataaattcatgtttggagtgcttcgttctgtaaaatagacttaagtagatagaaataagttaggacaaaaattgaactcacatttgtgcaggtgtgtgtttgtgtataacttccataatagcttattttatgtgaaattttatttcaaactaatgattgaattgagaacaggaatgtgtggtgaagaagatatctggacaagatagtgcctctctctcccttagaagagattttaaactcctgggaatcactgaggattctgaattatttttatttttcattgatatattttttctccttgcatataatttattttcaaatctcctattctccatcagaatagtgaatttctctacccgtttgtgttaagagtactctgtactcttaacactctgtacattttctctctcggtagactataaaatttgcattaacatcttatagataaaacaaatatattaactgcctccaaaatagtagctgtcaaagggaacatgcctatagtatgcagcattttgttttatcctttttgacaaaagtaatcatctacgaagagaagaattgtaaataaatttttagtaagtgacccaagtaagaacattttgaaaatcagaattttaaagttgaagaccttctggaagcaatttcccaggaagtaaagtaacaaaacacagagtgtagtaaccaagtactgtattatgttctcatagtaaggtaattgtaacaaaaaaacaccatcatcatcaaagcatttaagggtagaaataataaactgcatttcaactggaaaaacagaattatcctgaagctatacatatgtctatttataattatttgcacaataaagtaagactaactgtataaatttaggtctcctcatgccccaagtaagtttcttaactgcattcatcatgccaccttaacatttatggccataggtatcaagatattggctgacatattaatattcaccaaataatttaatatgagaagaacagtgtaaacctgatattgagatacaaatctcttattttatttacattaatttaaaagagataaagcaaaattttattaaacattgttctattacatcaaaatcctaaaagaacctaaaagattttgaagcaagcagtttagcagagataggcaatgtaataagtttctatttttatttgccaaactcagtaatgaggatcaggagattaagatacataataaaccaataatccaaatcacaaagagtacaggttatagtccttagaaacccataaaatagatgaagagagtaaaggatcaaaacaataggttggattctgatctatgcctataaacgctggaatgcaaattaattgatacttatggaccataaacattttgcaaattactgtgccttaggcattttaagaaatcaaaagtgaatgtgggctggattttcagaatggcatagtaatgacttttgaaattccactcttctggaaaggcaatgagaaaatattcataattatcagaatcaatgttattcagaattgtggaaataaattaaatgtttggaataaccatacagcatttattaaaaacaaaacaagcttcaagttttggtaagaatggagagctttgcaacattgtagcttattatattcctactaccctgtccagaccaccactgtgacctcgaaaatatgcatcctagaaaacatggtagctagctataagacccagcacctcagaacccactgaagggtgtgggctgggcttgcagattctaaaaaagcataatctcaagaagatcataatcatctgacctatctggaagcttcctagagaagtcaatttgcaggctgctatggttttaatatggcttctcccctctgaaactcatgttaaaatttgattctcaatgtgacagtgtgatgaggtggggcctattgggaggtgtctgggtcatagtggtgaataatgccctcttgtgggagtgggtgagttctcattctaggaggaaaaaatggattaatttccatgagaattggttgttaaaacaagtctggcttcacaggtttgtctctcttacttcctctctcaccatgtggtctctttgcatattcccacttcacttccactttctgccatgaggtcaagcaacctaaggcagtcaccagatgtggctgcccaaccttgaactttccagccaccataatcagagccaaataaactgcttttttaaaagataaattatccagtctcaagtatgctgttatagcaacacaaatggactaagaaaattggcatgcagagtggggtgttgctctacagatatctgaaaatggggaagtggcactggaagtgggtaatgactggtggctggaaaaatttggaggagactagaaaaagcctgtattgctatgaatgggatccttagggtgattctggtgaggactcagaagaagacaaaaagatgagggaaagtttggaacttcttagagattcattatgtggtcaggaccaaaatgccattagaaataaaaacagtggaagatatgcctattacacccttgcaaagaacctgactgcattatgtcgatgccctagtattttgtggaaggtcaaacttaagagtgattaatatttgacagaagaaaacttcaggtagtaaagcattcaggcaactgcatggttgcatttaactgcatgcagtaagatttaagagcaaagacatgacctaaaagcacaatttataattaagaggaaagcagaacgtaaagattttaaaaatttgcagaccaattatataaaaagaaaaggcatgtttggaaagggtgctgagggttgggtccagtgagtagttgctaaagagattagcatggctgaaaggaaacccagtgctaataatcaaaataatggggaaaatccctaaaggcatttcaaagatctttgaggccagtctcatcacaggctgagaggcctaggagtacagaatggttttgggggacaggcctaggctgttgaagtcctgtgctgcctcaggatgctgctctccacatcaagagcagccatggctcaagtggccccaagtaaggctcaagactctgctttgaaaggcacaagcagtaagccttggcatccacatggtgttgattctgcaggcctgcaaaatgtgagagctatggaaacaagcctttattgactgagatttcaaagggtatatagaaaaacctgcaggcccaggcagagacttgtcacaggacaaagccaccacagagaacctctcatagggcaatgctgagtggaaatgtggagttagagctctaccaagtcctcaccagcacaatgcctaggtgagctactggggccaccattgagacctctgaattatagagccaccaacaccatgtaatgcccacctaggaaaactacaggaaccaaacttcaatctatgagggcagacacatgtgtgacactcaacaaagccacgggagttgaactgcccaagaccttagaacacacccttcacaacaatgtacacagggtgtgagatatgaagtaaaataaaattatcctggagccttaagatttactgtctgccctgctgtgttttggacttatgtagggcctgtcatttatttctttttgtctagttttcccttttagaataggaacattgaataaatgtctgttatactattttatcttggaaataaataacttgctcttgatttcacagattcataactacaaggaacttgccctgagtctcaaaagagaatttggactttgggctttcaaggtgatgctggaaaagttaagacctttgggaccaaatggagggaatgattgtatttagcattgtaagaagaacatgagttttatgggggcagaggtgaaatgcttcactttgaatatggtttgttcctctgaaactcatgtcaaaatttgattcccaatatggcagtgttggaatgtgaggcctagagggaactgttcaggtcatgggggtagattcccccataaataaattaattccctgctgcaaaggtgggtgagatcttactcttgtggaaatgcattatttcccacaggagtggtttgttaaaaagagtctggcttcctcagtttctctgtcttgcttcctttctcaccatgtgatctctttggacatgcccactccactttccctttctgccatgaggtgaaacagcctgaaaccttcaccagatgcagctttcccaccttggacctttcagtcaccagagtaatgaaccaaataaacctcttttttctgtaagttacccagcctcagatattctattatagcaacacaaacggactaagacacaggccttgtcattacttgacctcactcagacctttctcattggaaaaattgctaacctaagtatttaacaatcaacagtttaagatcacacctacttgaattggcaataccagttgtggcaagaaagatgctggtgaaaaacttaagatctgaggaatgaggttccaatgagggtcttttagaagctccaatacattcctgagaacctagaagggcacatgaatgtgccgagctatgcacatgatgagaaaagatgccctaaactctcagttctggctagccttaaagatctgtgcaagaagaaagtaaagacttagaaagagttgtaaatttccagaggattaaagaagtgccacaaaacacacacagagccccatggaaaagttgtaagactttgcttctagtaatttacagaaatattggtcaaaacaatagatgaccaagaagctaaatagacagaaatagtctgtttcctatcagtgaaacagataggaaaacatcaacaacaaactgcaacagcatcagactcttgggaagaatgagaatctgatgtccaagaatattctttgaaatgccagttttaaacaaaaattatgggacattgaaaacattctcaaaattgtggcctttctgtaagaaaatagactcaatagaagctttctttgaggaaaaccagctggtgcacttactagtaaaataatttcaattgtgtattacaaatatattaactggtctaaatgaagctatgcccaaagaattaacctgtttgaccaaatagagaatgttaatgaaaggatagaagtaatgaaaagaatcaaataaaattttcagttgaaaagtacaattactgaaattttaaaaattctgagatgaactgaacaaaacatttgagtttatgaagaaagattaagagaatatgaagagttcacaatatctcaatgtcaatagggcaactgagattatccagtctaaggaataacaaaaatataaatgaagaaaaatagcagagtctcagaagtctctataacagcataagttatactgtcatatatataaagggaataccaagaaaacaagaagggacatggatagaaacaatattttaagaaataacagctgaaaacttctcaaatttaatattaatatacatatttgaagagctcagtgaactccatgtagaataaaaacaaaagacataaaattatcatgattcaccagcaaaaggccagagaatcttgaaaacagcaaaataaaaatgactcacaacatgcaaagagtcgttaataagaataacagctcattttttatagtaaactgtggaagttagaaggtaatagaacggcacatttaagtgatgaaacaaaaaggctgtcatataagaggttcttatttagtgaaactctccttccaaagtggaggagaattaagtcattattacatataaaaaaaagaacatttgccactagtaaatatacactacagaaaataatttttagataataacttgaatacacacttagaaataataaaaacaccattaaaggtaaatacataattcaatataagtgacagtataaatgcatttttattggtgttttacttctaattgatttaaaagaaaaattgataaaatgataattatatcactgtgtctttgggcttgtaatatataaagatgtaaagtgtatgacaataataacccaaagaagtggggggaacagagttatatagaaacaaatttttgagcactattgacgttgtcattgttctgaactagaatgttttaaaatattattatatccctccaaataactaataaaataactaatgataaaaatgggagaattaaaattatatgaatgtagtatatacttatatataatttatataaaagtgtatacatatatatacatgtacatatatagtgttataacccccaaaataaaaacagtaatggaaaaataaaggaacaaagataaaaacttatgatataaagtgaacataaattttaccttatgtataattgcattaaaagcaaatatattaaatatttcgaccaaaggcagagattaacataatgcatttccttaaatgatttagctatatgatgttctcatgagaacttgtttaaatttttaaattgaaaggtactctagtgtatatatgactacaatcaagagattgacagtgaaacagtcaaagcagaacacctgcatcctgatcctgttctatttttattgttattcagttcaatgtatttttttatttcttttgagactctcttgtatataaaggattatttataattctgtgccttcattttcaagtgtcagaaattatttttgttttctttctgtttctttcttctctggtcagaaaacacaccttctatgactttaattattttaaatttattgagatttgttttatgcccccagtatggtcaagtttctacagaaacttgcaaataatgtatattctatttgtattgtccaaaagttctaaaaatgttagtttgatcttgtcagttgatggtgttttctaattcttctacattcctgttgatgttctgtttaactcttttaccaattgttaagagagatgttgaagtcttcaatgtaattgtgtatttatccatttcacctttcaattctatcagtttctgcattacatactttgcatctaagttatttgatgcatacatatttagagttgatatgtttttcttgtagatttatgcttgtattattaattaatctgtctcatttcatccaataattttctttactttgaagtttagctcatctaatgctaatatagccactagtcacttttcttcatccaaaaaaatcattcttttactttaaatataactatatcattatatttaaagtgagcttgtagatagcatatatttgggtcatgttttttaatctattctgccaatctctgtgtattgattggtgtatttagacaacttacttttattttaattattgatgtgttgacatatttataattatatatttgaattttgttctctctcttttccatttttctgttttaatttttctgccttcttgtaacttttttgaatatatgcttttagaaatcaattttatccatagcatttttgagcatacttcaacatatactgttcttagtgtctactctcagcattaaattttgtatatatcttcacattctagtgaaatcaacatcttatcagttaggtgtagaaaccttaacatattttaagtctctttacctattttattatattttacattttataatatataatatattatagcttataatatttatatgttatatttaagcatatattaacatatacttatgtactataaatattgtttatatttataatatatagatatattatgtcttatatttcatattttatactattctttatataatattttaaaatatttcatttacatatagtaagaaccaaaccagacaatattacaatttttgtttcaatacccaagtataagttagaaaactcaaaagcagaaataaaatatttaaggatcacttttcttaccatattctttctttcttcctaagttccaagatagcttctataattattttctctttttgtcctttttaagccatgcttttaggataggtcttcttattataactttactttgtttttctttagctgagaatgtcttgattttcccttaatttctgaagcactattttgctggatataggattcaggattgacagttcttttctttcagcagttgaaaaatcttgtgccacttccttctggctgtatgatttctgatgagaaattctctgtcatttgacttgtgttctcctataggtaaggttttatttctctcttgctgctctcaagactttttgctgtcaagttttcagaagctgactatgatgtgtcttggcaaggatttctttgagtttatcctctttgtatttcacttagtctcttaaatctataggatgtattctttcaccaatttcaatgaattttcgctattacgtctttcaatatttttcagttccctaatttttgtcctcattttttggactctgaagacatgaatagcatatatatatatatataataatataatatatataatatatatatttgttttagtctcacagttcactgaatagtctttccttttttcaatctttcttacaacttttattctaactggttaattctcacaattcttttatccagttcactgactcttctgttctcttctttctgctgttgagccatctattcagttttttatttctgttattatatttatcagttctaaaattattattgtattcttttttatgtcttttatttcttcctagggtttctgtttcttttctgagactttctacactttcatttgttctaagcatggtgataattgcttattggaacaattttgttgtgactactttaaaatatttgtcaactgattctaaaatctatgtcatctcactgttggcatcttttgaattttttttccattcagtgtgagttttctttttttctctctctctcttttttttaattttttaaattttattattattatactttaagttgtagggtacatgtgcacaatgtgcaggttagttacatatgtatacatgtgccatgctgctgtgctgcacccattaactcatcatttagcattaggtatatctcctaaagctatccctcccctgtccccccacccgacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggccgcatagtattccatggtgtatatgtgccacattttcttaatcgagtctatcattgatggacatttgggttgcttccaagtgtttgctattgtgaatagtgccgcaataaacatacgtgtgcatgtatttttatagcagcatgatttatagtcctttgggtatatacccagtaacaggatggctgggtcaaatggtatttccagttctagatccctgaggaatcgccacactgacttccacaatggttgaactagtttacagtcccactgacagtgtaaaagtgttcctattcctccacatcctctccaggacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttctttcttgtaaatttgtttgagttcatagtagattctggatattagccctctgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggtttcaggtctaacatttaagtctttaatccatcttgaattaatttttgtataaggtgtaaggaagggatccagtttcagctttccacatatcgctagccagttttcccagtaccatttattaaatggggaatctttccccattgcctgtttttctcaggtttgtcaaagatcagatagttgtagatatgcggcgttatttctgagggctctgttgtgttccattgatctgtatctctgttttggtaccagtaccatgctgttttggttactgtagccttgtagtatagtttgaagtcaggtagtgtgatgcctccagctctgttcttttggcttaggatggacttcgcaatgcgagctcttttttggttccatatgaactttaaagtagttttttccaattctgtgaagaaagtcattggtagcttgatggggatggcattgaatctataaattattttgggcagtatggtcattttcacgatattgattcttcctacccatgagggtggaatgttcttccatttctttgtatcctcttttatttcatcgagcagtggtttgtagttctccttgaagaggtccttcaagtcccttataaggtggattcctaggtattttattctctttgaagcaattgtgaatgggagttcactcattatttggctctctgtttgtcttttattggtgtataagaatgcttgtgatttttgtacattgattttgtatcctgagactttgccgaagttgcttatcagcttaaggagattttgggctgagacaatggggttttctagatatacaatcatgtcatctgcaaacaggggcaatttgacttcctcttttcctaatcgaataccctttatttccttctcctgcctaattgccctggccagaacttccaacactatgttgaataggagtggtgagagagggcatcctgtcttgtgccagttttcaaagggaatgcttccagtttttgccaattcagtataatattggctgtgggtttgtcacagatagctcttattattttgagatatgtcccatcaatacctaatttattgagagtttttagcatgaagggttgttgaattttgtcaaaggccttttctgcatctattgagataatcatgtggtttttgtctttggttctgtttatatgctggattacatttattgatttgtgtatactgaagcagccttgcatcctagggatgaagcccacttgatcatggtggataagctttttgatgtgctgctggatttggtttgccagtattttattgaggatttttgcatcaatgttcatcaaggatattggtctaaaattctcttttttggttatgtctctgcctggctttggtatcaggatgatgctggcctcttaaaatgagttagggaggattccctctttttctattggttggaatagtttcagaaggaatggtaccagttcctccttgtacctcttgtagaattcggctgtgaatccctctggtcctggactctttttggttggtaagctattgattattgccacaatttcagagcctattactggtctattcagagagtcaacttcttcctggtttagtcttggtagcgtgtatgtgtcaaggaatttatccatttcttctagattttctagtttatttgcatagaggtgtttgtagtattctctgatggtagtttgtatttctgtgggattggtggtgatatcccctttatcattttttattgcatctatttgattcttctctcttttcttctttattagccttgctagtggtctatcaactttgttgatcttttcaaaaaaccagctcctggattctttaattttttgaaggcttttttgtgtctctatttccttcagttctgctctgattttagttatttcttgccttctgctatcttttgaatgtgtttgctcttgtttttctagttcttttaattgtgatgttagggtgtcaattttggatctttcctgctttctcttgtgggcatttaatgctataaatttccctctacacactgctttgaatgtggcccagagattctggtatattgtgtctttgttctcgttgctttcaaagaacatctttatttctgcctttatttcattacgtaccgagtagtcattcaggagcaggttgttcagtctccatgtagttgagcggttttgagtgagtttcttaatcctgagttctagtttgattgcactgtggtctgagagacagtttgttatcatttctgatcttttacatttgctgaggagagctttacttccaactatgtggtcaatttaggaataggtgttgtatgttgctgaaaaaaatgtatattctgttgatttggggtggagagttctgtagatgtctattaagtccacttggtgcagagctgagttcaattcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggagagttagctcttcttgttgaattgatccgtttaccattatgtaatggccttctttgtctcttttgatctttgttggtttaaagtctgtttcatcagagactaggattgcaactgctgcctttttttgttttccattttcttggtaggtcttcctccatccttttattttgaatctatgtgtgtctctgcatgtgagatgggtttcctgaatacagcacattggtgggtcttgactgtttatccaatttgccagtctgtgtcttttaattggagcatttagcccatttacatctaaagttaatattgttctgtgtgaatttgatcctgtcattatgatgttagctggttattgtgcgcgttcgttgatgcagtttcttcctagccttgatggtctttacaatttggcatgattttgcagtggctggtaccgttttttcctttccatgtttagtgcttccttcaggaactcttttagggtaggcctggtggtgacaaaatctctcagcatttgcttgtctgtaaaggattttatttcactttcacttatgaagcttagtttggctggatatgaaattctgggttgaacattcttttctttaagaatgttgaatattggcccccactgtcttctggcttttacagtttctgccgagatatccactgttagtcggatgggcttccctttgtggctaacccgacctttctctctggctgcccataacattttttccttcatttcaactttggtgaatctgacaattatgtgtcttggagttgctcttctcgagaagtatctttgtggtgttctctgtatttcctgaatctcaatgttggcctgccttgctagattggggaagttctcctggataatatcctgcagagtgttttccaacttggttccattctccccgtcactttcaggtacaccagtcagacatagatttggtcttttcacatagtcccacacttcttggaagctttgttagtttctttttattcttttttctctaaactttccttctcacttcatttcattcatttcatcttccatcactgatactctttcttccagttgatcgcattggctcctgaggcttctgcattcttcacatagttcttgagccttggctttcagctccatcatctcctttaagcacttctctgtattggttattctagttatacattcgtctaaatttttttcaaaggtttcaacttctttgcctttggtttgaatttcctcctttagctcagagtagtttgatcatctgaagccttcttctctcaacttgtcaaagtcattctccatccagctttgttccgttgctggtgaggagctgcgttcctttggaggaagagaggtgctccggtttttagagtttctagtttttctcctctgtttttccccatctttgtggttttgtctacttttggtctttgatgatggtgatgtaagatgggtttttggggtggatgtcctttctgtttgttagttttccttctaacagacaggatcctctgctgcatgtctgttggagtttgccagaggtccaccccagaccctgtttgcctgggtaccagcagcggtggctgcagaagagccgattttcatgaaccgcaaatgctgctgtctgatcgttcctctgatagttttgtctcagaggagtacccggccgtgtgaggtgtcagtctggggggtgcctcccagttaggctgctcgggggtcaggggtcagggacccacttgaggaggcagtctgcccattctcagatctccagctgcctgcttggagaaccactgctctcttcaaagctgtcagacagggacatttaagactgcagaggttactgctgtctttttgtttgtctgtgccctgcccccagaggtggagcctatagaggcaggcaggcctccttgagctattgtgggctccacccagtttgagcttcctggctgctttgtttacctaagaaagcctgggcaatggcaggcgcccctcccccagcctcactgctgccttgcagtttgatctcagactgctgtgctagcaatcagggagactccatgggcatgggaccctccgagccatgtgcaggatataatctcctggtgtgccattttttaagcccgtgggaaaagcacagtattcgggtgggagtgacccgattttccaggtgccatctgtcacccctttctttgactaggaaagggaactccctgaccccttgcacttcccgagtgaggcaatgccttgccctgcttcggcttgtgcacggtgcgctgcacccagtgtcctgcgcccactgtctggcactccctagtgagatgaacctggtacctcacatggaaatgcagaaatcactggtcttctgcgtcgctcacgctgggagctgtagactggagctgttcctatttggccatcttggctccagaacttcagtttgagttttcactggttcttggtatgatgagtgatcttctattggaattacacatttttgttatttagttatgatattccaaatcttacataaacattatgttttatctaattgccattgatatagctttatcaaagtaagggagaatgccatgttgttcttgccagataggggtagaatttcaggtttactactttacctccactggaagttaaacagtgggctcttcataactactgtaaaagagtaggagatccagttcgccagtaggctttcactgatcccgccctgagtagggtgggtggagttatctcattaacatttacctttaaaatttccttacgtttgttttacatataatatgcaaataattcagtcctacttagtgggagtaaaagggacagatatgtctactccatcttcctagagaagtagaattatccaagctttatagctaaacacacatgtaggttgcaaataaaaggatacaaatatatatatcttgtatataataatgaaaaaagaacccgaataactatagtaattttacaaaaaaggctttaagtcaaaaattgtttcaagatactaaaaagggcattttataatgaaaaatgaatcaatttttcaaggagatataacaattataagcatatttgatgataacagagctccaaaaggtatggaacaaatgaggcgaaatcgaagagaaaatggaaggtaccaccaattagttgtagacatcagtaccccactgtaactaatgggtagagcaattaagcagaagagtaacaatgatattgacttggtcagcatgataggcaaccagacatgttgacctgtttagactctccacccaattacagaagaacatacatttttaactaaaatatgctaatatctaagatctaactacaatacactaatatctaagatcacttgtatgtcaggttataaatcaagcctcactacatttaaaatagttaaaataatacaaattatgttctatgaacacaatggaataaaattagaaatgaataacaaaagaacaattgaaacatatgcaaatatgaggatattaaaagcaaattactaaataaccaatgggtcaaaaaaaatcacggtgaaattataaattattgggagataaataacaatgaaatctcatcatgctaaaacatatgctacgcagctatagtttgtttagagaaaaattttaacttcaaatactatattaagtaataaaaaaatcttaaatacctaatctttctcaataagaaattagagaaagagcaaaataaacacaaagtaagcaggaacaaggacaattataaatttagaccagaaatatataaaaaaagaatacataaacaattgagaaaattagaaaatctcaaatttagttttttaaaaaggttaacaagagtgacaaaactttaactagataaccaaacagcgagagagagaatattcaaattttttaaaatcagaaataaaagaaggtatattttagagattaaaaagaaaaacgtaactataaataattgctaaacatttacataatttaatgaagtgtgtaaactctgagaacaacaccaactaatgaaactgactcaaagataaatcaataattggaatatacctaaaagaaggaaagatattgaaatggtatttttaaaacacttcccacaagaaaaagccccaaatcaagaggtttgtctgatgaactccattaaacaatgaaaaaacaattattaccaatctttcacaatcttttcaaaatatagaaaaaggggaaacactcctctacttatttgagattcgaattagcttcatagcaaaaccaaaaccatcagatgaaaagaaagccatagaccagtatccctaatgggggtagatgaaacaatctttaacagaaagcttgcaaaccaaatccagcaacatgcaaaaattgttatacaccattatcacttggtatatatccctggaatgtatggtagatatatatcttaaaatcaatcagagcaatacaccgtattaattgaataaggacaaaaatacataatcattgtcatagattcaaaaataagaaaaaaataaataccatttcataataagtatactgaagaaaactaagtattgaaggaatgtatgtgttccccctacaattaagaataagaaaaggatgtatgccctccccactttcatcaaccttgtgttggaatttctagccaaggatagatgatacaaacttaaatatagaaaatgttcatgaattcactaagaaaactattggtactaactagtaaatgacttctgcaaggttgcagcatacaatcccaatgcacaaaaatcagctgtatttttatatgttagcaatggattagagtaggtaaaattaagaaaaaatttcatttataacagtatcaaaaaattctaaggaatacatttaacaaaagaagtgcaaatattgtgtactgaaaactacaaaacatggaaagaaattcaagaagatttaaataaggggagctacatcccatgtgcataaattagaaaacttaatacttttaatatgacaatactccaaaattaatatgcagatttaagaaatctccatcaaaatgccaactgcctttttttcagaaatggacaagttgatcctgaatgtatatgaaatccagtatagccaaaataatcttggcaaataagttggagagaacccccagttccatatttcaaaacactacaaagctatggtcaccatggctttgtggtattgtcataagaatggacatatagaacactggaatacaattgagagtctagaaatgaaccttatttattgttaactgtcttttaccgtgcttttcaacacagcagaatgtggaaaggaacaggtttttcaacaaatagtgctgggaaaaccggttattgaatccaaaaaattaagttgagtcctttcctcataccataaaaaattacttaaaaatgaatcatcaaatatatctaagagctaaaactgtaaacctatttgaagaaaacatgggattaaatttttgtaaccttgggtttgacaattgtgcttagactccacaccaaaagcacaagaatcaaaggggaaaaaaatagacaaattggactttttcaaaatttaaagcacttgtgctgagtaatactataaaaaaggtgaaatacaacttgcagattggcagaaacattttcaaatcatttatctgttaaggagactgtatgcaaatatataaagggttttcagagaaaaaaaaagaaaagaaacataaataccccaaataaaaattgacaaaggattcaaattgacatttctccagagaagatattcaaattgtcaataagcacaagaaatgatgctcaaatcattagtcatcaaaatgcaaatcaaaaccacagtaaaatacagcttcccactctataggatggttataatatttttttaaaaaaagaaactagacaataataatgattagtgaggatgtagagaaattggagcactcagattttgctagtgagaatgtaaaatgtggtaactcatttaaacaaaagttcaacattttctgaaaaagtgcaagctgaagttgtcatatgacccagcaattccacttctagatatattcaagagcaattagaagatattcccaaacacacaaaaaagaaactctacacagatgttcactgcagcattattcacaaaaaatcaaaagtaggaacaacccaaatgttcaacaggtgatgaatggggaggaagagatatgtccatatcaggaaatattcatcaataaagagaaaagaagtactatctatgccacaacataggtgcaccttgaaaatagtgtattaagtgaacgtagataatcacaaaatatcttatgtgtatgatactatttatatgaaatgtccacaaaaagcaaacccatagaaagacaaaaaaataatgcttatcaggctctgaagagagaggaaatgaggagtgacttgtactgggtataggatatatttttggagtgataaaaatgttctaaaatttgatgatgatagttgtacatctgtgaatattctaaaatccgtttacttgcatgctttaaacaggtgagtattatagtatgtgaactatatctccctaaggctgctgcagaaaaaaggtgaatgacacataaaggggatgtcaagccagggaacatattcatttacacaataatgacataagtaaatctgaccataatggcattaacaagaaataaacctatgaataatgatggagctatttgtttttctctaatgactgcaaggccattaagaatattagagttaaatctggcctggaagaagagatgacaatcacagtagaaatgaaagagaagcctatcttgaaatcaagagccataatggaaacataataatgctattaagcaagtgatttacagaatgtaattttctccagcagtttcaatatttttttgtcctcacattctaagagactcacttgagttatggtttaatgatctattgaatgttgcatggccatgttactgtgggaaacaggtatgcaaatgtagatgatgacttagttggctctcaattttgttcagaggactcaagagttattgacccacttatgccattattggaacgctaagcgtgtgggagttgtttatattctacttctcaaggtcatcagcaaggtctgattgcaaaaattcaaaaaattgcggtctcaggcataaatgggttgaaagcttttaaggagcaagcagaatgaggaagataaattccagattttatgcctaaaatgatatctataagttagtagtttgtccaaattctcaacacttcctgctttatcctatcaggctatgactttgctttgtatcccacttaaaacacagaatgaagcaaagctacacactaccaaatctacccaccttccttgagttgtacccatatactgtgcctcatctcctgcggcctcagatcaattgtccaggtttccatccatgtccagcctctccatttttgcaccagatctcaccctgctcaagaatacagtttctacaattgtcctcagatttgatatctcaaccatttcatgccagcaattctacaaatatatactaatttcataaaccttggaaaaacattcttgatttcctattgatatattcctatgccccctttaaaaaggaaaagaaggatttcttttccaaagagaagctgcttgtagtagacttgcctgtagtaactctaataccttcacatgcaggctctcatgaagccattcttatgaagtttttgtttccacttctccataaaacgactcttgtaaaggattaaaatggcctctgtgttgctaaattcaatggtcaatttccagctgtcattttacaagactcccgggttttgcactcactttcttggcaactacagctatttcttctttgctggttctaccccatctttcttacatttttatactgtggagtctcagggatgagtgcccagtcattttctctacctatcctgcacaccttgatcttctcatccagaccacagtgctttacctaccatctatgtgctgacagaagctgaacttctattctgaactctaatttttcccttaaatccacactaatatatgcagttctccacttatcacctatatgtctaatatgcgttcagatgtaacatgcccaaaaccaaaatcttgatctttacttccaaacctgcttttcccataatttctccatttgcagagcaacacgttttttccagttattgaaatctactttcaaattcaacccctttccatatagaaaactttgtaacttctccttctttcaatccaattctcataaagctcattctcaatagtctaaccagaatcatcattttctgacttttgtcaatgcctgtcactcctctgctcaaaaatttcccatggtttcccatgtcgctcatagtaaaactcataaaggctcatgcagcatgcaaagtgttttctttgatctcattgtctgccaagtacttcttaattcattccattccacacaaaataacccttgcttttcttctgactctcctggaatgtccctatctctgggcctttaaaattataattcttgtgtctggaatatttccccacaaacatggaaatggctcactccatcttccctttcaagttccatatacaaggcaacatgaattttccttcccacggccctttgagtagtctttgctgtctcctccgctttatttcttgatggtaactgtcatattctgacatattgtccttaatttatttctgcccttagtcacattttgcctcctgtcactggaaagtaactcccatcaggactgttttgttcctttgtttgtttttgtctgttttattcactgctatcttttaacaacaacaaaaaagagtagatgcataggaagcatttggtattttattgaatggctgactctttacatttttgaagatagcttatatttagtgatatctgagggatcatgatgatcataagactttttttacaagggaaacttgtaagtctgtgacttggtggaagctgtcggtggatggatagatagatgttcatcatcagtggatgtttgataggtggtaagaatgcaggtctagtactcacataagaaattagtaaatgagcagtgtgagtttacataaaaggaatcgttgacaccctaggagtggaaatggttgccaaggctgatcactgaggcagaggaaagatgtgtgggcattgtaatgaagagtcaaacttggatccatcttggtctcctgctttctcttctaatcacctgctattatttcccgtctaccattacttcaaaatgggtataaaaagtttaaagtgtcaatctatatcaaattattgataaataattgacaaggtgggagtaattgaaaatttttatttttctaaagatgcctggatacttagatatttaagggttgtttatttttggtaaccaaaatataacctctattttaataaagagatggcagaattacctttgagaaaaagttatttgccatactattttcacccaattgtaacactcaactatattctcctccttaccaagaatgaattgcttatttttgttgttgttgttttattttttaataacatgcaagaacattttacattttcccaaaatttccaaacctttcacattaggtggatttaatttgggaagatagagaaagtatttaaaatgtgtttgggaaataaactggctacaccaagcattatggggtgaatggaggatttccagggtgagttaaggcaaagagaaacttgcttatttacaaataacatgactagtgccactgaagcagattattataaataaagcttctaagatcattatgatggagttactaaaaacttttttggtggaaatatctaagggaattagaatagttaaatgaataacctcttctattctctaggacaagttgctatttcacaaaggaaactatcaaatattgaaggtttcaagggagctactgagaaagcatagctatgtcttctatattatagggacacctgaatatatattatggggtatcgtactcctgttgcatgacctgagaaaatactcctcggatgaattattttatttaaatagctgtctggtacacgacagatattacaatgtgtcataaagtattgaatattttgtaatattttccactgccacatgtaagttgtaaacacagtcatgtacatatcaattataattctaaattctttattacatatatgtagtgaaatatataataaaatagcaatgagtttgtcagaaatttcatatgctttattaccctctagttaccctccttgtgataagttcatcgtattgatttcattaagcacacaaatgtattagtctttcaatcatcttgaaattaagacatgtttatgtgattattgatggtctttaataataatactagcaacatcatctttctaaatgtattctgagcatagctttaagattttatagttattttgacaaaattatggtttgaaataactttttctgttttcactgcaatatatatagtttggttgccactggtaataaatgggttacaaatttcctttggtatttaaatgagaaacctatttctaaaaatccaaaatgaattagtgagctctagtttattttttttttttttagtaaatatgccacataaaccattaaacagccagccacaattaaaattaatgcaggaattattttttgaaagtgaaccatttggctcctctggttataagagttcatatccccttacttctagcatttcttattcagtttcttatggcaaatattaactcattctagagaatactcaagaatagttttaaattgccctaatccatatttatcatctgatgtgtgcacaaagagataaaaatacttttaaaagtacttccaagtttatctttaattgtacattatcaagagtaaaattttggcaaaatatatttatcaatcagtgctaaaagaacattcatagatggtaagagtgattagtcctcctacctcttatccaccatgtattgaaataaattttcactacttacgatgtttacacgttgaccaaaaatgtctacatttgaaattagtttccacatgttacatatcatagattctagataagtgtattgaaattgaaaaaaaatctagctattataaatttttaaagacattaatttttatgttatctgacctgtttctctttccctttcaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttgacatactgaactcttcattgacacaccccatgactgtat

SEQ ID NO: 387 - DNA, 2059455 bp, Homo sapiens
tagaaatctaaaattaaatatttaattagaactctgatttgctttaaagattggtggcattgcacaggctatattacaccctctttataatttttttgacaaaaaaaagatactgttcattttaacaggccactttaatattaatacatgtgtaataggattggaactgaaaatcagctagagatggtacattttacattattgggaaaattacagttctgtattgtaaaaacatttattttttaacaatgtacctacattaatcaaaaaattacagcatatttaataattttacaaattcttcataaaaaatatatctctgtacaaaaaggtctttcgcacctacgtcgtgacagcagcgtgtggtgggacgggagggagggtcggcgatgacaatgggttttcctgatcataatgccagcgttcttttttttaccccctttttataatagctttttgttgttgtttacaaaatattttacagaagaaaaaaattattgcagctagcctgaaaaaaggcaagatgtgtgtgtaaaacaagcagcagttttaaacagctctgaagcacgtgtcctctgttagtgtgtggtcgcgtccctcacgcgtgttcccgttgccttcagggaagagtcttctagacctaactcagcaagcacagctcctgactgccctaaaatgagatcctccaacaccttgcggagacgccgttcaacactgcacacaaccttaggaagaaactaggcagaattctcacacgagaatttcactgattttttttttcatttaaataacatgcttcaaactggcaaccctaggacagtttgactttgcacacaaaggaaaatcatatctaatttgatatgtggtttcttgtatgtatgtatgtcctgtcatttcaggatttcatagcatcgttgaccagggagcaggtcagggatatgggaacagagatgttaattcagactctgaagtcagcattttgcacctagtttgaatgactcaaacttagatatgtacaatatatatatatatatatgtatgtatatatatacactaatatgtatagtaaccctgttctcccttgcacacgagcctcctcacactttcaatcatcttctgtttcgttcaatgtgtgtgttaggagcacgactcccgctgacctcgtcccgtctactgtgaaacagcaatgtaaggattcccactggcaaagcaaatctccaaggatgtgggcaggttggccagggaaaactgtgcagagaattcagcataatgatacagaatccaacagcgtggggttcacaagacaaaggagtccctaggagaggccagtgagtccccaaacagcagagaccctttcgaccgaggaacacaacactgggagccgagctctacggaaatgtccgaatcaaaacgcgtgactctccaaagaatgccccattttcctgactgcttttccttttccacatttgaagtcctacatggaaaccttcagtacaccaacagataaatcagtcttaaagctaggtgtcaatgtgttcactccgacaacgtgaaggccaatttgaacattctgacatttctattaccaacgccaatctaaaatgtgaaacagagaaaatctgccacaattgaataggaactgaaatatcaaataataaaataagtactatcgtttcaaaaatatttttatcaaataagtataagtaaaagtaaacatgattttcactttgaatttgttacataaactacctcacggccacatcttctacttcatgttttgatttttatttgccctggggatcttatagattttatttgcatcataacttatcatttacctataatggaatttaaacttgaaaagtcactgaaattacctttccatctggaatcataaagcatgaaacaaataacaaatgaatgtataaaatatatcattgtgagaggagagtgtgtgtactttttccttccctctaaaagaacacttggtattttgatcctgaacaattttcactgagttcaaggtgctactgtggtatattgtctttcaatgcaatatcaaagatcgatggcacagtaaaagacaaaaaaaaaaaaaaacaaaaaaaaaacactgcaaaagggaaggctgcattgtgagctaaaacccacaagttcatcgactatctaaaataaattactattcacagttttacatggcaaacagaaatttctgcaaaccccctgctattaagtagtatcagagagacagtaattggatgaggatggtactaaaggaggaaaacgtgtgaaataaggaggcttctgtttttttctcattggacctcttcaatgaattcaacacgtaaatggagctaattgaagcaataataaaataaatctcttcaatactgtatttccttttaaaatctgtgccatatctaggaatacttttccctaacactccaactaagctgatgggggaatgtttagcttgataatatgaaataatgcttatatacaatggatagtgtgtataaaccctgtgtaaataatttattttttttatcagaatcttagtcattcataacacactagtgcaaaaaattgtgcattaaacattctgcgacagaacagctgactgggaaattgcaaacatccctagagatgaacacacaggggagctgtgaggtcctcaaagcttgtcaggtctcggaaggacagagtgaagcatttgtaggtgtgagcctctatcagaaaggtgtcttcttccagaaagctttttatttttttcagagtattcgtgttcatgggggtttaaaaaggaaaaacaacacaagagaacacatatcgtggtgccaccattctgtcaccgcacctgagggacatatccacgagcccagacgattgcattgaaaggcatctcagcaacacagaaatatgaaagtctgaggcattgagtatgacgtgttggcgcgacgtggcagtcttcctggagtgtgccttgatttcatacagatgcagccaggcatttagaacccacttttggaatgaaaacgcatgtgtagtttgatccgtagaagaccctgacacatttgagtagagatccccgctgcacttatgccagtagacaaggttgaagatcgctgcagtaaagccagagtggaagggagagtggtatatggcaccaaaggaatcactgcttgtccatcagaggtatggctatgaatcagtcctgttggggcactgagggctataccactgtacagactgtgttcagagttgtgtcaaacctcacagccttggcttctgtgggttttaagtttgtatcatacatggggttttcaaacgatgcttgtccattgctgttttcatgcccagcatagccattgtattgaacttttggtctcgttctaaggaaaacagaaaacaaatcattagaatcctggtttcatttgcagatttagcagctgggactgtgtgcaggagacaacgtctacagagcagggagcagtatagccaggacgtttgcaaagaaggaaggcatccacacctgcacacctgtcagtttatttgcttaaattggtgattgggagtataaaatgggttttaaaaagtgaatcgatttcaaaaattaaataaaatttttttgagacagggtctcactctgttacccaggctggagtgcagtggcacgaccaccactcatttcagccttgacctcttgggctcaggcgatcctcccacctcagcctcctgggtaactgggatcaaagatttacttatgcttcctacaaatgccccagggaaatcgggaaggtcccaaaggctgaatcggattggttttgttttggatgtctatttatcactgataagttatacggccttggttaagacacgaaactttctactactctgtaaaacagggttgtgggcatatgcctagcctttagcacggtatgcttacactaaatttcaagtttaagcttttagttcactgtcgttactaatattcacaaaaagttattttttattttgcctctgttgagttaaaaatgaatctttataaaaaaggaactatactcattattaaactgttgtcacattttctggttaaaagaaaacccctacgtacaatctatgattagagaattagaggattttcagactgaaaagacagaatcatgtctggtctgctctgtctctgtttattctttccttattccagaagaaatcaggtaagaaaaatgtgccacgtggcaaaaccagaaatttaatgtacataagcacgctcgcaaaaacatcatttgacattgggcgtcaagaaacttctgccgagacatttactagatttccttatgttacacatgctcattaagaaaaagagaagtacgtggcacatggctctgagaaaaaggcagaacagcactttgtgactgcccttggagtgggagaggtccgtgacattgtgcttggaacatgcgccagcagtgatcgttagcaaacaaatccagcccctcgtcaatgaagtgaagacctggctaaaatgttcactcaatcgtccagatcacaagctgccacagtcccttcatgtgtagggaaatgcaatcccagagtggaactggctgcagctggatgctgacgtgcaggtgtgcagctgcacccggcagaaggctgtcagcaccttgggctctgaggaagcaactcccaacatgcaagcaacagactcagaaatgagcagaaacagggtttttctggaggaatgcagagccaactcatcaagaaatatttatctctttagagcctgagaagccagtgtagagagtgctacaggcttggtgctttcctgaccaggtggtgagaacttgaagaaaatggattgatgtgctgctggcaactgagccctgggcttccttgcttctacaaaaattccaccatccctcgctcctatggcacagaagtagagaactaaaagacccaatggattgagaagtcacagtggcctcatagccgtcctcttgagaactgtgagagggaacagcttccttcatattcaacatgcagggcagcctcttggtcttggtgcagtgttaggaagggagggagtccagttgtgatgacgacagattccccaccgacccagaggaggcatcacatttacataaaaataagcgctatctcccttatctctggctctgtaatctgagatctctttccaaggcaccgccttcacggagacacccaactactcagcattgacagggaagtttctaaggtttaacgactaaaactggtgtgtatgttggatatagcccccaatgctacattgccttaaagttaagatataatcagaagtgatatttatgtataaatatgcatatataattatgtggggttatctttttaaaggacaagacaatcccagtcttatatgaaggtttgcatctttgcaggcaagttgagggaaaacagctttaatggactagaccttttccttggggttaatgtggatgccaatcaaaagcaaaaataaatttgtaggaattgtaagttcctacatatgtgtctctataaggatattatatgacccagaggaacccgtgaaagaagatacatttttgtgtatatccctttaagaagagaagctcatctgatcatggcatcttattggagaaggtagtggcatatctttctacatttactaaattttaaattagtcctgagcagaaattcaaggataaggctcatcggacttgtgtgtattgggtattttctcttccaaaaaattaacacagatgtgcccatctttaattttctaaatatcatctgaaatgtttttcattgagtcatattcttaaagaaagaacattactagccatagggaactgaagacacaggcacaagcagctaatacacctttgaagcaacattttctctactgtgtatttcaaaagtgaatataagaaagcaaatatttaaagaggctatttcatgagttttgaaaaaataatatcatgacagtttttctgttttaaccagaattaagtgaaatatctgtattatgtactgatatttatttaacctatctaattttatttcaggggatcataatttatttcttattatttgtagttaatgctaccatttcaaatagtattttagagtagtttggcatttccagattcctccaggtaatgtattatccatatatggaaaaaatgtacaaggagtttatagttcctccaaaataattcttttcttctggcatccacattaatcccaaggaaaggatctggttcactaaagttgtttgtccccaagttttgacattttacagttagcagagttttgcaaattgatgggtattcagaacactttttcaagagatggaacatctatattgcttactacatataaagagctaaatttgtatttgttgaagaaagaaatcaatgaaacatctatcaatcacagattcacagagttgaaagtggccatagagaacattctgttcacccttttgctggaaggttgaaataccttctaaaggttctcatcgttggccatggagcctgaatgtagagatagaatcctttatttcatctttcaattgaacatgaaagaaaaaaacatattatttctcaactcagtcatttattctcttatttcttagatgtattctgcttaaaaagtagggcagaaaacaacagaaaggacaacaaaaaatcttgacaaataagcattgttagtccaagaaagagcattgctctcactcatgagtgggagctgaacgatgagaacacatggacacattgaggggacaacacacactggggcctgtggggggctggagggagggagagcatcaagaagaacagctgatgggtgctgggctgaatacctgagtgatgggttgatccatgcagcagaccaccccggcttacatttaactaggtaacaaacctgcacatccggcacgtgtaccccggaactcaaaataaaagttgatttaaaaaaaaaaaaagaacattgcatagtaatataaaatacatgtgcatgtgagcacgagagcatgcccattactttaaacccatagtttacactcacaacattctcaaacagatggtgtttctgcagtacctgtgtttgtagaggtaaaatgcaaaccctgataaaattagagcaaagaaaggaaccagaatggcagccgccacagagccactgctggtgccgtggtaatgactggaagagtcttgatctgggtttaaaggatctgtaagataaaggaaatattaaatttgttgttactgtactctgcttaaacaaatacatatgataaattttgtaaatggatacgaactcttcaagaagcagacggagttgccatttcacaggaaaccaaatgatattcttttctaaagatttttaatatccacttaatgaccgggacaaaaaactgactatttcctactaataatggagaatactatgaaagagtctcaacatttaaaatgtgagaaaggcaaaagggtcagtatacatcctgactttcgtttatagttataggtgttttcacaaaactaactgaaaacatttatgtattttttctatattcagaggtcaataatatttgctgttttttcaggtcttaaggccagactcggcaaaatatgtcattgaaattatgtaaatatcccagttatccataaaaatggcattgcattcttcatatgtgaataggatggtgtcatctgtctttattttacgtacattctgaaattcacagaagagtttagaaatactcaaaaataattatagttcaatgtcacaatgcaagtttccatgaagacacaaaataatgctaaaatgtaactttttaaattaaataattaatttttctttttttttttttctgagacagagtctcaccctgttgcccaggctggagtgcagtggagtgatctcagctcattgcaacctctgtctcccaggttctagtgattctcctgcctcagcctcccaagtagctgggatgacaggtgcctgccgccatgcctggctattttttgtatttttactagagatggggtttcaccatgttggccaggctagtcttgaactcctgacttcaaatgatccacctgcctcggcctcgaaaagtgctggaattacaggcttaagccaccacacctgacctaaaatataccttttgtccattagaaaggaaggcaaatgtgaatacttcaagtatcatgaaggtgatagaatcagccaggactatggagtgtctcatggcatggcactgagaggaaagcaataaaaactcaaatccacagacctttattaagcaactgttgccaaaggaggaagtaagtttttgaagagtgtactaataaaatataattttgagatggatttggcctaattgcatggagtcacttaatgcaggtgtgcaatgaatcatgattggcgtcatctcaatatagcagaattgttgagaagaagctcatctggttttcttatttccagaatttataaaatgtcagattcaaagagatgttgctgtatttattgttttataaaccagaaatgcaaaaaatcaatcaaatattaaaaatctttaaatcattatttgtatcaacaccctttaattttcatataaaaactttcaaatgacattatttgccatttgcttcaatagatgtaggattatgactgcctacaatattaacgtccaataggaacatattttggagcaatgttggctttttacaactacttatctttttgagatctgccccaccatcacgcaaaaggaagatgccagacacttgctctcttgcaatctgagcacccaggttatggacgtgcagcgagtgaagccaattgggtgttcccaccccaggcactgtattggaagcgagggacgcaaaacattctgagatggtttaaaatttgttccatggctgaaggggttctagagccctggggacaacatgaagtgtgtgtgtatgtgtgcactgagggtggtcccagcagcagcagtggtgcagcagtgatgtccagtgacaaggggtggtgctgtccaacagagagcagtggtgccctactcagatggcaccaacttcatgggttggttgtgaaaatcatatgttagtacatctcaagtgcttacaacaatgcctggcacagagggaatgttcacacggactcatagtcacaaaaatgtaactttcctgaagccagggattttgttttgttttgtttggtttcgtttggtttgggtagctttcctcttgactcctcagaacctgcaataaaacctagaacacagtatgtgctcaatatatatttgcaaaattaaaaaaaaaagttttgtctgtatagcatttcagcacccaaatatcttttagtttccattacgatgccaaacattgatcttcaagtttctgtaattctgggattatctgtcttattcttataaatgtgtattctacttacattaaccacagttactttttttaatctgaaaacaaagctacatacttttatccataatagataacaaaattccaaataataaaatgctggaaaatctacgtgtcacaagacacctcacatgaaaacaaagaacaacacgtaagaaggtgtttgtgaattacataaccaaacttaccgtgagattatcacatgcctgcagctcctagttaatttcagttacttgccttgttttaataatttgaaggttaatatacacacattgtgttaattaaaatggcataaagggatatgaaaacaaataatataaaggaaaattaaaataatcattccttgccctacaaggtagttcctctttatagttgagggttttaaaaattgtccttccaacaatgtactcgtaatatgtgtgattatttctcttttcttatttttataattggtaatattatttgcattttgcttatgtggcttttaaccttaacagtctatttatgaggctcttccattggcatatatgaatcagatttaattttttaaggtgtgtagtattctactgattagatataacagcatttatttagccagtctactgtccagggacattaagggtgtttctaatacttctataatgttgcaatgaaatcttttgcctatatctacacattagcaggagtcgacattacataagacaaatcttaagaagtagaattattgagaaacagaatttgtaccttttagtgttgctacatcctacctaattgctctctaaagaggcactgcaatttcattcaatcattatcgtacgagggtcttcacaataacacatggacagctctgtgcgatccctctgctaccctccgttcccttctcttccccctccttgttttcccctgtccctcctcctctctcattgccctccttccacacgttattattggttccttggctgttgcaaccacaactgttgctgccactactacaatgataaatcaaacagtgtttaggtagttataaatttacatttctttactgaaggagggtgagcatctttgcacatgtgataagctaggtcattcaattttctaaagagcattattgaaacaaatgcacatcctgtcacgcaacacttcatgttggggatacattctgagaaatgcttcgtgaggcaattttgcggctgtgtgagcatcagagtgcactcacacacctagacggtgttgcctactgcatatctaggctataggtacagccagtggctcctacatgagtaacaccgtgcactatgacattatggcagctgtggtgtcaccaggtgttaggaatttgtcagcttctttataatcttatggggtcactggtgcatatgcgatcttttgttgaccaaaatgtcattatgcgatgcgtgactgtcctatataattcatccacttaagctgaacacacaatccaaggctttctcagtgttttcatagggtggtgcaatcaccaccgtagtctcacttagaagattggtgtccctccaaaagaatctcagtatctcttagctttattcttcctctaccttcatcccaaccttcaacccaggcaaccactaatcagtgtcccatctctttggatttgcctgttatggacatctcctgtaatggattcatagactatttggcctttttttatctggcttccttcacttggcatgacgttttcaaggtccatccttgttgtaggattcttcaatactttattcttcttcagtgctgactaatattccattgtatggctatattacatattgtttattcattcatccattgatagacattttggttgtatctacatttgggttattataaataatgctgctctaagcattcatgtacaagttttgtgtgacatatttttcagttcttttggctacccatgtaggaatggaattgctggagcttaagtaacaactgtttgatgaactaccagagtgttttccagagcagctgcatcatttcacatttccccagcaaagtaggacagttccagttcctccgcctccttgccaccctttgcgatttgacttttagatcacagccatccttgtggacatgaaggggtatcccagtgtggttttgatttgcatttccctgataatgattataatcaacatcttttcatgggcttatcgccatttgcatgtctttagagacatatctattcaaatctttggtcaatttcttatttaggttatttgcctctgtattattgagccataagagttcttcgtacattctggatacaagtcacttatcaggtacataattttatgtattttctctcattctttgtgtgtatgttagggttgagtcattcaatcctaatgaggaaaccagtttattgttgagtttcttacgcaagtttttgcattaaatttgtctttcaaattaattttattttagtatccacttaatgacaatcacgttttttggtttatctactgactagagaaaattaggaggttatttttatccataaaaatagatgcttgccatcattcttaaatgaatggttgctgttgcagaattacgtaaacacaaacttttctaattagttgaaggggggacttacttatgactcaaattattttgtaaagtaaactgtttttcctgacaacaagctcatcatcacatgagaataaaaatcccttgttaaaccaagctgttattttgttagattaaaaagaaaaggggtaatgcaaagaaaacgtgtaatagcaaactgatagttcaggtcaaattcattggatcagtcaacttagacatctacacagcatcctgtacagctcactggggtgtccttcaacaaaattactagagcgtgtgctacagagagaaaggaggacaaataactccaggattcggcttagagcaagagaaaaaacatcacccatcattagtgttggtctaatgcatttattccatttcattacctcaaaataatataacccaatttaacatataatctcagccactgccaacattataatgttcttctatttaataatactgtgggttgaatagtggaagtaaagtattttatgattaattatcctttttttttttttggcttttctacaggccagtagactttttttatattcagcactttgataaaagtcttacaaaataagttcatcagtggtaatcattacaaaattgtacactcacattcctccaaaaggtggctctggtatcaaagcctatatggtaatattcttctttatagtaatactgtgtgaatagtattctacaagtaggagaaatatggtgccaaggttgttacaaaaatgcgtttccttttatttgtgggttgcaacaattataacgacttttgtgcaaaaagagctgtagcatgcacaaagcaatgcttacgtggcctctcaatctcgtaacaaccttgggaacttctatactgagatttaagatgaagaaataggctcaagaatattgtgacccatcctagatgacaaaaataggaagcagacgaggtagcattcagatctgatgattgtttccacatatgttcctcctttaatcactaaggcaaaaatcaaatagtacagaaagctataaagaaggaaggaggacttacctgtctatgtagaataagctttttctcatttataagtcaaacctctttccacatcaatatatagtcctcatttctttaaataaatatactgaataataattgtttcataggtagtataatttgttacataaaaatactcattgaagcaattctttcagcatagatgggcaacatgcggaggttatttctaagttccactactaaaacaatcctgctttggacacgcctgaatatgcagaaaacaatttacacatttgcctgattaaaaattctagacagaaaattgttggatgaacaaagtactgaccaattgtatctacccatacatccatcaaaattaaacatgagcatcttttcctgctatcaaccccaaaccaattattaaaactttgtcattctgataactaaaaataatcatctttgttactatataaatatatatatgtatatttctgaagatctttttatatgtttgttggccacttttaattactcttactttttttttttacttttaagaactcttagttttctttgggtaatatactttgcttatactttgattttcatctttttctctcttatttttaatagctcttgatatagtgaagatatgatgtctggcacatttattgcattatttccggctttgtgtttgtgtattttgctattcaaaataattttttttcattcagctgtaaaatatgttagtctctctcattatttttgtttaggtttcttttagagtcgtcttttccatttcttcttagaaacatcattggaaagccaaactgatatttgctttaaaatatatcctaagtgcaacttaccttgcctttctagcttaaattttccaaagtcttttccatgaatgtcaccttgaaaagtaaatcctcctctttcaagtccagatgacacctgacacataggaaagaaaagaaaagaaataaaaaggtatacgaagggatgaataatatcctcttttaatatatcttttaatacaactgttatatctcatatttagatactactggttaaatgttttatttttgccatggcttttggtgacacatttatagttaaagatcagaaaccaacacagaagtgaactttaactaacatatgcaaatgctcacaatctcattttgatctcgaaaatgatagcaaattttacaatatatccatatgttaactgcactttctaagggaacacaaacgtatgaattaagaaataatctacattatgtaaaactcactttgtgtcccagctattgggcagggtacatcatgtatggctgtctacccttaagtcagatagtaaattagaacacgaacaaatggttaacttgcaaagaacggtgttaagggggatgtcttaaatctttctatttatctgggaatgatttcttttagaacgagcagcgtggttatcaagcggtcttggaaaatttctgatggcaccactcacgatataacgtagcagtaacatcatagaccctggatttcaggtcttgttctgtcctcaacagtaaccacccctttaaggatggccagttcattgcttacttcttagacctggtttcttcccttataaaatgaaggaataaaatggccactctgtcaagaagaggggcagctgagttttcaaggggcagacacaagacagctctactcagaagcctccaatccgtagcccttgcatctgcacagagagatgattagaaagcctgtgctttgtcacagaccttacacatgtacttacataaccatctagtccccagttgtcattttcgaacttgcttacaaaaatatctgcctggcctttaatttgaaaagctttcaggagtaagtgggcctcctccttcttgtaaatgcctgtgaaaagatcagcagtttaggcttaccttggagaaagttagtaattcagccctttaatccatttgatgtggaatgtggtacggagatgataatatcatcgataatagaaaactcaaacagaaattgtatttttatttgtgaattttagcttaggagcttccattttcccctgaaaatcacttcttaaatccttgtctatcttgaataggtataatccactccactaagttcaatatccttattccacagaaagaataaaaaataacatatttgattttgctaattaaaaaatctctctctaaaaaagtatacagtaaaaatacatcacagaattaatgtaagaatgaaaatgataatacacatacagtgcttaaaatagtgtttgccatataaatcgaggctgttttattttattaattgtgtgatgattttaaaaatctcatgaagagcacatgagttaagaaaaagtattaagaaataaagtttggagacatgcagtatctgtatacgaatctcagattcttgacttaatatgtgcataattttgagcaaatcagttcacttttctgtactcgttttgtaatctctaaaataagaaaataataccaacctctcacggctagggagaggctccaatgagttacagtatatacaaagccaacagaacagtaataagtacttaatacttactagatcacctctctgtgaaaagataacaggtctatttctgctcacaccatgcgtttagtgaattcttcgggacctacctgtcaacttcagctccactggcgaggcttcgctgaaggtggcattcaccttactgcttgttgcattgaaccagtcaacagttagagtggcgggttgtcttttccctaaatattcataataccccttccacagtgaattgacgaaaaagacatctgaaggaactgtgggaaggggggaaacagaccaatgtcagcacacacacaaacaataaattcagacattattaaacacagaaggcatcatactgcttagcgagcgatcacagatgagggcagtgatgaagacaagaggagcctagtgcatcgctgttcacagcacgtgcaaaactcaaaagaagcaggtgcgaagattattatggtatgcaagtagacacttgtgcttatgggtttcttttattattattagaagccaaagcatacctactttaacagcccttccaagctcatgggctatggtgaactggtacttctaatgctagtttagtttttattgtgcttagcaagaaatatgtttacctgacccatgaaatcactactgatatttcaatgatatccaagtctactctttgaaagacttggaaggctccaaagaactgatatatataatacgagagcaatgccctgtctcgaaaaagcttacatatcccagcaccaagtggacttatgaagacaaagccctttcacttcagagtctttattttgtaagtagagtccctctctgtcattcatactcttctgttcttctttaatctctttatgtaatatattccatgagtaagaagagatgggctcaataatttcaaatgtttcttttatacatgtcttttaaattcagtaatgaaaggcagtctttttaaagcacagaatccatcgacaggaaaacttaacaaagattattgagatatttcttcttgttttcacggcttaagaaaaaaataaacttatttttcatgtgtctgtttaaaaatgtgtataaaatcctgccattttcacacataaacgtgaattgtagtgtataaattcacatgatgatttcagcattactctttgttttctgccttctgatgtgcatgaattatttaattagataagattcatgataagcataattggtcaaaacacattgcttgagttgctaggtggaaatgaagattcatgtctccctaacccattttttaaaaagtccatttatagtcgcaaataatgaggacaaaagtatattgttcctatacccatgcttttctttccagcccaactggccattttcttgttttcctaggcaggctgaacctataaaacttggcctagcaagagaagggttaaagaggaacagaagataatagcttcctttggccttttgtagaccccactttctcataataatagtgataataaaataagtaaaaaactcatatatccacacaagtatctaacacatttgcttataaatcactgattttagacacatctgcttagccactgtcagcacaacagaggcccccattttaatcagcaacctcaaaataactttattttccattactaaaattaatagcctttaaagtacataaaaaatatcttccctaattagaatttatatgctcttctgaagttactaatccacttgttcaagcattcacttaagttaatcttgttgaagtttcacaggaatgggccaggcctggctgggtagggtaagatacaaccaatgtcttagaagtggcttctgtgtattaaaataggaccacgagtcatgtggcagaggtcatctttctgggtctttataatttcacttgttgctggcagcccgcagtacaatgcagcagccacatagctgagctgtactagaatgtaccaccatgatgaggaatcacattcaattagcacttgctttccaagagtacaagaaaaggaatattgataataatgtttgcacctacaaaaggagtgtatagatatttcaatatcttaaacacaaaataagcaaataaaaaacaaaacacacacacaacaataataacaaaaagaggctgtgttttgttccattgaagaacatgttgcctggataaagagcactgacttctgtatgtgatttttaggtaatatttaaataaaatagtctagaaagctttaaaaagcattttatattctttattattcagattggagaaattcctttcatcatattggcacatttttccttgtctaagaattaaatgtgtcacacagcatcctgacaatatttttccttgtctaagaattaaatgtgtcacacagtatcctgacaatagcaatacaaatactctttccatgtttgattctaaaatagagcttatgtccaaaaaaaaaaaaaaacagtgttaaaacctgaataaagaaagtactagtcaagtgatcttatatatttacaaaggatttctgtttctgataaaacaacaacaaaatacccaacttaaattaatataatttgggatacattttgttatttaaaaataatttaaatttaaaacacagaacatgccagatgattttgtatagtaaaaactttccttgggaaataggactgcatctttgcgatttgctatataatgcttttagcaaaaggtgccacatacaacaaaaaactataattaacattttagaaggcaaagcatgcctagatgaatggagacacttggaaaaaaattgggctccatgtctgaactgtttacattaacaacttatgctgtgaaaatgcctcattgatatgagcttcctcatttggaggaaaaaagtcgcaaccctctttataaggctctccattataccacatggaacgaccaatgttttcatttctgcctaccaaatgccgaaggcaagtttgaatgaaacagggtgtgataacaccaaaggttttctttttaagggaagtaatgttatttcattaacaaaccattgttgtgaaataaacagaattccatgtaagcttggtgttttaaataattgaaacattaacttggtcgtggactaacggattcagaaatttaaatgttgaaaatagtttcactgtgcagagtagagaacaaatcactttattggattgaaatctagaactgttctggtatacaaacctggagttttagtaactgtttcattaacttctctcactcctttacctacaagtaaaaagacaaattatcattttaaaaaaaacatttatttttgagtaagtttgaaaaaatgtcaaattgaagcaattttcctttctccagatttttttaatgtacaaaatatgaataccttatacatatacattttaaactcatgtctttacagcagaatattcttggtgtttgtgggaaagcggagtttaaggatgaaaaatcaatgtacatctatctacgtatatttccatttaaagtgctacaacagagagccttgcaaaggagggtgccttctatgacatttcttgtatcctgtttggaataccctgccacatactaaaaggtaacaccccacccaaataaccatgatgttacagtccctcttcattgaccaataccccacccaaatcaatcaatttatacgttactactgaaaaattcaaaattatttccattgcagaatgttcattttggtctatcaagttagatttacgtcataatttcttagctttcacagttttagatcaaactacgaattaccattttaaaagttttcattcttctatttctaacagggaagggcaagggaaacaaaagtctctttaaaatccctaatatgagaactataaataggctccaggaaacaaaacctaaagtcactgactgtctcacacgccatcatttttggtttatgctgtttagactccatggatttataaattacaaacaggggagaacctgtaagtgtagctatcgtcaaatctgacccaggctgatgactctcacttgtaaacacacaaatttgtaattaatggatcgtttccatgtgaattgcttttgtaattttaaaaagcagaatcaatgtcagggacacataaactgaggttttaccacaaacagcatgtggtcttaaaaataagacagagtttcatttacctattctcggatacttggtgacctttattcattttcatctctaagaactacttttcctgaaactataccaagtattattttccttttaactcagaatgcttttctttaaccaaatagcttttctcttttggcttgaaataatgcaatcattttattatgtactaattgcatactaattgtactatatatttagctatgccaccattgcatcaaacactgaggatacacacgttcacacacacagctcacgcacatgaagcacgactgaggcaggtggcgatgctgcagcctcatgctcttacttatgggtctcacacgtggacactagcctgatgggcagctgatcctttcccttgctctttggaaaagtatgccactccttgatcaatgacttacttttacacacaggcgactttcctgtccatttcatgtctgctttacatgttctgtgctcagatccccctgcgaggaaaaagcctggatggcaggtgtacactaaggtgtagccgaaagtaggaagatcgatggctctcacatccgcgtgtgccggggtttctggctgtctgcaggcatgagctgaaacaacattaggaaacattgagactttgtttattgtaaagttagcacatgtgtctagagaaattaatagattaaaatagtttggaaatggttatgcagtcaatatgtatatatacatatatatacacatatatatgtatattttttttggtagagatgaagtcttgctatgttgtccagtctgtgctagaactcctgacctcaagctattctcctgttttgacctcccaaagtactgggattacaggcatgagccactacacccatcctatatatatttatacataggtaattatgtgcaaagatttagagatcacagctttgaaataaaaacacttctgctatactaccgaaataaatatgttaaagatccttaaaagcccagtcttataaattatagagactggtgaatatttagatatgccttgattttgttcttgtggaaactaccaaatttattactcaatttaattaattattttgataaaactttaatgtgtatttagaaacttaatatagattcttattttctttgaaatataatttaggaataaatgagactgtgatgtatactctatatctcaaatcactccattccttataaagtttgcatacatgctgcaaataaaggattgacatattattataaaacaagtttacaattttatttatttatttttatttatttattttttatttattttttgagtctcgctgtgttgcccaggctggaatgcagtggcacgatctccgctcgctgcaagctcctcctcctgggttcacgccattctcctgactcagcctccccagtagctgggactacaggcacccgccaccatgcccggctaattttttgtagtttttttagtagagatgggatttcaccatgttagccaggatggtctcgatctcctgacctcgtgatccacctgcctcggcctcccaaaatgctgggattataggcatgagccagcatgcccagccaagtttacaattctaaaattgtgcatgcagttgttttgaatgttgtcactatttcactaattagtaaccacaacaaatacctgatattatcaagctccatattatatataaacatgcatatatatatgtgtatgtatatacatatatatgtacatgtactatcaacatataatttgagtaatgatttagagcagagataattttaaaataaatacacccaaaaatcacaccttatatactgagatttttataacattctattaatgtttttatttttaatacagtaagaataagacaccgcatttcactaaattcagagtgagtgaaatgaataattcacatactactcatccatatattttttctaattctcatgattaagtcacaaaataaaatgtgatccttaagtatgtatttgaatgatcaattcatatatacttcctgttatagcaagaataattttttaaacacttctacttagactctgacatatgacgttattcagttcatcctctctttggtaatttgatgtaaatatcctaggagaataatagcacgtacaaataagttttccctctaagaatgttcaatataacattatgcacttatcttcggtttcatgcagtttctcagactttacagtgcctgagaatctcctggagcgcttgttaaactaaactgtcccccttctctcctccctggctccctccagaggctctggttcaaggtcaaggatggggcttgagagcagccttcacagcccaatgtccagccaatggttatgctgccagttctagggaaccaaactttgaggacatccgaaaatttaggattagggaattaaaaacaatttctcattatttcccttagtggtaaacacgtctcagacattcacaataaataggtgacttgtgatgggggtggaagaaatcacacttacgtatacattcggtctgtatcccactccatgttaaattggcaaggcaggtgcgagtcgtggaaccttgaatatggtagccttttctgcacctgaaaaaaaccgtgcttccaacctagagaggaaatccaatactagcttcagaggccaagggaatatacgaagtgtcaactagtgatacctgaaagtacacgcccgagtaaaagtacagcagcaacttttcaggttaatgtcaagccactgtctaagtcaacatgtacattttaactgcctgctacagtgttacacacaatgtagattgctcaatgaataatgtaagatcttctcgaattttgaaaatttagacggctgtttgggtaaagaaattatgccttttctgttttagagttctttcttttttgtttgtaataattattatttcctttttcatttttttcctgccactcacatttgaaacaactggtatttattagaaaattacttttgttagcattccaaggggattggtcaactcctactcatacagagtccaccaaaactctacctgtctttctgatgcttcaaactgtacaaactatttactgttgtctgaatgtctgaggcgtcttcctcaccaggtcttcacaaagctaacccccacttaattctctgtactttgcttaaactgcacatccgctgcagattcttctctgatcctccaagaatgaatcacattcagcttgaatgcatttccccaacgtatctgctccactcaccacagtgtcctggaattacctgtatatttattcacccatgtgtgttcctaatttaaccagaggtgccttgaggggcagattcctgtgatctgtaaatgtcttttttagagaatgagctatggtcgtgtgttgaggggcaccaaagatcatccatggttctgtgtatctgcagcatgaggccagcatgactcatgtatacagggagaggaaagcagcccccagggaaggcgggtttgcactcatcccagcttggcttgggaccagattatttccttaaagcttgacttatgaaggcacataagtgcaccaagttagcatccaaagatttgaattcccctcttgtttcttgctctgagaattttaaccagttatttaattccctgtgtctgccttctcacaggcataagcccatacctcccatgttgggattccgggaagaataactacaagtaaaatgcaaggaaatagttggtacactgaatagtgtgaaaggatatcaggagaaaaaaaatgctgcttctagcacttgataaagtggaagtatgaatttataaagaaaagtacaaatttatctaaatgtcaaatcaatagctaatttaagattcaatgatgggaaagcgttgactcatttactcttgattgattgattgattgactgatcgatttaaactttagagtcagggcctctctctattgcccagagtatacagcacagtggtgcaatcatagctcattgcatccttgacctccagggctcaagtagctcccatctcagccttctgcacagctgtgacaacaggtgcaccttaccatgcccagatgattttttgtattctttgtagaaatagggtcttgctatgttgcccaggctgttctcctggcctcaagcgattcttctgcctgggcctcccaaagtgctgggattacaggcgtgagctgctgctcccagcccacttcctctctatcaggaacggtgtccatcaactctccatgcaagcatgtttgcaattccaaccagacctcctggtaaacatgctgacattctcaggaaggtcatggataacctgtatcatttactggcagaaagaaaatacagtctccttctcaataattttttttttagcagaatataccgagccactgcaaactgattatcatacactaaccctggagctacgggtttcggggacacgctggctggagaacgggaggtagtcatttaagctgcaagattaacatagcctaacacagggacatttcacactgaaatggctcactttgtgtaagtaaggtttcagcatatggtgctaaagaaaacagacaaaaatctcattggttactttaaaaactaaaatgttcctaataaaggaagaaataaaaacatttggggagagctgcatttcatggtctcaaccttctccttaaaacatggtgtctgggctctttaaattattagtaaatcttgctgttggataaaatcaattattcgtgttagtgtaactaatttgttataaggagggtgaaggatttatccaaccctattagtgtcatatgataggttatagaactatgttgctaaatacagtcatcattgacttttaattactgtaagttgtacataggcaagttaagaattgctcaaagcaatggtgatcaaaattttatttttcttagtgaatcagtgagagcgacatccatatatagtattttccaatattccttgacaatttggcattaaatatttatatacctgaaagtatttacttgaagtttaaggcaatatttgagacataatagaaaatgtgctagagtcagtatattattagctccctgtaaggacttcccctgtgggatgcaagagagctacaaggaaatggccactctgtgtccgagcgagaacaatgggaatattttcgtgctcacgagagatggggaaagtggctgaggaagaaggttttttattcttaattgatgagatccctatataattaacttttgttttcaaagtcatccaaccagataacagtgaagttatgggagtacttaagatggttaaaacattttatttcaagcttcattaccttccacttttaggtatttctccaacgttcactgaagtgttagtgttcattttattaaaagtcaaatgaacgttccaaaatgatatttagtacgctaataattcatagaaatttaaagatcatacggagaactaatttcacaagtaagtttagactaaggggcttacatacattttctcctatttttatctctagaatttaatattatttccccactatatccagtccctaagtggaaccttttatgggtagctaatcagtgacaagttaccccaatctgagaactgccgtgagaatttaacagacaaataatagaatcatgcatgatttcaaatagaaaataatgtaatagttgctatgttaatttctatatgaaattatgcattattccattattatctagtaagcaagatatatatatatatatatatatatatacatatattgattttgacagttaaaaacacatgtagaaatcccctttgaacgaattttattcaggtaaatataacatgaataaggtatgatataaaaaagcactcacatatgtttaagtaacaaatatattttatatttccagaaagaaaacatagtaaattcataatgaactacctcatagcctctggagctattctgtattccaaagtgtggcgtaccagggtctgggcaggtgttatgagcaggatctgaaatttgtgatttaaaaagaaaagagggcaccagatatagttattgtgagaattttaacagctttcactaaaaggtctcatgaaatagagaaaatattgttttgagaaatgtgcaagatgtttttcaggaaagttaaaaattaaattgctacttttatcttctcttcaagacatgttttttagatgttaacttttagactttaagtagttcagtatgttcttcttatataagaataagtgcattttttttccattctctggcttttttttctatagaaatatatttggtcaatgatatactatcttcaataatgacctatcactatctttttgcttattaggattcaataattggccatctcatttggttacccattacattattctgagtttctttaattaattttcctcaacatttcaaaatgaaaaatatatttaatgcttcataatggaaccacatggaaaaccaagagtgacatttttcaaaaaacacaggacttgggtaacccagtggcacttcagctctcttacttgctgctctacagttaccagtagaaaaacaaaacagataacttcttaaaacctgttatctagagtgactaaccttctagggggaagaaaaatatttttagtgtagagatagctactgtatagcaatagtttaaatcaaatgacagcaaatattcttctaattagaaaaaatgcttcaatgacaatatttctttaatactatattttctaggtggatactattcaatttcttagaaaataatcaagactaagtattacttttttactaaaaattagtagaacacccattattctgcttagtaaatctcaatgaacaaaattaacccagcgataaaacttgactctgcagcaataaaacaacagcaagactgtctctctggggagggctgctttagagaatgttcctacctgcacctttcccctaaacaatgcaattggcagttaaggtagacagcggagagagccactgaggtcagagaacaaagtctagtagctactttagcagacttctgacttattttgcatgatttaaaagaggtggcacatcagtttagctgatgagtgcgcaatcctactcagtgcaaaaattattaccttgtacagaaaactgtctatggaaacactttctatgtaatcacaaatgacccaatttcggaatgaagcgtcctcatctccaaatactcccaggtatccccagagctgtatgataattattaccaatgcaggtgggttgtatgccgctccacgtgccgtcagcttggcagactcttctggaggatcccacgagtataaatggagatttgcactggaagaagacttcggacttataggtgaaacttttcccactaagtcgcccttctgcggggatgccagggtctccgcagaacacagctatggaagataaccaggaagaagtcagccttcaacgtccctggatcagcttcaccaattgagcttggtaactagtttctgttaaatctttagctttaactattaaacaagaaaaacgctaaaaggaggccaggcacggtggctcacgcctgtaatcccaacactttgggaggcagaggcaggcggatcgcttgagctcaggagttcgagactagcctgggcaacatggcgaaacctatgtctacaacaaatacaaaaattagctgggtttggtggcacacacctgtagtcccagctactcgggaggctgaggtgggaggatggtttgagcccgagagattgaggctgcagggagctatgattgaaccactgcactccatcctgggcaacagagtgaggacctgtctcaaaaaggagactctgcccttaggcaacacagtctcaagtttgagtttttgtgtattttagggctattattacccaccaggaaggtcctcagattgtaaccttaggatgtgccctggttatccgtccctgttgcagacctgcagtgggcggaacaaattctgctgtagaacttacggagacactgggggatctctcctttccacaccccgcgaccttcacaggagaggatggcggagtgagagagctggtaaccgtccatgcagctgtaacttatgctggagccccagcggaaatcacttccctccactgttccattctgcaccggcggcggctgaggacacagcacggctatttccaaagaacaaacaagatcaacattccggagctcccgctgcagcggtgatgttcaaacgattcccattttaattttacctgaattacaaatgacatctacataggtttttaaaaaaaaataataaaagaattgccaaggaagacagtacatcaaaataacaaaatattttttagaatatttcttcattaatatcgatgaagtctataaaagcaaagtcaagtcaaaacatataggattgaacatgacattcccaatatatacaaggccaagaaaggaagaaacgttcttgcttaatttgtgtctttttatgatggttaccaaagacaattcgaatgaggatttggtcagatgacacaaatttataggcacagatggtaagaatttttctggccatctgtattttttatttaaagatggcatatagtttccaaaagacacagtcggtccatctatttactgaatatatttttttagaaatgcctgaatggttaaagaagatgctgtggaataccatttgcaagtgtttcatcacagccttggagcctgatgtccactttatggggctgagaagcaagcacgtggttgctagggaggatttccccgagggtgatgtcacgagagatcaccttccccactctagaaattatactaaaatgcacaaagggaggcaaaaatccaaaaaccactgtctaaaatccttcttctctgaagatacacaacttccctagtttttgaaatgaatggaagtttccaagtgaccctgtaggtagcagaaggcactacaaaagaacaaccgcttgcattttgtgtgttcaggctcatgccttctcacgtgagaaagacatgccaacacacacaaatcacatgtgcacacccaaaagttggaaatgggtccttccctcaccactccaccttctactgatctgttcactcgttcaacaaatccttcctgagaccccacagcgagggctggggaaatgcgtgttctggcccaagggaatgtccagggggaggccccagttggaagagacctgagctacatgggtcccctgggggcagggggaatgggaggagacaagttcaaggagggacagagagagaaagaggtcccatctggtagggacttgctggccgtggtgttgttacaaacacaatgggtactagaaagaggataaaaatccacagaattatgcatgaagcatattttattggcaatttccatcatgaccatttgacctgaatactgccgacacaacgtagtgcattttcattcaaattcaacatttatttagcgtcagctatatcacaggtgcagtattaagagttacaatacaaagaagggaaggcaatgagatcctttgactctactgggagacgaaagcaggatggtccaagaacacgcccatgtcagaagagagagaaagccatatttttgagcattcaggtcacatttaagcctctgccacatttaaccatgtgtcttgcagaactcaccgaagatgaaaccttctccataagctactgagtgtcctaactctccctccctcagtattttatttgttcctagtctaataaggaggagaatgccatcttcttatgtttggtcactgacagctttcaagcccctctctccccctcttcttgtccttcctctgcaccagctgataagaaagtctggatagttcttctttgcttctggtaaataaactgtcaccacgcaaatccctggcccttgcacagccgccactcagccctgctccctgtcactgtaagagccaagcccactcactctgctttactgaagccaccttgatgagttgagcctgtcttgatttgcccagagggtccagtcacataagtcataaacctcttcctgccttctcggccagtgtcatcttcagtctcggcaaccaaaccccatgaaacatcacggtgctaacactctctaccagtgctctgccattactaggtgattggctcgtctctccaacctgcctctaaattcctacaattagattcaccatgccacgaacacctcacacagctagggtcacaggtttacccaggacagcaaagcactggggttcagacacagactctagggtggcgtgaccgtcactgaaccccgacatctccagttcctggtttgtgatcctaagccttttcctctacctcgctatgagttagtttttccatctgtaaaactgagattaaagtattataaaaataaagtgacttaatagttgcaaattgctgttcaagaattcctagcccctagaagggctacataaatgcttgcaaaattaaacaaagcataattcaataaagacttctatacacatctgtaaaatccaaagagtcaccaaacaaacctttgcagacaggtttgctcggattccacctgccgtctttggtacagcgaatagtggcggatgtgactgcttccatgacatagcctgggttacactgatagctcacagtcttgttgaaggtgaagtcggtcccaaactggatgccatttgctagtgtgcctggatccccacaacttataactaataaacagggaacaggaaagaatcagagaaattcatttaccatgaaatgaattagtcaccatttctattcaagatactctctctgagttgctattcacagtggttaagcagtgaattaatacagcaatactaccctctgtgtgatgatttcactgacccgctgtcagaaggaacacttgtattttgagaatcactgatttctgttccgttggcagctggctgtcagatgctgacttccaccccttgactagcccctaattaggcatggggtataatcagaaagatgaagcctgcagccagagaaccaaagacatttcttctttctctgcagacccagtggtctacagacaaagtctggacttttttggtctcaattttacaatgtttgactgaactggccttttaaagtagcttcagccatacgaataagcaactggaaaaaaaatcttaaagtacttaagaaatacagccacaatgtcacacatagttttcccttttttcctctatgaattaaaaataaaaaaacagtataacaccttaaagtcattttttttcccaatggagtgaatttcatagtaacgtctgagtctaccatgatgtctgcttactaacttgtgcagtcgggagcagtgcctgtccaggtcccattggctgtgcaatgccgtgtcatgagccctgaggtcttgtagccttcccagcaggcatagatgaccgagctggagaacagaatgccatcactactgacaatcattccgttggtgggtgtgccagggttgccacaggacacggctgttaggcaaacaagaacaccaccacacacagtgagtgacccagcatgaaaatggcaaacacaagagaccaatgggtatcagtgcaatagactacacatttattacaaacccaaagcacacaatcctatggaagttccttaacatatggcttactatggctcatatgtttattttactgattagctacaaatataaaaataacctttcaattcgtcttttctaaagtgaactatttctaaacaaattaaaacatgagttaaagcactaaaagttcaaggccctgttattcagggactgaatgtttttaatagccttgctatttggggattgaatgtttttaatgccgtgacagaattgttgtgatttttaaaaaagaatatctatgatattagcaacactgaagcatcttcctttatgtaatcactgtatttttttaaaatctaggcaattcaggtcctattttacatctccaggagaattcactttggaaaataaagaatgcctcagaagtatgaatgactgtacttgaactgctttgtaaaatggtgtcctcaataattaccagctctaatagcagctgtgttaattggctttgacatgattgaactttacatttctctcaaaaggctcctaatgccatgtacaggcaataaggcctcaattaacgatggtcagtgcaacaggtctacactctgtgcctattttttacgctctttagtcagtaaacaaaagcaagctcggctgccgctgggtacgtttcagggtgaacatttcaatctacacttttttttttcccttttttagtcgagcctatttaccagaaagattgctacattttctccttagtactgttgcaataatatacaataggcaggtaaataaaggaagtgacccttggctggttaacaagaatatatatcatgagactgcctctgagctgatcaaaatatttaaaaatacttttgcacatttaattgaaacaatttcaaatctggcctggagaacaaagatatatttttcttaaaagaacatggaagaaaacatcctgcaaaatttgctcagcacagagaagtcactgtactgggagtcgagggactacccttctgattacatagaaataaagcacttgtgctcaggttgaactggatcttgtttgaaaaaaataatacaaagtgcacacgctggtgcttcctggtcccgtgccaatggcagacagaagtactcaatcacagccctcttctctgatggttcacggtgtgacttccaaccccttctaacacagacctattagtagtttcctggttggcatatgagttgggatgtatttaccaatccagaagcacatactatttaaggctctctaaaacttgaaagttttatgataactatactatatatcaaaatttcattttgcaataattaagggttggactatccaagacaactattcattcaacaaacacatattcctcacttactgtgcaacaggtactgtgtggatgggctaatggaaagcctgtcacagaaagggagtgagtttggtccaattcatagtttaacaaaccgaaagaggacactgatgttattgttacattgtattctaattacatttgctattcaattgtatgtctaaatcttcaaaagccacctaggtagaaccaatacttaaacaagtcaaataaccgatgaaaaatttcaattcagtttgtaaggaaactaaaatgttagtttgctaatattgttaatgaatgagtaccagcataatgctatcctaatattgggaatgtcccctcaaatattgtactgtggaaagtaaaattcatgattagtttttttctctttttttggctgacaaaaaccactttcactcacggttataactatgaaaatgactagaaggcaatgtcaacatatccgcttttctatcaatgcaattatgtaaaattataagacaggactaagactaaaacaaaacaatagattaaatttagaggagaaaaaagaacaataaattagaagaggaaaagtaaactggaagaagaaaaataaattaacctgtaagtttaaactttgccatattttctctttcctgagtttattttcttttgaaatatgcttttataaaaagtacattttgttaacgtgacttcttcagctaaaacataatttctttaactcagcatataataaaatattatgcttattttaaatatactttattatttacaaatattagtactgttcattttgcatgctacatgacaaaaattgctgttaaattgagttaaatagatgtgaatatctgctcatgcaagttaaataaacctgagcaatcaatttaaattccttagatatagtgcctttaaccataaaatgagtattataaaaatacttattcccggctgttaccaaattacccacgctatatgtaaaatgcctagtgtgagatctgatgtattagtggtagcaatgagttagcttgtagcttatgctattgttattttcatcatcatcactcttacttattgagtaaagtgtagctttatcataatttcatctgaaagagaattaagagttccctaatacagctgaaactaaatattttagttatgtaatgcaacttcatgagatagatccatttgaaatcttaagcttgagcctatgattaaaagactagatggctaacaaaagcaaatttgatttaatgtgaaggaaatatatctgcaatataaattctttgagttgaagaatttaaaaagatttttcgtttagaattataatttcctcctcctttttataatttattcaatttaccatcagtatctaactttttgacagatttagaggaaataatttcatcaggtttgcaataatcttaactaggggattagtcaagtcatagctagtcatagaagctacgcttcctggaaatgcaaccactggttacatcctttttcatcgagaggaactcacacttcagtgatttggacctatgataacaaacaaggaacaaaatgaaaacctacagattctccaaaatgtatttcaaatttttgctggtgtgtgtgtgttcagtcactgattttatgacttttatacataatttgttgccttattgggtgtaacatatattgcagtgggcttattcagcttcccatgatgtccgtatcatataatgcagttttagaagtaatcaattttgtgaggcatgatatatttgagaaatattttcagcattgcaacatttttgtaacttattttgtgtatgcagcttttaagggctaagtttctaattttttttcatagaaaacttttaaatgtctaactttagaaagcaaaataaaatttttaaaaatactttgcattgcctgagttagatagattgggaagtgaaacgcaattaagctctcattcaaataaattgtttaatgtgtactttgctggactagaactcatagtgtgccttcatagccccacagaggtgagattgctaaggaaaaacattgcccaccctcaactgttataattttgttcatcttttaagttttcaaaactgaaatacttgaggtaaacatgatactgaatgtacagtctcaagtgaatggccatctttgatagaatatttcatattccactttctgggagtgtcagagtctctgctcttcatacaccaagttcaggctgcaaaccagggtttaggctcaattattgcatttaatattcttgaaaacagaaggatagttctgcttttaatcagcatcagattatatctataaagtctgaataattattccagcattcacttattgacatccagccctctttgtaactattgaggaaatattttaaatttcaattaaaatactgccgatgagtgatctttcagcctctctgtttttaaacaatggagaattaagatccagaaccaagactttgtgatcactacatagaatcaggtctagagccaaaatgtcacaattcacaaacccaccatggtgctttccaaaagtcccgaatgataaatgctacagatacattaagctactgttaaatgggatttgacagaaacgttgaaattttactatggaaattgttttaatttattggcaacattttttgtaactccacactttgttataactacaggattaaacaaacttcacaaaaagattataagccattcttacacaccctttagtcagattcatccactgtttacattttgctcactttttctccctctgtctctctaaatatgtattttctaaggtatgtgagtgtaagttacagacatgacaactctttagagttaaatatatcagtatgtatttcctaagaacaaaggcattctcttacataaccataatacaattattaaaagaatgaaatgtaactttgatgcaatgttgtctcatacacacccataatctaattcacttcaagctcttggacatatttttaatagttgtcttaagatcctgtgtcagttcgccacctagatcatctcagggtcagactctaccatctcggtaacgcctctcataactctcttttgctcagtgtaggacccaatccgagaccacacattgcacttatcgggtctcttaaatctgaaagaatcactcagacggtgtcttttctgaacttgacgtttcttcgtgaacacgggcaagctgatttgctgcatgcccctagggttttgggggatgttattgctgctgcttcaggactcgattcaggttacgcatttcactggcaataccatagaaatgacaatgtctcttttcagtgcctcatatcgggaagatagaacatcaccttgttaaaatattggtgataatggtttatcccataggattgcttacctgaagtactatatgaaagagtagaaaacactctggttttggtgagaaaacattgctctcatgtgcaaattttaatactgaaatatctacaagatgagagggaactgaaaacatttgcatttgattaacaaatttatatcaatttatagtgtcatacttcagttaaaaacaaaagtatgatcctgcaattcgtgactatgggtaaccatttctcactactaatcagtggtatttgacctaagacaacttttttagggcctagtcttaagatttatactactttgattgtcaagaggcaattcagagtaaaaaattatcttggattatcatgtttgtgtgcacatatgtgtatgcctatattatatgcatatatatacatatatagtcaaaaatagtctttgagaaaaaatatatacactatgcatgggtaaatataatatataaatatgcaaatatatgcacaaacattcctatattaatatttagcgttattttatatgtgaaattaatgttacatagattatataatatagatagatcatatacatacattatttctatttacctatatagaatgtataatacaataaaggcagaagtggagacagtatagtcaaggacaataaatgaagattaaggaaactcaagttaaatttctcacattgatagtgtgtatgtgagcttactcaagttggtaaaattatttggttggaaagtgtttcatacatacaacaatacatattgaattaatttgtataacctttttagactgaaaatttaattgaggagtttgcttgtaaagaattcctaacatttacattcctatctgtctgaattctaaatcgggttttgaactccgaatacatggttaccatcacctctcagttcacctttgcttgaggctacatttctgatacacagtgcagtgtctataaggtgtccgtggctattcttactgtcattactggagcataccaccacttcctacgatgcctctcaaacattagaatcaagtagacccactccaaaatagttcatagaatataaccccagattcctgtgaaatagagtgctccacacacaggggccaccaacagattggaaatgacgtgtgaaggaagcctgcttccagcctgcggaaattcccatcagtgatctgcattggtcctgctcactgctctggaaccccactcactcactgccaggatctagaaaacactggcaacaccacatatagattatcactgggagaagattagaagcttccgtgttacgaactttcaaacaataagcatccgtgtgatgggacctgtggatacttggaatacctccatgcacccagtcatgatttctgatgatgcttccacaaatattgcggggaaaagatttaattgtataaatagtacaaacctctagaatttttgtagaattttgccaggcattttagaacgagctgtgtggttttaactttcaaggtggaccttaaggcttctggctactcaccctcacacaccggctgcagtcctgaccatgacccattgagcaaacacgtgcgttcaggggagcccctcagctggtgccccatttcacaggagaagcggagaagactctttgtcttaaagtcatcaccaagccgagacccatgtgctggggtccccggatcaccacagaatccaggattatttcctattgaaaacaaacacatacggcaatccacaattgtgttagacttgttttaagcagagttgtcacacttaaagataatgaaaagttgttgaaatttgtgtttcacatgagttatggttacacaacattctgcaatcttgtaagaaagaatttctttgtgatagccccaaaatgaaaagaatttaggatgtggctcccatgttactaacttcacaatagcctattcaaatatggttgtgagaataaacgacgtttcctttggaaggaggaaaatgccaggaatggtaaatgcatcacgtcttcactgaaaaggtaggtagagagcaaaaggaaaatggggctttaggtaaacagggaatgtggggaaaaaaaaaaaaaaagtcaaaggagaggtttagctcttcagaattgtgtccagagttgctggttcgctgaattttggttgtttaagaaacattcgtgaaaaaaataaagataatgttttttttcttccaaagaggacccatgcggttaatggtggtagaggatgatggtagaggatgatggtagaggatgatggtagaggatggtggtagaggatgatggtagaggatgatggtagaggatggtggtagaggatggtggtagaggatggtggtagaggatgatggtagaggatgatggtagaggatggtggtagaggatggtggtagaggatgatggtagaggatgatggtagaggatgatggtagaggatggtggtagaggatggtggtagaggatggtggtagaggatgatggtagaggatgatggtagaggatgatggtagaggatgatggtagagggagggaaaattaaccacataaaaaagaataaagagcgaacagggacacacggagccatggccggcaagcgtcctctcaaatgagatccagactctcctgagaaccccggaggagaacatttaaagtaatggtgtctaacgattattgcgaagatgaagacaatatctataagagcggcgtatttggctagaaatgcaatactaatttcaaataaatgcataattatagggcttttcaaataactgtaaatcatcattatttgaaatcactatttgaaaagttatttgaaatctgtaattctgtcagttcactcgtaagcccctcacctgtgcagtggggcagtgccccgctccagtgactgtcttcctggcacactctcgtgtcgttgcctatgaggctctcgctccctctgcaggagtagtgcacgacggcgccataggtaaacagctctccagtgaggacggcgttggcagggacccctgggtgtccacacgatatagcttcagaaaaaagataaaacaattgagtacatccttccagttaaaccactttgtattggaaaatctcccatacagacacccatactgacatcatgtattaaagaaaaacacctaaatattctggtacttatgtaatttgtgagaaataccaattttcagatgacacttcctcccctaatttctttactgaaaaggaaaggtcccgtttatgaagtttttgttttgctaaggtagctttccttatggtagaaatttacatgtggattttcaaggagacagccatactgcctacatttttccatcgacccttaactatattccaaatgaacagtattataggaaatttgcgaaagtaacatggatgcattaaaactatttccacgatgttttcagttaatatgacaatcatattctttgcttgcggacatgattctgtcaaatctgcttaatcttcaagctcacatgtctaagaaaaccattctaacagttactctttgaataaggggcagtctaatatgtataagtaaaataataataatcaattattgattcatttgttcttcaaattgttctataaaataatctcattatttcccttcatttccttaaaattataccaaatcaggcctaaactctatttataaatatccttcaaaaaggcaaactctgtaatccagattaaaataggatagtgaagatttatttttcctttactgtacagtatcaaatgagggctagcaatggacaaatttttatctatatgcaaaaataaccgatttgagactaccaaggaattactcaaaggcgactgctttagtatcctagagtaattccatttggtaacgagacacccagaagggttatcaaccagagaggtagatttgaacgcctggaagccatggccatcccctgagtcatatcagccgtcactttctgtcttacatggacattgattcattggagaaccggattttatccacatagagtccttaaaagaagccagtgagacctgaaacagtgaaatgctggataaatgaccatttccaggtgaaataaaatttatatcttatttaaattttaaccttcagtgaaacaatatcacagcaaaatcagacatggagctcagctgctctagagcatggaaaagcaaaggcaccctgagatctttggattcccaaagtgacgacaattccaactgttaatgacaccaagcggagtgaactggccaccccggaaaaggagagccagctaaaccccagctcctggagacttgaggaacatcagcatcagtacaaaaccaaatggaagtctcacacaagccagtggagacataaaagaaatgttctgggacagacaaaaacaaaactaaaccaatttctatgaaaaattcccatgtgtgaaagcaaggaagatgagaatgcagacataatttgaagaccgtaacacatttacagatgcattttttgttaaataaggctgagaatttttttgaaagttaccactgtcgttctccacaggaattaattgaattgttgaagttagaatttgagatgagtttctgtgtagattagaggaatgtgagggaaactcacttggagaaaaaaaaaaaaactgcaacactaacccattctcaaaatacacttcacagtgctaaaactgaaaaggcaagaggcattatcccttttattgtgtatgtggtagatccgattcataatgtaagtgccatttccctcctcatttctatttttatttttttagagatggggatttgtttgctggccagcctggagtgcagtggtgcaatcgtaactcctggactcaagtgatcctgccacctcagcctcccaatgtgctgggactataggcatgtgccaccatgccccactagtttttattttattttttgtagagatggagtctggctaggttgtccaagttgatctagaactcctggcctcaagagatccaccttccctggcctcccaaaatgctgggattacaggtgtgagtcacggcacctggcctccactttctttatggatgtaaaatgcataggacaaagatcagattttgattttaaggattgctttgcttctgcctaatttcaaaaagactaaagagagtaacaccttttcctaaatcttcagactatgatcttaagacatgattctcttttagttaacagtcaatctgatttttttttcaagtcaaagaaaataacactttggctatttgggtaaaatgatatattcttgctaatcttcatggtctaaaatacactgacaataaagctgtaagaggggccataaggatcatctataattatctctgcccagaagaacacatccatttttcagagccatatcccttcccctgatttaaagattcaattcacaagccaattactatcaggatatgaggtttttttaaaaaaaaaaagaaagaaagaaaaaaagatttaataacaactttattcatttattttttatctttatttaagttctgggatgcatgtgcagggtgtgtaggtttgttacgcagggaaatgtgtgccatggtggtttgctgcacctatcaatccatcacctaggtaccaagccccatatgcattagctatttatcctgatgctctccctccccctaccctactgacaggcctcagtgagtgttggtcctctccctgtgtctatgtgttcagctcctacttataagtgagaatttgtggtgtttggttttctgttcctgcattagtttgcagaggataatggcttccaagctccatccatgtctctgcaaaggacataatctcattcttttttatggctgcatcacgttccacggtgtgtatgtaccacgttttctttattcagtgttttactgatgggcacttgggttgattccatgtgtggttattgtgaatagtgctgcagtgaacatacacatgcatgtatcatgggatctaactaaacaaaagagctttagcactgcaaaagaaactatcctcagagtgaacacacaaccaacagaatggatgaaaatcgttgcaatctatccatctgacaaaggtctaatatccagaatctacaaggaacttaaacaaatttacaagaaaaaaacaaccccattaaaaagtgggcaaaggacatgaacagacacttctcaaaagaagacatttatgtggccaataaacatatgaaaaaagctcaacatcactgatcataagggaaatgcaaatcaaaactacaatgagataccatctcatgcctgtcagaatggcaattattaaaaagtcaagaaacaacagatgctggcgaggctgtggagaaataggaatgattttacactgttggtggaatgtaaattagttgaatcattttggaagacagtgtagcgattcctcaaagacctagaataagaaataccatttgacccagcaatcccactactgggtatatactcaaaggatatgaggtttttattgtagtcaccatggactgtaccaggaatgctcacaaaacccaatcaggtctcacagcactcccttctttggccgtagatgccaggtcaacagacagaaactccacaccagagcacttcgcccacctgggctgagcgagagtaagacgcctggcggggaggtcctggctgccgtgtctgagctgtgtggaccaggcctacctggtaggctgaggctgaaggcaagccatgagaaaaacagataaaggcatcattgtccaagtggcatccaataacctgggtcatttctcctgagcataccagcatcccccgacccttcaaatttgctgaagttgtatttggtgatttctggccactcgatctacagctatcataaaaactcctacaattggtgatgggaggacagaaggaattaaaattcagtgccttttaaatatacttacggaattttctgctgatggtgaccttgcaggggtctctgcacagaaattgggaataaccctgacttacccaaacacttgggcagggatcggtcccataagccatttgccatacaggtcaaggctgaagatcccagcaagtaaaatcccttcttgcaatggtacaggatactcattccatactcaaaactctcagggaagttctgttgcccgtgacgaatggcattttccacaaagcctggatcagaacagttcaccactagaaaataaaacatttcacacaccatttagaaacagctagaaataacaacaaaatagatcagaaatgaaggcgaattcctcatcattttagaaagttcaaaaactgacaacatgatggctgaggctcatgaaattccactctcacgatgaattctccgctttggaccactctttttcaagaggtgtcaagaactggtcgaccacgatagcaattttcacgtgaggctaatttcctctatttcctagtaatgtttattcaacgtaaattctgaagttagtttccttggttaagtttttgtgttctaataatggtcaaatagaactagctgaggttcgtttaaatatttttactcaagtgtggtgttttagaacagtctgtggcacaccagttaattaccccccaacacacatacacacctacttgcattagtgctttaatatgtgtgcctaaaataattttgctctatgtagaacgcaactaaaaatgacaattattccatcaacacctaacagaaatgcaaatcaagccagcctctgacttaggcctcttctccttttagaaacaggtccgtggtgaggcagtcttctgcggcatgcgggacatgctgtggttcctctgaaaggcattagcctgaatgcctgttggcgtctgtgagggaattagcgatgtgcttttgcaggtgcagaggaaaagaaagaactctgattacctcatgctttgacccaccccaccagtgaatgaggcagctgttccagaggccacagtctctccagatatttctggctcagaaaagcactgtgcaaatgaatctcgggcggcctctgcacatcatgagtcccagaagctgaagacaaaccctgtacccaaactgtgcgttttatttcttctctattcaaaaaaggaaggcagagggcagaatcaaggcttacagtgttcccttttagtgcagtagaataatgttctatgcttcctaaaacacccctgagtttacagaagaaagtcttgagttcttttgaatcaaaaaagccaaaacaaacaaaaagccatgtgtgaagttcgggcaaataatttttaaggcatgtacatgcccctacagggcatgtatctgcaatacaattgtaaccaaatctctgaaatagcaggaattacctaatgtgagaaattctaattaacttgaaaatgtgattatttgtataacctggaagacacccacatcgtcccattcttacatcaagcataagagatggaatcagctcccccatgccatactttcataaggagacggacagtcccgggctggaacactaaagatatttttgtgtttatgtttgtgcttatgttgctcttaggagactgtccaaaaataatttcaaactgtgtttgtaatcaaagcagagaaagccacttaggagaaatgagtggaagactttgaccatctcccactaaggatgaccgagagaaaccaaatggccccgggatgccaaaggccagattgagctgatgccaccatttctcctcctcctcctcctcctcctcctccatttcctcctccacctctgtgtcctttcttcctcctcctcttccttcttctcctcctccacctccttgtcctctcctcctccttttcttcctcctcctcctcttcttccatccctctcttccttctctttctcctcctccttctctttctcctcctccttatcattttcatcttctctttggcccagcctctcttaaaggttcactggcagacatttatttactggtgcagtaacaacaggatccagtcacacccttctccttgcaggcagagaaccaaatgttctctgagttccaccacggctggtgaaggggaatttacaatatgtgaggttcataaccttgctctgaaactaaggactaaaattctctttaagggtcactcttgccgtggaaagaggtgcgcaggagacaataaacccctcattcttgtaaatcattttgcaaccttacattgcattagaattgcttggaggatgtgtattaaaatgctaagccctaagttcctaccctttcctttacctagttcactacccttaaaatattttgagcagtaaaaaatgtttgaaagcaataaatattccttgagccccatgtggggaaactcagtggatcctaaaatggaagaagcatggatacaaatactctaaatcttctcatgcaccttttcagtcctacatagagttgcagtcagaagtctttctttatgttccttcctatttaattctgaggctccaataggagatacagctgcaactatgtgctggaggaaaaacagggcaggaataatttgatttatttgtccatgatagaacttccataccattgttgcaaatgggtgtgttttactgtacagagaagaatttatctgccagaagagtttgttagtgaccaaccaatccacacaagcacctttcccatctgtatttgttttgtcattttctatgtgaacaattcctatccagggatctgatggaaagaggcttatgtgagtgacaggtgagctattggtttgtaaactagaaggagaaatggccagtgaagttcatggtgcggagatatgtcaggcccacctgcagcgactccagacctggttcatgacatgctgttaagtatagggtaatgcgtcagaaagaaataaagaggctcactctagacggctgcacctcatcttaacatcttaatgcctaatacactaagacttgatttccaagtgtgaaaacctgacatggaacctgattttgtcagctgggaggaatgagaacactgatgtcttatatacatacagctcagcgtggattttgtcagctggaaggaatgagaacatgatgtcttatatacattcagcccagcagggagaagttcaaatgaacacacaggctgtgttctgtggcgaaagctgggtatgtggaaaggtaaaagaagaaattaataccgggatcaataacaggtccaaagtcacaatgacaattgaactagaaatacataagaatcaggactcctgaacacatgtctggtatagcataataataaaaggcatcagcattccttggtgacaggaatcccagttgcaccccacccctttttcctggagaggaccagctggaaatcttagccctcgataggattctagaggtgactcattaagctattttctctactctatatacactccttactcagagatgtcttcttaaagatgctcaagttgacatacgaatatgggtaacaggccaggtgcggtggctcacacctgtaatcccagcactttgggaggccaaggtgggcagatcatttgaggtcaagagttcgagaccagcctggccaacacggcgaaaccccatctctattaaaaatacaaaaattagccaggcatggtggcaggggcctgtaattccagctactcaggaggctgaggcaggagaattgcttgaacccaggatgcggaagctgcagtgagccgagatcatgccactgcactgcagcctgggtgacagagcgagactctgtctcaaaaaacaaacaaacaaacgaaaagcaaatatggataaacataaggtcctattgtttattctctttcaaactttcttgaggatcatggaggtccttcctatccagtaatgtccccattctcagttaagtgaacgtactgatcgcctgatgaaggaagcctgaaaacactgtgttttgagatttgatggtgaattatttgagcagttttgccagctctaagagggatcactgttcccgtggcatgcctcacaccgtagtaggtctcagcaaagcacccgcactatgaccgcggctccacctccaggagctgccctgtcctgccatgtgctcactaaccagtgtttcccttttaattcccttcttggggacaggaagcaaggtgtgctccacatcctcgcttctttccagaacccaaagcaatggcagtgttttcctgaaaaactccctaatgacagagaaacgtgataattcccatcccaggttccttctccagctgttgatcaatagaaacgaagccacctgtctgcacgctggtctcttataggcagcttggctctaagctgaagggcagtaacagggcatcacataagagtctggtgtcctctccatggcacagatgctgggctcttcgggcagacgactcctaacataactttgcaggattcgtatctattcgattccagcctgttatgtgatgaggaaacaccgtgaacacttcaactgttttttaattagataatgtaattccaagttccatctgttgttctcagaaaaactttttataatcagttcttatattaaacagaatctatatctgatatatatatacatacatatatatttttttttgagatggagtcttgctctgtctcccatgctggagtgcagtggcacaatctcggctcactgcaagctccacctgctggattcacgccattctcctgcctcagcctcccgagtagctggtactacaggcacccgccaccatgcctggctaattttttgtatttttagtagagacagagtttcactgtattagccaggatggtctctatctcctgacctcgtgatccgcctgcctcagcctcccaaagtgccgggattgcaggtgtgagccacctcgcccagtctttctgttgtatatttttaacttcatttatttattcattaaaatgtattacttaacgataattatagataaggctttacttgaaggctctgagatgattagagcagaaccgtggactttcacttgtatatccaaaatttggcaaaaaattgtaaatctaatcgtaacccaaagtaaagcacttcccagtctttggcatcagcactctttcctacaagcacaatagtttttaaagaaagtataagcaactatgatcgaggtcgtgcctaacttcttatttttgtagaagctctgcctggggccaaatttgttcttatgtgtgttgattttgaaaggcaaaccatggaaataaagcttagtttttaaatttcaatataattattatacaaaaaggaaaagtaaaatcgaaactgtcagattaaactttaaaagctaaatgctatgggctaagcttttatgtgaaattaaaaattaatattaagcaaaattggcagaaatacactgttacagtatgaactggtaactcctgttccctgagcaaatagaaaactgttaattactaagaaaaaaaataaaaccaacttagtgcaagttctgtttttaaatggctgtgagtgacattctgagaataaaaggcaactaactttccatacatttggaggtgcactgagagaccatccgtttatgtcgctgcctcaaatcggattcacaggaaacgtctgatccacgtctgtcaaattctgctcactggggcaaccctcaacagcagtgactgggagccgagcaaacgcacaggagggagaggtaggatgctgggaggagcatgggatttaaagaaacctgtgcgttgaggctatttatttactttttcttttttcccccgagaccacgtcttgctctgttgcccaggctggagtgcagtggcattatcttggctcactgcaacctccgcctccctggttcaagagattctcctgtctcagcctcctgaatagctgtgattacaggcatccgccaccatgctcggctaatttttgtatttttagtacagacagggtttcaccatattggtcaggctggtcttgaactcctgacctcgtgatccacccaccttgggctcccaaagtgctgggattacaggcatgagccaccgcgcctcgcctcattcttttacttcatgagtgctggatgaacggccagcgaagatgagcaaatagaagttgtcagagacacatagtggtaattttgggtctaggaagtcaggaatcccaacaagcccagcatcccgtgcaaagcacatgggtttggaggtaataaacttttcaatcgtccataccaccatcgacttcagattctgttggtgttttttaactcacacatatttatgcacgtatttaatccaacacgtttgactacacatcacctggacaagaggtttacatacccaacttaaaaaatacattgaaaatgttttaaagtataacttctttaagtttgaattttaagttaacagttaactctgaacagatactggaacaaatcagacctgagcttaaaattttggcagaaaaaccattattttaagaccatcattggcctcaaagcgactcaaaatcaatatacgtcccaatataaactgtgacacaatttttatgtcacaaaaattgtgtacagaatatagaaaccttaattctgtaagcagactggaaatataccatgttcaaagctttattttgttttcaaaaagaatcctgtggccccatcatgcctgtatcactagcttctgcctagttcaggaacacgcaaaacacatgatatttccacatgtaagtgagggaggagactgtggtgtgatactgctacactgtttcaccacgtgaggcaggagactgtggtgtgatactgctacactgcttcaccacgtgagggaggagactggtgtgatactgctacactgtttcaccacgtgagggaggagactggtgtgatactgctacactgtttcaccactttccttacaaaggttctatacaaagtcactaaattacacaatgcataggcaatatataggcaatactccttatagttttcttctgaaattttacttttcttaaaaaaaatattcaatgaagtataactgataaagtttaaagggcactgttcaaacaaacattgtcaactgattgacatacaaggaagaaagtcataggagagggtgactcagcttcactcaaggagctcagtgggaaatcaggcaaggccttaagaagttgctttgtcttaacaatagctgcccggagcaacaggtggacgggtctggtactttcaatttattctacaaggaaaccggaaatgtgctccaggaggccccagtggcttctgaactgctccttctacattctttgcatattgtgatcgaaaagaaagaagggaagggaaggggaggggagggaagggaaggggaaggggaaggggaaggggaaggggaagggaaaggggaagggaaaggggaagcggaaggggagagagggagggagggagaaaaccgtctccatagaagaaggaaggaaggaaggaaggaaagaagggagggagggactgataaccaggttacagctatagttttggcttttaggtgtgataaaagaaatacgttataatttattgtaattgacaattgtaattgattgcctgactttcctgcgataatataaactttgaagaggaaattcagattccctgaggactcactgtctgccaggcacttggccaagcattggtttatctagagctctcaaaaacctatgaagagggtactgtggctaccacttccttgattcttcatctaagaaaactgctgttctcccaggaagtcgagcatgaactgtaagacctgcagctaggactaggtggtgtgggtgcaaacacatatcagatcaacccctaagactgtgttttctctactcagcaacactccctctaaggcctacacagatattaatattttccccagttcatttattttttattttttttgagacagagtctcactctggctcacccaggctggagtgcaatggcgcgatctcagctcactgcaagctacacctcccgggttcacaccattctcctgcctcagtctcccgagtaggtgggactacaggtgcccaccaccacgcccagctaattttttgtatttttagtagagacgggttttcactctgttagccaggatggttttgatctcctgacctcgtgattcgcctgcctcagcctcccaaagtgctgggattacaggcgtgagccaccgcgcccggctctctagttcattttttaccaaagaaaatatgcctaatgcaaaggaaaaacattgcaggaaatattaatttggtgcaaaagtaattgcggtttttactacagcaatagcaaaaaccgcaattacttttgcatcgacctaataacacaaggaagtggcatatgcaaattctctacaccatcatatttacatcttgacttcagagactcttgcaagtacattccctcttaactgattttaactcagccctaaggcaaagttacaactaattcttaatggtctctccgactatattatttccaggctttggatgtatttttctatcatattttactgataaaataataaacagcttatattaagggcatttagcatttgcaggtcaagaagaaaggcaagttaactctctgagctattaaaattttaattaaagaggcattaattttataaggataattcttgacatgaaaaattcttcatgatatatgattacacaaaaaggcaggttataaaagagtccataggaattatatgtaagcttatgtgtgtatacatcatatatataaataagaaatatataagtatataagaaacagaaatatttctttctatataatatatacataaatatatataagaaatatataaagaagtatatttctatatatataagaaatacataaaatgcaataaaatctacaataccttttctaaaaatcaaagcttattcactactattttgaaagatgattgatacagtacttctcttcggatataactcacaatttttgctgtaaggaatgtacactgcattatgagaaatgaacacatgacttttaagttaacataaaatcggaggatgaatgcccccataagaggggccttccctaagcacaagagtgatgcgggttcatcaccgtttccctctgtgccaggggacacaccctgccagcggcgcgcataagggcagcttcggggagactggagtctcagggtccctgggctcacaccaacctcctgctcttgacaagctccttcccatccacttccttaagcccaagaggagctttgttaagtcacatcactgcaattggttcatttaagttctgccatacatgtgcaggatgtgcaggtttgttccataggtaaatgtgtaccatgggggttggctgcacctgtgaacccatcacctaggtattaagccccgcatgcgttagctatttttcctaaaacctattttccccagttattaaaataactattttagctattttaacattagcttacatttcctttaattttaaaattttactattttaacattttgagaatatgttattatatcccatttttcattaacactttagtacaactaaacccataatgattctttagtgaagtttttgtggttgtttcctttttgattcctctaccctaacagaacattcactaaccccatattttcttaattttctttatgcttatgtacataagcatatctggacacatgttttacatgtgtctaaacacccaatcctataaaattatgaaagaaaagaaaaaacaatatcttaatgtttgcatgcaatacacaaattattagacaaagcagggaaacagtatgtgaatcatcctgaaacgatgtgagacctggtaaatctaactggtccctcactgaactggctcaactcttaggcatagtgacacatagtttagaataggggacaaagtttccaagaaagctcctctagggaaatatgggcctccaggagagtaggaaaatgtgattctcaaaataaacctgaagatgcttgttttcattccttcttatgacatcttcaactgtataaattatttcatccagaaagatactactactaataaaagggataccttcttttatttattttttaatcttatatgcaaagatagtgttactgggttgagtataatgaattttctttagtctcctaaatctgagttttctaattgatcacaagcactgcagggctggatagagctgcatcctgtgaagggttgaacctgagaataagcaggctacccagggtgaggtggatgttgtagaaatctgtgtctaattccgcctcacagtagcacggatttacctggggctctgtttcaaaatgtgggatggggtctctgttttgtgccattaactaagtgctgcaccagggtcacactcaatgagtcctccagattacacacttgagaatcttaggaagtagttaggaaaagaatgcaaagacaacagcacatttatgtgagatacaacagcctacaactcttgtgagaatattttaaaaagcacacacagtaagaatcagaccatattgcagtaaacagcaagaatccctggcaattttgttcagctgcttttttttaacttgaggtttttgagttttatgccattgtttcctgaagcttcaccatctttatgagtctgtcctctttgaaatattgttttttcctgttttaataacatgcatataaattctgtgtactagattgaatcttagttctgaaataaaacaaaacaaaacaaaacaaaatggaataatagaaaactaaagcaggcagacagctagggatgatccaggcacttctaatcaacatgacatgccaatgatggtccattaacctcctcctccatcccctgcttcatcagatatatttgaaaaagcagtttttaaaattaagtttgtttctatttttctaggaaaaggcaagaagtttaaaaaacaaaggctacattaatcctgaagagtttaaaatgcatcaacgaatttgtttaagctgtgcaacagacatggtatctagtggaccagagacagtatctgggatacagagaatgatgaataaatatgaggtgtttttaatttcttcttctcttccttgggataaattagaagaaagtggaacctacatacaaaaaaagcttttcatacttaaaagcccactcttttgagttcagttaatctctcattctgcaagaacaagttttgtgtccaatgcacagatgccacggcagattgggtgagtcttcctagctagcaaactcctctggtcgtctgcatagttatctacttaaagacacgaataattgtattgatggtgtctagcacatcatttgggatatagtaggtgctcaacaaatgtggcattgcatggcctagaaggctctagggggatggatacagaatgttctgatacacctaagacgtgaagacataattatgctgtccccctgtgtggaggtaactgggacaacatttgtggacattcattctcaatggttccttcagtcatgcaatttattttctgtcacacaaggaagagaaaagagtttgattaaagctgttgaatctttccttaagtccttgcagctgcatgagcaagaggctgacactaatatctgtcttcccatcgccattccggtcctcatagtttcttgtagatgtgcggatttcatgtattcctctgagaactgaatgagttaacgtgattgtttcagccatatttagcacagtgtgcaataaatatttcatgtatagcaaagcctcctggtgctagagacagtgggacaagatttcattcagctccggttgacacatttcagggtatcccctaaacccatcccccattttccatagcccctgactttacaagtgagcctctctctacgaacccattattatataataatcctatatagactatacgatcgacttgctaattttcaagctgaccagaccacccacattatcggcgaaagcaggaggttttgagcaagaaactagggacacctctgtgagcgattccattcctcctccctcctaaataagacacaatagaagcctgctttctggggagagtgagaacaaagtaactttgaggattttgttatgaatgtaagatgctctctaccctggaagagcgagaagcgatgataatccccatgtatttgttcagaagtattcacctacagcacatgggcccagagctatgcaaggtattgagcaaatgagatagtttgaaacttcgcatctgttagctgagcttattggtcagaggcatcatcccagggaagcgcagaactgctctggtctttcttcattcaccgcctttcccacatttcaatgtgatcttttcccttcagttgtagattgctttccatagggtatattagcaataggaattgactgctgctgcagatacaccaattcagataaacttgggctcatatcttttggcagcaaagccttatacaatatacatcatctaaaaggtgattttcttattgtcttgtccttcaacaggccaattatttctagggtgtgtcattaagggtatttattactttatgtagaaactacattaagacactcaatgttcttccacttaaaatcgcaatgctaaaatacttcttaatacacatggcactctgataaatttagagcttttaggttatatacattatttaaatttctgtaacagggtaaggactaaaacacactaaatatacatctacgaatgaaactgtcactgttggagatttttttggcaatgcaatcaatgagttaaatggaaataataaaaagtacaaaagtttatattcatcaaaatgaaaccagaatcattttctaaaaggccagatatggccttatcctaagacttttgaaaaatctcagagaagagaaaacatttctttaaaaaacaacctggaatttgaatttttttaacaacagacgtggttcaaaattgccatttccttatgagcaaacatttttgaaagtaaaacttgttaattaattgattaatgaaacataccctttttaaaaaaaagcaaaaatgcgagtgaatatgagtcactgaagtattcaaacgttgtgaaagtaatagatgttcagaaaagagtattcctgtgtttaaatacataaatagcatttggtctatggctgtatttcccatctgagaactgcagtagtcatggacagtcacagagggaaaatggggctgtttttaataaattccacctattacaaagaagcagtgggtacaaaagtcacaggaaatttcgtttaagaaggtgactacacagcgaaaacctgacgttatttcctactctactgtcaagtacagatgcttaaaaatatgttaaatcagtataaacataacagatttaaatattccatatgagaaacaaccagcttcttaaaattttagtgtgtatgtatagcaattctttcaatatttatcttaattacattcacatgatttaaaagaaacacatgcatgaatagtacatatgcatgcacacacagacacatgcacacacatgaacagacatgcacacacatgaacacacacatgcacacatacatacacacatgcacacacacatgcacacatgccacactcattgctgggaggtagaggagtagggaaatggggactgcttatgggcttagcgttttgttttggggtgatgaaacatctgggaactagacagaggtgatggttgcacaacatggtcatggcgaaagcgcccctgaactgcacactttagaacggttaactaggtcgagttttgatttgctttgttgttgttgctgttttttttttaatgaagtctcgctctgtcagtcaggctggagtgcagtggcgtgatcttggctcactgcaacctctgccttctggattcaagcaattctcctgcctcagccttctgagtagctgggattacaggtgtgcaccaccacacctggctaatttttttgtatttttagtagagaggggggtttcaccatgttggtcaggctggtctcgaactcctgacctcgtgatctgcccgcctcagcctcccaaagtgctgtgactataggcgtgagccaccatgcccagcaaactaggtctagttttatgccatctgattttcttttgagatggggtcttgctctgttgcccaggctggaagtgccgtgtcttggctcactgtagccttgacctcccaggctcaagggatcctcccttctcagcctcctaggtaggtggaactacgggcatgtacctaccatcgcagctggctaatttttgtagagactgagttttactatgctgcccaggctggtctcaaactcctggactcaagtgatctccctgcctcagcctcccaaagtgctgggactaaaagcatgagtcactatgcctggatgaattttatctcaagaataaaataaacactgaaagaaaggattgtccaatatcatgtgttggagcttcatccagtacttgtgaatcccaaagcagattttttttactcattaaaaactgcttccctttatatacacttatgtgaaattttacgtgcgttttaaaactaagaacaatgtataaaggccacttctagttagtgaagtccttttaaattggagacacttttccaaaatttgaagcaacaaatgggtgtggattgcctgtctgggttttctaaatcatcccccttgttgaaggtaaggttatattttcctccttcaatgcatttattgccaatatcctgtaaactgcagcagagggggctactgtctgcccctgtccggcatcactttcctgatcctattacaaaagaggagtgtcagggcactgaggcagaggcaaagcacagcccaactctcagcgtctcccagatgccaactggatctactttaaaaatattttttaggaagtcggcttccaattatttgagaaggatccatctttttttcatcaaaagcaagaataaagctgaattttcattaaaatgaaggaagcactcaaaggtctcccgggacgtatagatctaatcctctagtgtaaaatacaaagggaagctcttggttttgtttctaatgttttaaaagacgagcgtggctaaagttttaggacgtagactgagtgccacaatgaagacagctcccgtctcggcccttatgacttcaatctggcctggagttactcccctgcattgaagaaagcagacaaggctcgtgatgttatcgtcaacggttgttctgaaagtaagaaaacaggctgggtgcaatggctcactcctgtaatcccagcactttggtgaggtcaggaattcaagaccagcctgacccacatggtgaaaccccatccctactaaaaaaaaaaaaaagaaaaaaaattagctggacatattggcacaatcccagctacttgagaggttgaggcaggagattcacttgaaccctggaggcggaagttgcagtgagctgagatggcgccattgcactccagcctgggcaacagagcaaaactccatctcaaaaaaaaaaaaaaaaaaaaaaaaaagcaagaagaagaaagaaagtaagaaggaagaaagaaagtaagaaaacaacattcaaacaaccaaagaagtagcctaagtagttgacctcgtgtgtactgattgctgatggtcaatttgggtcattctacgagacatacaattaaagggaattgatggatgagcattttcagagtaacattgccttgcagtgggtggattctttccccacacacagaagtgtgcacctgctgttgttgctgctgtggtgaggacgcaggtgctgatgtcatgcggacaactcagccggggcagtggaaagttcccaaaatgagcaccagttccccacacgccatcgtgcccactcacgtgataccactgccatgttttacagaggaaaacggatgctttttgactaaaagactaaaacttttatgaaaaacaactcatatgtggtaaatgtagaaattaaagccatcaatgttttatctttatatggaaagtgagtatagctacatagaaacacacagtaaagtttttataggatcaattaattaaaaaatctaattcagaaaattatttatagacatctttatcattcaatttttaatttttttattttgggttagaaacatagaagcccttcctgataatgttcctttgtaatttaataaattaccatattaaaaccaatatctcttgaatatccataggttaaaaaaagaatagtgaaactctatttaaatctcagactttatacaaaaattaacacaaaatggatcacagactttaaaatatatcaaatgcaaagtgatagacaaaatagaggaacacttcaagatctaggtcttggcagagttcttagacttgacatcaataccatgacccagaaaaagaaaagacgatgaatttaaaacttgtgctgctcaaaggaccctgtgaagaggatgaaagtcaaacgagagactgggaaaaattctgcgaatcatatacctgacaaatgactattacacagaataaagaactcttgaaactcagtcttaaaaagcaaacaaaaaaatccaaacaattccattaggatgtgagcaaaaggcatgaacagacatttcactgaagagtacagatgggaataatcaccagataaggtactcacgtcgttagccatcaggaaattgcaagtgaacaccacagaaagctatcaccacacatctatcaagaaagctaaaataagacagagtgaccgcaccgaatgctggacaggatgtagagaaacttcatcgcccacacatgttgggtagggatgacaaatagtaccgccatgctggaaaaatgcttggcagtttcttataagactaaacttgcaaataccgtatgtgccagtaccatttacactcttgggcatttttcccagaaaaatgaaaacttataaccacacaaaatcgtgttcataacagctcgtagcagcattgtttgtgacagcaaagtctggaatcaacccagacgtccttcaatgggtaaatggtgaaaaaaactgttacatctgtaccatgaaatgctactccacaggaaaaagggactgaattattgacacaggccacaacttggatgaatctccggaaaattatgttgaataaaaaaggcccatctcagaaggctgcacaccacatgatttcattcatttatataacattcttgaagggagaaggtcagagaagtggagaccaggttaatggataccaggaattaagaatgaggttgggatgcgtgggtgtgtttataagcggagtaaggcggattctagtgataatggacattctccatcttgaccacatcaatgtccatatgctggttggtctaataccctctaagtttgcaagattctaccactgggtgagagtgggtaggggacaaaaaggacctctctgtattatacctagtgcctgcctgggaatctacagttatctcaaaatgaaacattttattatgaatgtatttactcattcaacagagaaaaggaggactttaatgggaaaaaagagagagaattgatgacattttatcctaacaaaaaaataacatactgaacatatgacatattttacatattccatataaacacgtaatttagtaatttaccatgttaaaacataatgttaacatatttgagctgaaatattttttaaaatgagagactacacattagatcagcttcttatcaggataatcacccacaagacctccaatgttagattttcactgagataatgctgttattaagtaaagaaatgaagcatattgctaatgcacgcacacacgattgtgaggagctgagggcagggtgaggcatgtttgactctggaagtatcaggcctgtgcagtaaactcagctctgctccgtatggagtcctgcggcctccacaaagagtcaccgctagctctcttgagctccagagcatattttgctaggccctgctccatacttcctaaaacaccactgcacagttgtcagtcataagagttcaactgccaaaaagattgaattatgctagaatgagaacacagcagtgttttgcatctcctcttatttctcgtgattgtgaaactaaagtgaaagagatcatttcaaccctaattctgcacatcagatatttcccatgtaattattaaaggaaaaaacaaacacaaatacaatgaaagaagaagaaaagttgtagttcaggtgaaatcagtaaccatgttcctctctctgtttttatttttggagggagaccatgtttggatacaatgaaagctgtgattgaagcaagctcacccctgtgcacctggggctgaccaatgtccctgggcttcttaagctggggtggttccctcctctggtcaggggctggggctcggcggaggcaggggcactggcttcaccccctcactctggtttcctttgcattctgcactgtggttagttgagtgaactgggtttcatcagtgtgttggtcaaaacccaagcattctgatcctgacagtgactagtattttagggggaaacagaggtaggagtctttacttagcctttgagcttacgccaagacctccaatttagacctgagccagaactctgcagctgagtagccaacttctatacaacttctaatcattttttaaatgacttgggttcccactctgctatcagcttatttgaagatagctcccgtgggagccctaggataagagaggttcttgtcagagaaagagacattgataagttcctggcttcaatttcatcttaataccataaaaaatacttgcccttcacactaaagtacaatacaccaccaataagagtgatgttgtaatggaaagtaattgaaatgaaatcttaaacatcatgagctcaaacatctagaaatgcaaaaaagaacacaattttcttggaaactcagatttagcagaggtctctgtgactacgtttaaagaaatgaatcaaaaaataaataattgaaaatttaaaacagtaagaacttcgtaaagacagtcataaaattagaagcataatggcccccaaatgctaactatacagggtagaaataaatgtgtaaatacatgaataaaaagagaaatagaagatgagttatctttaagggagataattctagattttcgtaattgaacatctggccacgagacaggaaaaagccatggagagctttgtgcttactctcagaaatgctttcacacctgaatggtgagagtttgcagaactctttatgcattacccttgattcatggagacaggctcttgatggtgttactgggcagcctagaacactctcagagcaaagggctcattcctggatgctgttcctacctcgacacgtgggcagagggctactccactggccgttgctccgacactgggctcgagacacgccctgcagcaaatagcccgtgttgcaggtgaaattcacgacatcattcaggttgaactcactgccattagtgaatccgtgggcagggtttccagggtgaccacatgtgatggctgtagagagacaggtcaacgtcattgttaaatattgaacaggtcatcactttcccttgggattattaataagaaacatgcaggcatgctaacggtatggactgaaggttttccactaaccaggcagcttacagatggtatttatattcagaagggaatattgggagctacaaccacaggctgacactacaggcttttaatataattgtggaaaataacaaacacctgccaaacacgctttctttaccatcataattattatttctctcttgaatcatgacagaataccaaatgatttaaaaacgaagcagtgaaaaacaagagatgctaaaaattcttgtattaatcatgagttttgaacattttctccatacacaccagctgactctgtgaaaccctccttttgagacagtatgggatttgtctgatactttttaatgtccatgtataaattattgcaatatcaatttacacatcatgaaattagcaaaataactaagcacactcagctcctatttttgttgagaatctctgtcatatgatcctttgaaatgcagtgaactgtcaatatgtcatgccccagataacagcaagacagatcagggagagatatccatcattcaccctttcaacagaaacacactacagtcataaaactggtgttttcttcctcatttatcttgtcaacaatttttttcctataagtaaagcttttacccgtgaactttgtacatttttcacatcactattacagataatctttgtcactgttttatccacatttcttttgtctacttcataggaaaatatacaatatttctaaaaacaattggtttaagggaaattgggcaataaagtgagagtacattgttcgaaaaatagtcaatatttacaatatttatcgctgaagttatacagctcaaggttgatcattcattacatgtaattttacctctttcttttttttcccttttttttttttttttttgagatagagtcttggtctgtcacccaggctggggtgcagcggcacgatctctgctcactgcaacctccatctccagggttcaagcaattctcctgcttcagcccctcctagtagctgggattacagatgtatgccaccatgccaggctaattattgtatttttagtagaaatggggttttgccatcggccaggctcgtcttgaactcctgacctcaggtgatccacctgcctcagcctcccaaagtgctgggattacaggcgtgagccaccacgcctggccaattttacctctttcaagtaaaagaaagaatgcttacaaaactccctatattcttgacgaagcaatgacaaaaatgtatgcaacacggatgaggcagggagtgccgctgtttctaggactgcaaagctgcccagcagacccagactctgcacctccaccctcctactatcagcttttctctccacccagtttatcctgtgataaaatcaaggaggaggaatccatgacaccacttggccagggatccatttacaatgaattgataagcaaattaaatgtggagtcaggaaaaggagtttgaaggaaacaaaacgggaaggagatcaaaaaaggaaagcgtgaacatggcacctctcctgttctctttctttgtataggcaaaactgaaagtttgctgttcccttttacagtgaagattaaacaggtgtatattgtgacctaataacaaaagacaatgtggcaaaaggaagcatcgatgaattcgtccacaaagagtgcacttacggacacagacaggcgtttgtccagaccacttgtggtcttgcaggcatatcctcacggaagttcccacaagccggaaaccaggattgcactggtaaaccaccgtgtctctgtaactgaagccatctccactaatgtgaccgttcacaatcgggtctggggaaccgcagtggccagctaaaaatgttaaaccaattttaaaatttagagtgtctgtcatttataaaagtagtacattcacaacttttattatcaagtcaataacagtattgaaggcgcaacatattgaaatctttatcattacatatatatgtatacttttaaatatagtttttcttttttttattattttttttcagaaatcctggaaaaaataagtaatatttctaatatgaaatggtttgtattttcctagttgtgattttcccatctatccatttcacttattttgcttacctgtattcagttatttaccttgttatactattttcaaaacaaagcaaaaagtaaagaaggaattcttggaattaacatgaacagggcttcttaacctattgattatgggtagtaaggagatcggtgaggggggcttccagtcagatagactagataatcaaattacctgtgaaattccaaatggaaagacagggatcagagaataagttcaatttcaattatgaaaatctgagttatgggtgagctgatgtctgagtaaaaatggcctggaatcagttgaaaagagaagtctagagttccagggacagatgtgctgaagttagcgtggacttgggacaacaggagcatgcacagctgacagctgaaactaaaggtggcagggcttactcaggtgcacagtgaaagaacaggaaggagcgcgagatcgcgacaggcgtctttacttaaggggagacagaatgtccatgtagatagtaaaacaattgacaaacatggcattgaaagagctttagtaacagagcttccacatggagacagaccctctgacattattccactcactcccaccattttttttctttttttttttggcagggtcttgctctgtcactcaagctggaatgcagtggcaccatcacggctcaccgtagcctcaatcccttgggctcaagtcatcttttggcctcagcctcctgaggagatgggactacgccaccatggtacatgctgccatgcctgagtaatttttttattattattatttttagtagagatggggtctcattatgttgttcaggctggtcttcaactcctgagcttaagcaatcctcctgccttggcctcccaaagtgctgggatgacaggtgtgagccaccacaacattttgttaccttctcttccatctccctcttctgcctctttactgctctcacttttccttctttcctttcctccaacttctccttttctctctctcccttcctcgcatatatggaaagggtattcttattaaattaacaaaatatacaggctgaagagtaacttacatgaattggacctgtgttacacatgggttttggagtcacaagaagaggaaaaacattcaccatgagttcctaaataatcatctttgtcactctcctatagttgcatcaacatttctttttgcttaattcacaggaaaataaagaatatattagaaaaacaattgctttaagaggaattttgcaataaagtgagagtacccgtattctaaaaataataatcaatatttatctttgaagttatagaaagaaacttttcgtaggaaaacagctacagaagccttcagtccatgcaaaatatcaaggcggagactttccctgcccacttatttccccaacagggaacacaaccaatgattctccatacaagttcctgcacacccagatttgagaaattacaaaattgttgtcatactcctttgggattaagtatatccttctagggagatttaaaatcataatctatatttctgcttaaaacaaagtttagaaacattgtgttctcctattttggagaacaaacttattatcaggaaggtaacattgcagaggagagagacagaagagaatctgatctctgcctcaactcgtagaagagattagaccacaaaaagccaggctagatttggctaatttttgtgcattggcaggtattccagtcaatcggatcaataagtcagttctggtgatttgtcccaatcactcccacatatgagacttgatacaagcggagaacgtcgatgagggtgaatgttctccatattgtgaagagagaccccctgaaggcacaagtgttatcacaggcacagaggacattgtctctgaaggttcccctttccagacgctgtcctttgcacaacgtgctctgtcgtgcatgggggagatggagccatcgttccaaccctagagacagggagacgaggactggtgagagccagaagagcccatcagcccagcacaagagatcccagccatttctgaggcgaggcatagaatagctagtttctagaaacacacaagaaaatgacaccagcaattccttttggaattacttctgaagcctggaaccactccaagaggaggggatgtgggaccaaaggcaatagtgatgtgaaaaggggtgcattttaacagagctcctctcattttagggaatctgttcaggtctcattcttgacttagacaaacaggactccttttaaaccttaatatttttctgaactgagttttttgtaagtgcacatagtttgaagttgcactcttctttgggaacctggcaaacaaggacttgtaatggtcaaggaagcatctgtgtactctagaaatcaggcagcaagcctgacagccatgactgtaaataaagattcccaacagcaactcctctctgacacatggtcatttcggttctctgaggaattggcaccaaatgcctaaagaaaacagaggatgtccttcaaaaacatttcattttacctccttgcctgaagaaaaaaaagttatgtatcagcaggattgcctagtatctaagcttcctaatacagaacaattatttcttcattgtggcttcctattttgaaacaatgagatagcaatctgtttttcacctgttatcactttccagccatccgttaattctgttttaaaacattcaaaatctttgaccaattatagtctattacaaatagaggataaccacacaatttcactcacagaatactctttaacccaaatcttaatgatattgtgtcaatatgttgaggaagggaaaattgcattaggaggaatttgaactcaatgaattttgagctctattttaaatttaagattctattagtctatgatagtattattctatatgctttgtatgtgagttaccttttcttttaatatctctgatgtagtcttggttttgagtcatctacacaaaacctagaaagcctctctgtcttccctcaggatgaaatgtaatcaagttcatgcttctctgctgtgtctctaccatatcagtcacacactgagtacttgttgaaatgaacagaaacagaataacctcaccactgggcagtcatgtcctttacattgtctcctatgtcaccttcatgtatttgacaataattcatttatttgacaataatttcatgatgatttgttgtgggttgcaatgttcttggggctggggattaaacaaggaataagacacaatcgcagagggtaaacgcagaggagcagctgtcacgtgcagagtcctgagggtgtgcggacctagcaggctgggaacgagtggaaggaacactcagccatgctgaggaccaggactcctggtgaaagaggtggcatttaaagtctgaaggatgagcgcttgttagccaggaaaaggtgatggcaagacattctagccacagaaattagaaatgttatatatttttaaagcatctgttaaaatatgaagactatgatgtcaaatgacccagttatacatttgctaggagggtgaccatttgcatcctgtccagcttagtacatagtaggtgtcagccccactgcgtgactctgccactatttgaagatagttgctacaactccactgagtatgcacagtagcaaaggaggataagcaactctattcactgaattttttttttaaagaaatgaacgtggggtgagggcagccctgcacacttcaaaaccaaatatcatctagtgataataaaatactgaaattcctcagtggaccttacactatgatgccagagcccagaggctgtgatttgtcttgattttgcagactttgtttatttattattcattgacgtttagcttcagtttaaacaaaaactgcccaatgtctccaacaggcaattgtgtagcaacaacagtcacagctcggacatcatgaagcctggatttcttgagaagtgtgtgtcagaaattgtcctattaaagtgtggaaggaaaaccttggcaagaaagcaagtgacccactttactcttaaatcaatcttctgcgtgaatttattagtctactagtaatctgaacccagcaggactgagaagcaaatggttgaagaattaggaaagaatgctatgcaactgtaaattcatatgatttttaatccaatgtatatagatagacaatgtaaatatatcctcatggaattgcagaatttgcttttagctcaagcacgaattaacaattcaattactaccacacttcatgaattttacattttaattcttcattttctccatgctgagaacaggtatgactgtggacagggtaattcaccaaccacttaaaatggttgagagaaccagtaacggaaccaagaatgaaatggtctgctccagtgactccgttttacacactgttctacaaaatatgtcattggaataagaataccgtggccaggcgcagtggctcatgcctgtactcccagcactttgggatgctgaggtaggtggatcacctgaggtcaggagttcgagaccagcctggccaacatggtgaaagcccatctctactaaaaatacaaaaattagctgagcaaggtggcacatgcctgtagtcccagctgctcgggaggctgaggcagaggaattgcttgaacccgggaggcagaggttgcagtgagccgagattgcaccactgcactccagcctggacgacagagcaagactctgtctcaaaagataataaaaacaataacaataatacggtgaaacttcagaaccattgaggtgttatacgtatggactgtgcagtaccctgggtgggacccaggaatttgaacgtctttcctgagttacaaagagtttccgtaccataagctttgaaaatcactagcttttcagtctactctattctgtgtctgatgaaagctttgttactccaaggaggaactggtaccattccttctgaaactattccaattaatagaaaaagacggaatcctccctaactcattttatgaggccagcatcatcctgataccaaagctgggcagaaacacaaccaaaaaagagaattttagaccaatatccttgatgaacattgatgcaaaaatcctcaataaaatactggcaaaatgaatccagcaacacatcaaaaagcttatccaccatgatcaagtgggcttcatccctgggatgcaaggctggttcaattacacaaatcaataaatgtaatccagcatataaacagagccaaagacaaaaaccacatgattatctcgatagatgcagaaaaggcctttgacaaaattcaacaacgcttcatgctaaaaactctcaataaattaggtattgatgggatgtatctcaaaataataagagctatctatgacaaacccacagccaatatcatactgaatgggcaaaaactggaagcattccctttgaaaacgggcacaagacagggatgccctctctcaccactcctattcaacatagtgtcggaagttctggccagggcaattaggcaggagaaggaaataaagggtattcaattaggaaaagaggaagtcaaattgcccctgttggcagacgacatgattgtatacctagaaaaccccattgtctcagcccaaaatctccttaagctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaatttacaagggatgtgaaggacctcttcaaggagaactacaaaccactgctcaaggaaataaaagaggatacaaacaaacggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgaatcaccaagtcaatcctaagccaaaagaacaaagctggaggtatcacactacctgacttcaaactatactacaaggctacagtaaccaaaacagcatggtactggtaccaaagcagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacagcttacacaaaaatcaattcaagatggattaaagacttaaacgttagacctaaaaccataaaaaccctagaagaaaacctaggcattaccattcaggacataggcatgggcaaagacttcatgtctaaaacaccaaaagcaatggcaacaaaagacaaaattgacaaatgggatctaattaaactaaagagcttctgcacagcaaaagaaactaccatcagagtgaacgggcaacctacagaatgggagaaaatttttgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacactacactgttggtgggactgtaaactagttcaaccattgtggaagtcagtgtggcgattcctcagggatctagaagtagaaataccatttgacccagccatcccattactgggtatatacccaaaggactataaatcatgctgctataaagacacatgcacacgtatgtttattgcggcattattcacaatagcaaagacttggaagcaacccaaatgtccaacgatgatagactggattaagaaaatgtggcacatatacaccatggaatactatgcagccataaaaaatgatgagttcgtgtccttcgtagggacatggatgaaattggaaatcatcattctcagtaaactatcgcaagaacaaaaaaccaaacaccgcatattctcactcataggtgggaactgaacagtgagatcacatggacacaggaaggggaacatcacactctggggaccgctgtggggtggggggaggggggagggatagcatcgggagatatacctaatgctagatgacgagttagtgggtgcagtgcaccagcatggcacatgtatacatatgtaaccaacctgcacaatgtgcacatgtaccctaaaacttaaagtataataataaaagaaaaaaaacttaaaaaaagaaagctttgttactgtttgtaattataaactgctattatattttgcttaaaatgtctcaaatagaaaaaggggagttattttaacaatctttctctaaaattggatttgaaataaataaaagctaccaaacatttgaacaaagcacagagactggtagcaagatggatggagtattgagtccattttcatagcaaagaaatagagtatgtcgcaagcaaaatgtcaggaagaaggctcgagagggaggaaaggcctaatttcttgattggtcaaggtttccctgcaaactacatttgtgccagagcagtcaggagggcagaaagtggctgaattccctttgtgaggtcagttgagtctgaggttcattagggacacacacagggaaaaccactcactccattatcacccgcacagtgtggcccacccttagaccaggggaggctgcacacctgcagtttatagaattcaacacgggagagcaggggcctccgcaaggccagcctctcaaagcctttgtttctagagttccatgtaaattccactgcacaggtcttttagtgtaagttataaaacaccttgctgagagaacaaaaggttgttttgtttgttcgtttccagtagagtgaacactcagaaactggctcctgaacgaatccggttccttcagaactccagcatgcccccctgggtgacctatgttttctggaaagcggttctacaaagctgtgttttagaggaggaatcttactggcagacaggatttggctttgtttagctatccgtactgtttctgcaacacttgcttttgctactgaaaggagttatgcggtttgcaacctaaaaccaccacactgattgtcagtggtgactttctgagtgactgacgcaaggtggaccctcaaagagacctgaggtacttgttggccgatttaccttcacatcataacgcacgcagagtgaacacctcacatgcaagtacagcaaggtgagagtctccgacaagtacctagacctgtgtgattttggaaatgggttccctgatttggaaatgtaataaagttccactgtttcacttctcccgcagaaaccccatataccagtgggaatgttgccacaatgtctcccatgacagcggacagacctggagccgtgcattctttggggaggaatcggctccttccattggagctgtaggatctctcccctctcaccaggtctcccacacacgcacttttgcccctagaggggcctacttgaagctcacgtcttcagtgtgcaggtttgtagcaggacaaatactaaatattggtccggggattagaacggaatccatttttagaaaatctataaaccaaatattcaacctcagtatttgctttgtgattactggtacttattgctgaaaataaaatacattacaaatatcctgggcctgtaggggaatacaatatgctttattctatccattctatgcaataacatggtctttggctaagtcagagttatttgggcagtagattccaaagccaatttgcaaacttttcttcagtattaacaaatggtcataaaatgtcaggtgcatcagattcacttataggcaggaaaaactattattagcagtacacttcaacggacatattgaagtctcttgatctccatatgctaaagaaacacatttgaatattgataactgaggtgtgttttttttgcctccaagtgcaatctctaggggcaatgctgaccgacttagcccatgcatagatatgcatatggtatcacagagagtgtgtggaatttgtccaacatggaggtattgggcttgcagagcatacaacactctgtgctgtttgtgacagcatcaaacacgggcccgagtcctctgccacaaatccatttgatcagatctctgcttcacacatcttagtgaatgacagcttttttaaaccagtttggtttgaagaaaacctcaaaccagggccatcatttggactgtctttggggctttcagcattctttttatctattcctgtctcaatgtagttcctgaatataccccatttccaccttcttccctgggcctatcctgcctcattgtcctcaagctttgtctgcagtcttgcctgccggtgtcacgtctttctgtccctcaaacttcagtccaaatccaccgcaggtgcgcatcttccacaaaccccaaaggaagagctgcccattcatacaggaggcaaagatctccctgacttcaggtttctcctacaataggagagcctatcttcggtgttgcctgtttaaaacacccagactcctactcttctactgtgttttgttttagatgtagcaggtggcattctaatttttcgtacctatgcacttcccctattggactgtgagttctgagtgcagcaccatgccttgtgcatgtgcatcaggactcagctcaaaacctgccctagagcgggtgtcagagttatcagatcttttccaccatctcgtggccctatcagtccaggctcttatgaccaggcggccgtcgagagttcgaccccagcacctgcttgtttcaggcaagtccgacttccttgggccgcactccgcatctatgctgttgccaccagggttgcagctcttgatttctggaatggctttaccccatgcctgcttgctggaattccacccagaatcagcacggcttcccccacatctactcttctgtcagcctctaggttgctcccactctcacctggatttctcaagtaatgtgcctatatttcccttttgccattattctattcccaactttttttttttttttgagatgaaattttgctctgtcactcaggctggagtgtaatggcatgatctcggctcactgcaacctccacctcccgggttcacgcgattctcctgcctcagcttcccaagtagctgggattactggtgcccaccattatgtccagtagtagagatgaggtttcactatgttggccaggctggtctggaactcctgacctcgtgatctgcccacctcggcctcccaaagtgctgggattacaggcgtgagccaccgcgccctgcctattctcaactttttattaaagctacttggtatttaccttatttactccttagagtatagatttcataaaagaagaaccaatcttattaacctctgaatgctgcaccatagttcttgaggaacaagaaaaatatcattaaatactattcagaaatatgacagaaaaacccaccgctgagaagtttgctagttattccccagccactgacaatgcatttggaaaatctgagaactggtatagggagttttcctgactaacatacagaacatattttacacttaagacggtatggcaaagatgggggtggggcaggggaggcagtgctaatctttctgctctgctgtgatataagcattatcataatcagttgttttattaaatattttatgtggatctttccaaaatacaaggcaattgaagaatatatttaaacttgactatctaagaactatgaataactacagtctaaaaacagtattttgaatcatgtcatctagctattttagccacataaataaccattatattgcatttacagaacaattcatctcctcatggttataatagcgcaataaatgcaaacttatttctaacaatagcaaaacaatctaataaaaaatgataatgtcctctatgtgggaaataactcaagctaccactaatatcttgaatactagagattgaagaggtaacatagtggagagaggatgggttcttatgtgctgaaaagtctaaatgatgtaaatgttttcaaaatatgaatgtgggattctgtgacaggaaacctagaccacaaactataacctcttcctagtttgtgtgttctctgttggtttaagcaaactaccgcagagaagataaacaggagaaaataattaagggatcatgtagatcacaaacttcctgggtggattagcaagtgcctgagagagtggataccaggtcagcattctcagtgcttaattctgtggcctggggagaggtgtagcattacacagtacagttggtaaattagagcaggtccttggcaatttacagaactctgaactctgggagatcccagtaataacgcaggagtgatcgtgttgatgaaggtgggctaaattttatactaatgtactcggatgcacctgtgcattactttgctcaaaatctatttacaatgatatttacatgcacactccaatttctcacaaggttcttcttagaatccagaccagggacctaaaacacagcatggattgagttcttgaatattaggtgtagaaaatcatcttttctttccttaaatacagctgtcctatagttgacattctcaagactcagtctgtcaacgctcatccattcctgtgtttggccactccagctgcaatactcaaaaaggattccagcatattctcccatgttggaagtcactggaaacaactagcatgccagcagtatgagtcatgttgcgatgaaactgaagcacaatctcaggaaacagtattctttctagtagccccaaaaataaactacaaaatatctcagccacaattcagggaaaaaaaatgcttttgtcaaaaaatcttgcaccaggatggaaaacatattggacctaaggtatacagcccaagggaagttaatctaaagaaccaaagtggaccctgcttttgcataaagtcttagttgtcttgtttggaagatccacctgtttaaaaatacacaaatgaaaggggatgtggggattttttatactgattccaaaagctctctttctctgtacacagtgcctgcttcatatgattggctgtgtccccacccaaatctcaccttaaattgtaataatccccacctgtcaaggatggagacaggaagagataattgaatcatgggggcgggagtttctgttctcatggtagtaaataagtctcacaagatccaatggtctcataaaggggagttcccctgcacacgctctcttgcctgtcaccatgtaagatgtgcctttgcttctcctttaccttccaccatgattgtgaagcctccccagccaggtggaactgtgagtgcattaaactcctttcctttataaattacccaggctcaggtatgtctttcttagcagcgtgagaacagaaaaatacactgctattacaaacccatgaatggaagtatgcacatatgatgtctgcatcaaccctgggccttgtcttggcagatatatgcaattaattttatgtttgtttcttttttcccacccacatgttcctgattaagatgtacagatgtcagcatggtcttcatgctgactctacccgtcagggctggcactgatatggaaaacaacttcccacaactagtttcttccatctttcacctgatagcattttaaatatttgaaaatagttatgaatgactactttacttttctctctgtcagagtaatatcaaaaattttccagcctggtgtggtgcctcacgcctgtaatcccagcactttgggaggccaaggcgggcagatcacccaaggtcaggagttccagaccagcctggccaacatggtaaaaccccgtctccactaaaaatgcaaaaaattagccaggtgtggtggtgggtgcctgtaatcccagctactcaggagggtgaggcaggacaattgcttgaacccaggaggtggaggttgcagtgagctgagatcacaccactgcactcagcctgggcaactgagactccatctcagaaaaaaaaaaaaaaaattccaaacagtcctcaaagatcataggtaccagatccatcaccacaaatgcatagcaattcctcaagagcccacttaaactattaaaaaactgaagtcatgattctggatatgggattcctgggcgaacagaggatgggaagaaccttattaataagactcagcctgagcattgcatggcagcacttgtcacatatgagcctgctcttacccaaaactcccaagttctctgcctctacactatgaactcagaatttcttctcctcatatacattgcaattattttatttctactctgagaaaaattttacattaatttctattatattattttgtttgtcctatcgtgagaatttgagatcctgaatccatcatccaatattattttcactctttcaactatgccctgatcgaagataggaataaaatttttgattcagaaacatttctgaatagtacttatgaatatccatctcataacaatattaaacaaaaaaaaatggatgcaaactcacatggtgtcttggaaactatattagttctatgtgaaaatacatttccaaagttacttatgaagaatatgcttgggtatctgctctatatatcatcaagtcaatttatggtttttgatagctagcttcttttcctgcttttcctgttgtgagaacaatcacactggatatgagtttcactctaggattcttcctttccataatatctcaccaagaacactgccagtaactcagcagtgtgatttttagtcccctcagctgattcggatgaaattctcctgggcaggagacacaacttcattgagaactctgaagttctcttttataagctccttatctttggggcgtgccagtttctgattttaaaaacgtcccgcctataatcccagcactttgggaacctaaggcaggaggattgcttgagcccaggagttcgtgaccagcctgggcaatttaggaagaccctgtacctacaaaacaaattgtaaatagttagctgggcatgctgctgtgcactgtggtccaagctacttaggaggctgaggtgggaggagcacttgagtccaggaggtcgaggtagcagtgagctgttgttgcaccactgcactccagcctgggtaacacagtgagaccctgtctcaaacataattaaataaataaataaaaacctcctaacctgtgtattccataataaagcttcttcatgatgtgcttattacacaccgtatgtgtgtaacgaaaatctcatgtgccccacaaatataaacacctaatatgtatccataaaaattaaaattaaaaaagtttttaaaagcttcttaatgaaaaaaaaaaacagaactgaataagcatccattttcataccagtttcaagaatgaatttggttcttgtttcaagcataactgaggcagctctcttggggttcctcacccttcacatcatttccagtttgtggtggatttgtccctccggacactctctttaaaaacgcattgcattctcttcaacatgtcctgggacagttgctttgcttgaaaattgaatttcttgcagaaaatctggtatagctgtctctgtttgtttgggtaatttcccattttttcctgattggatgatttgctttttaaagtcatagttttgggggttgttttgttttgtcaaggggtcatcatttttagagttgaagccatgattatatagacacagttttcagaatatatatatatattttgattcagaatcacttctgaatagtacttatgaatacccatctcataacaatagtaaacaaaaaaaaggacccaaactcacatggcgtcttgtgaaattatatatatatatatctccttaccaactgcatctttagtaacagtcatttccccactacaagtatctcgtttaccccggcatggtccagatgagcctgaaggttactcaaggacatttaacttggtggaaacccaaagtgattttcaaaagagccgtaaccatggaaacagggaaagggttaattcaaataacaagttaagagatggaagaaaagcaatagcaagactgataggcgagagcgtgtcagcatcctggcagtacaggatgaaggacacaattagccaggcagaactaaggcacaaagacccttgcacctgccccttgcatgcgcctccagaggggactaatccaggttccagagctcatttcacttctagttaacacaacacactcctccttattggtctgaattagcatgatagtattcttggttttatgatgttgggcaaattctgtacttctctatgctttctttcttatctgcaggtcgaaggaataagcacttcctgtacgttctaatcagataaatctcacaaatgccatgtgcattttaaatcatcaaaaaatatcatcatttataacctgcctccaaatatggcacctagttgatatttggattatggaggtatccatttgctactctactaaatatttgtgtagatttaggattgcagcctctgttcccttcatctatcttagagtcatacaatctactcaagcaatatcatctctgttctcctacctttttactcactcatccctattttcctctgagtctcacatgcaactttatggtttcttgtggacatatgttcttgctgagtttcacatgctgtcgccccccagcaaaagatgtctttgataaaggaatatgcttcattaccatgcttcacacgttatgaatctcaaccctttccgttacagtggtagctgcaaaaactatatttattaactttcaaaatgtttgtgctaaatgaattactcatggtttacccattagtatgtacatatgtatgtgtcatttctaatctttttctattttttccctttaaatactctatgtctcttccaattttattattccttatatgctgtatccaatatctacaacacaaatgttttatatattataacctgggcatttttcttcttccttattttcctctgagcaaatggactcatttctgagtgaatcatctttcaaaagctgctaagatgtattgcatagcactgagacatgtttgggggcatctccaggcagccaactattcaacatttatctcatcctttctactccaaaaccctaactttcagacacaagaataacacaagatagataaaggcttatcagggatcaataatccccaagctgacccatcatttaacagttatgtaaactgaatgtatcacttaatctcccaaagcaccaacgaaggcctttcctgcatcctgtattggtaatgaccaaaaggatgagattacggatgtttgtaagcagtagagcagcaatcaactgtaagttgctgttaattttcatgtttacaattactaatagagatgtggtacatactgtcagacgtgagtgtctcggaccacctagctccctcccagtggaactgggctccttcagaggaccaagctccaggcagaagagcttgtccatatcaaagctgcctaaaggagagtgctgttccatagccaatttcagaaggatatttaggaatgcatggaaactcctagaaggacttgtgactctctacatgaagaagcatacatagtccaaggaaatgtcatcgtctactgaaaactgtaatgaggacacccaacgacagacacatatgcacacactcatatatataattgtgttcaataatatataatgcactaaatatattacataatacactagacagagtgagaaagagtgtgagaaaccaagcagcattcctgtaagtcctgcagtgatttaaaataagtagataatgtttcacagacaagtgtgagaacctccttttggtggttggtttttctctagggttactactgtcctttcatcttgtttcttcaaattctcccaaatgaaaagaagaacaggttttgctatttgaagtttactgggcctggcttagttcctgaagtgatctttgcccatgcagattcagaagcttaaagctcccagtttctatggctttgagtgatttaaaaaaaaaaaaaaaaaaaaaaaaaaaaaggaagaacgcgtggagaaggttcagaagaaccaaaggcaagtaaggtattttacaaatcaccagcagacctactaagatcactctttactaatacttgttctttaaactgcttattcaagatttttcatacacttattcaaagaattttccaatggaaacatttttcaatccattttttaaattatgcagaatattttaagtttttgaaaaaagaagactacattattgtagacatatagcattttaaataattcactgtacttatgtcaatttggatgaatataacttcaattcattgacataattttaaaatttttaaaaacataaaatgtacaatatttttgaaattcatttttgtgtgtcctaaaaccatgatggcatttgagtgcaggtacattctcagcactcttgcaagattgcctttatggcacttaaggcaatatatgactttcattcattgctcggattaaaaacaaatccctgtagatactcaaagaaaaaatcacactgggaggtgcagcatttccaccccaggtaggatttaaggcattatagcaagaagtcatatgtgttacacagctgtaatctatttctaaggtttatctgcattaagtaagtgccagaacacagatgaatttacccagacatcgagtttcgctgccgctccagagcccatttgccaagcactctctgacatgagaccccacaagcgtgtagccggtgttgcacgtaaatatagctgtggccccataaactgtcaacgttccaatcttgttgccatttgggggaaaggaaaggcttccacacgagataactagaaggaaaaacaataaaatgaacatcaattcagttatgcagattactcctgtgctccaaacaaacaaacaaaaacaaacaaaaaaaaccaaaaaactatttttagtcttaattttcactaagaacatggttgagagtgtctgcttagggctggatagaccagtcacttaagaagcttaattttccatctttatgctcctgaaacaaaaacctaaaagcttaacgtggattccaaaacattctagattcctccaattacccattaacttttgttgttgttgttggcatggagtcttactctgttgaccaggttggagtgcagtggcgctatcctggctcactgctacctctacctccccggttcaagtgattctcctccctcagcctcccgagtagctgcgattaaaggcgcctgccaccatgtcccgctaatttttgtatttttagtagagacagtgttttgccatgttggccagactgatctcaaactcctgacctcaagtgatcctcccaccccagcctcccaaattgctgggattacaggcgtgagccactgtgcctcgacccattaatgttatttttattaccatcctgacaggtatagctgaaccattcttgaaaaaatacacagtatacaaagtataaatgcagaagcgtgtcaatcaaataaattgtctatctctctacctttctttccatatcaatcccaagaattacatagtagtaattaccagaagcctcaggagcctatcaggaaataaggaataccaattttcttcaccaaagcccatcagctgggacaaagtagtgtggtattaaaatctaggacttcggaatgcaatagcagtgctcagtttatttgtttttttagttacttgcataatttgttgggctcatgagctctgtaagaatgctgactacacagggcatttggaggctttccacaaactaaaacgtgcatacaaactagaccttaactgggtgtcgatggggtgaccctatgccccatgtttacacctgccgtcttagcacagttattgatcgtgtccattttcactcatgaaagtactccagtttggcaaacaagttaatggtcaccctcattatatattcttactacaccactgaaatctctgctcttcagattcagaaacacttgagcacagaagatcatggcctctcaggggagggaggaactcacaaggttatccagcccaacctatcatcagaggctgaaatatgttttgaacaggtaagaatgaaagtgttagaaaagctattcaaagcaagcattaagagtgctaggtgagcactgatgtgcagggtgcttcgctgcagcctgcagtggcaaacatcgagttcttccttattcacagtaaaccacaagaggcagtaaagcacagtgaggaagaacacggattctggctgtaggctacccagggtctggttctgccagacaggagccaggcagcacttgccaattttctaagtctctgggccctgttatgggttgataatagctcctactgcataggcttgtgcattagattcaaacggaagccatccctcgcacataagcaggcttaatcagggttaactaacaatgaaagtataaatcaggacctatttagtcaattgaaccaaaagtagaaaaacctttagagataattcaagtgaggaaaataaagtgatgcatgtaccactaaaaccagcccttttgttgttgtttatgtagacagagtcttgctctgtcactcaggctagggtgcagtggtacaattgtagctcccagcagcagccctgacctcctgggttcaagacatccttctgctcagcctcccaagtaccttagtgcatgggcaccaccacgctcagctatttatttttttaatttattttttgtagagatgggggtctcattgtgttgtccaggcttgtctggaactcctgggctcaggcgaatcctcccatcttggccttcccagaagccccagaccttttaattaagctgtctttactccatgttatgataggacaaccgaggctctatctcaaatgttcagacagagacacccagactgagttttctgtggggtgcactaccagaaattgggaggtccaactcgagagtccatcacgaccagcacactattgttattgagacagcctccacgatttattggttttggggattgctaaactattacagtgtcatatcgtttgcatttagtaatatgctaatatgtttgctctaccaaatgttaatgaactcgagtaggatttagatttttacaatttgttataaacttttcattaagccttttcccaaacagggtgaacttgtccttcaactatgatatttaaagatccatttgtagcaatttaagataattggatcttgtcttgaaacttccatgcttgccagaaaataacaatgaggtctgagtcgaattcttcttggaggtttcagcgcaccttcgccttcaatggtagagaagcaagaccacctccctctgctcgtatggctgtttctattgttgaagcctctgttaaaaatattctggtgacaaaactattttaagtttgtcctctaacaagatttactcaattgtaaagaagaagtaatggagcaaaattttagcttttcagtagctgaataatagaatttcagacccagagtttccttgtatggtagtaaactcaatgcattaataaagatagcagcaataactcggaaatcttgcctgactgaaaaggggaagcccctcactactaaaaataggctttgtcatacaccgaagggaaagccttatttttatgttctttttcctctgaagtttctaaaaatgaattgcttacgtttgcctttttttcatttcattaaaagtgtgtccacgctcacagtccgcagtgcttcctctgaactctgggagcaagtctttgcacaaaaaagacacttggctgacagcatccggaaatcacctgcaatcccaaagcctccggaatgcacctgcaatcccacagcgtccggaatgcacctgcaatcccacagcatctggaatgcacctgcaatcccgcagcatctggaatgcacctgcaatcccacagcatccggaatgcacctgcaatcccacatccatagcatctggaatgcacccgcaatcccacagcatccggaatgcacctgcaatcccacagcatccggaatgcacccgcaatcccacagcgtccggaatgcacctgcaatcccacagcatccagaatgcacaatcccacagcatccggaaagcacctgcgatcccacagcatctggaatgcacctgcaatcccacagcatcaggaatgcacctgcaatcccacagcatccagaatgcacctgcaatcccacatccacagcatccggaatgcacccgcaatcccacagcatccggaatacacccgcaatcccacagcatccggaatacacccgcaatcccacagcatccagaatgcacctgcaatccaacagcatccggaatgcaccggcaatcccacagcatccggaatgcacccgcagccccacagcatccggaatacacccgcaatcccacagcatctggaatgcacccgcaatcccacatccagagcatccggaatgcacccgcaatcccacagcatccggaatgcacccgcaatcccacagcatccggaatgcacccgcaatcccacagcatccggaatgcacccgcaatcccacagcgtccggaatgcacgtgcaatcccacatcgacagcgtgttttctcactgtccctggggattccaagccactagcctctgttcccacaggaaagtctcttttttgtctctccttcaattctatgattatattcacgttgaaatatatcaactttaaaaaacacttgtattgtgacatatcagttctcatacctgtaaggacagcactcctatcagaaatatgaatattacttgtgagtgtgacaaataaacataaactcaagagtaggtcttttcaaatacattctagctaaaaaaaaaaaaaaaagctaaatgaacatgcagacctccatgaagaataaacagctggcaagagaatgtgtgagcagggaggggctctttaatatgaataaaaggctcagtggactcacaatggctgtttgcaaatacacgaaggcactccgtatagatcagagtcaggaattgttttattaggcctagagagatagagctaccatcaatcactggatataagtcacataggaagcctggcacaaagtaaaaatgttcaaacatgaaatcagctgtctctggggcaatgagctgtcactacagttatttgatgttagctgggcattgacttgtgagaatattatcaagaaaattcaactgcaggtagtcctgagtgatgtccaatgtccactccagcaatggaacgaaatgacaatgactacgctgtggtttcctcggatatagacgaaatacatctgctgataaacacaggctcccatacgtttaatgatcaatccaggcctgcctccagtaacaaacagcagatcttcaaagaccagcccggacacagacagcccagaatttaggccatgttctttgaatatctacaatattacaaaattccagtgtagctcactgagtcagtgtgtgtgtataaaattaaaaatgcaaaaattattttttctggttcagggatttctgtgataaatgtttttctttttaaatatgaacagtaagtcgaacaataaataaatgtaataagacaagagtaagagccttctacttgtgtaaagactttgtgctaggaaggtgtgtagccgcctctacatattcaattttaactttctcttattgtttcttgaaggacaggactgcagagctcactgtttaagggtgactatgctctcctgtccattcattcatggagacctgagtttttctctagggacatattaaagtagcctggagttagaacagcacaaacccttcaaaaagtggtaaatttctcagcggattccacagttgtcatgaatgtgattaataggtgatcaaggctcacctcttcatctggagctacctagacaagcagaaagggaaattctatttccagctcctaagcaaataagtaactgaaaacatttaatttctgggagatcttacaagcagggccactctaaaatgaacactggggagtcaaaaaaaaaaaaaaaaggaaaatgactgctccttacctgcaccaatgactcgggtgatgctacccttgaagattccgttggtcctgatccaacagaacatagagagtgacactgtgtatcttctatgaagaagctagcacagtgtggaaaattggccttacaaaaatgtgtcatgttcattacttttaattaaggaattaaattatgttttaatttcctggggtttatcacacacttatttaatagtaaattatattattaccaggattcatggtgtggtgtgtgtgtgtgtgtatgtgtgtgcaaagtaggaaacatgagagataaatgtaatttaagcatagaatgaaataaaaatgtgttacagaaaaaatgaattaatgtgtttattgatttttttcttgtagatcccagataatgtttacattttgaggttttttttggggggggagggcagtgggggaggttggggacagagtattgctctgtcgcccaggctagattgcagtgatgggacctcagctcgcggcaactgccacctcctgggttcaagcgattctcctgcctcagcctcccaagtagctgggatcacaggtacatgccaccacacgggactaatttttgtattttttagtagagacagggtttcaccatgttggccaggttggactcaaactcctgacctcaggtgatccactcgccttggcctcccaaagtgttgtgattataggcatgagccaccatgcctagcctacattttaagtttttaaaaattgtgtttttcactttcttttgggtgagtaaagttttaaaggtggtgtaattctcaccaccacattgcctgtgttttctctgatactattaagtgactttcaagagagtagatggttaccatgttgaggaactcaatatttgtcccaagtaaataaaatcaagaatattgaatattgcactaaagctggttgtgaaacatacatagataatgacactagtactcatgaaaatccatgttggagggaaacacaagacaactgttgttcgtactgttccctccactgctttgtgtactgcctgcctgtgccttggatacacgtgccctaaaactgtgtattgtgtggtgttattctaaaactgtgtattgtgtggtgttattctgaaaccgtgtattgtgcggtgttattctgaaaccctgtattgtgtggtgttattctaaaactgtgtattgtgtggtgttattctgaaactgtgtattgtgtggtgttattctgaaactgtgtattgtgtggtgttattctgaaactgtgtattgtgtggtgttattctgataccgtgtattgtgtggtgttattctgaaactgtgtattgtgtggtgttattctgataccgtgtattgtgtggtgttattctgaaactgtgtattgtgtggtgttattctgaaactgtgtattgtctggtgttattctgaaaccgtgtattgtgtgctgttattctgataccgtgtattgtgtggtgttattctgaaactgtgtattgtgtggtgttattctgaaaccgtgtattgtgtggtgttattctgaaaccgtgtattgtgtggtgttcttctgaaactgtgtattgtgtggtgttattctgaaactgtgtattgtgtggtgttattccgaaacagctcttctaaaaatgggatccaagaactcctggacttctctgatattcttttagcggtcaacaagcatctccctttccaatgactacactaccaaccatcaatatattttattttacatatctccaccaaaacaacaaactttgacaaagttaatgcagaaggtgctgagaatccagccaccctgtattaagccacacattaaggggctttgaaaaattttaaaatgatgacattcttcacattaatttttgctttgtttgaaaatgaatccttattgttcataaaaatgtgttacttatgtgagcatgtaattgatatgttattttaaattaatacgtaaaattgtatccgttttagtgtaaataaattaacaaatcaatattttaaaataataatagtttttaatgtatgatatagttataaaaaggtctttggggtccagtggtaggcagaattcgaaggtggtccctacgtgtcccacccctgagtcgagacatctcctcaaatcctctccccctgagtgagggcagaactctgaggatgttaggagtcagctgactttgagttaataaaaaatgagatgatttggatgggaacagcctggtgagggaagcccttatcaggaactaagtccttcctgaagtcagagagattggactcaggagagggcctggtggggtgggggacagagggccaggagcttagtatttccccatcagcagcagcaataacatcaggtcctcagccacacaccacaaggacatgaactctgcccaggagccaggtttgggaagctgatctgaacctcactggacctcgctggatcccactggagcccactgggcctcactggacctcactggacctcactcggcctcactgggcctgactggacctcactggacttcactgggcctcactgggcctgactggacctcagtggacttcactggacctcactgggcttgactgggcctcactggacctcactggacctcactcagcctcacggggcctgactggacctcactgacttcactggacctcaccggacctcactgggcttgactgggcctcactggacctcactggacctcaccgggcctccagccctgtcaacaccgtgaactctgccctgtgagaccgtgagcagaggatccagccaaaatgtgccaggtatctgagcccagaagctgggccgtagcgaatctgtgttatcatgaggcccttagcacgtggtgactagttatgcagcaatcaataactaacacaggtcctcaaattttaaaaataaaaattttatgaaaacccctgagaacagttgccttcaaagaggctgggctatcccttccatagagggtctgctgaatgaccttggtaaaggggtttctagacttctgtactctgatgtcatttccaaaacattgaggcaagagataaaaagaggagaaagcggccattaaggcttgtaaattttagccagcatcccaatttaaacaaaaagtcacacactacgacatctaagacggcaaacctatgctccaaaaagagaaaaaaagattgacaagccctgtattagtacaatttaaaaaatttttttaaatgtttaaaatatatatagtagatataagaataaattgacaatatcaacatcaggccttttggggggaaaaaaaagacaaagcagaaaatttcagtttggtcacaaaagtaacaatatactccatgtcagctttccccagcacactgcattccctggtgtggaattggttctctgataccattctccaccagacgataccagggctttttggagaacaatgtgtttgggtaagaaaaattccagataaccatacaacatcctgtttttatgagaaaacaaggaccatttcagagatgttagagggaccaaatgaaaaagctgtgtaaaagggactccccggccaaagtgtcacaacctgagctacagatattaataaaatcatttttttaaaagtcaacaatgatttcagctggaatccagtgactctggaaaatgccacgtgtacacgatgacattcaagggacaaatagcaaagtgtgatagaacagctcgtgcccagcccgcaagcagcaggcagctgacaatttagaaaacaaatttgtggcccgagacacctagacatgtgatgataaatgatgtgtgggggttgtgactggaccccgctccgtgtcagaaacaccagaatacagttgataaaaccagaggcaggaaaacagactttctagaatttcagaagctggaagcagaaacaccgttcaaggacagcagagctctacctttgctttctttcccaagatgaggtcaacgccttgctactaatgagtttagttcaggaatgaggtttttgttaacattcccttaaggagaaggctctccactgtacgtgaaaattcttcgggaacgctgagttgtgagcatggaagattgtcacgcagcaaataccatttggcacggccctgctctgggaagacagggacaccgtaggtgggcatccctgggaaatcagagagacaagaaaacgctgtactgcgctgtgccagccgcagaagccctgtgtaaaaccccacctggaagaaattaataagtgtctgtttttaagatcctatttctggtttgaaatcgacaagatgatgttggcgggaagagtctaaaataggcaaaaggttagagttcctgactccttctcctaatctctccttaccggtgctaatgctggaatctccaggtgacaaaatctgtgcacgactggcaagaatgtcgggaaggggggcatttcctaagctgcaaaggtgtgacaaagaggaacggctctgcaaactcagtgaccaggtcattacccatccaaaccaggacaccgttcagagtgacaagcaatcactaataaacacctggaaaacaggcttcaggcagggctatcttagagaaacggggaccatgttcattacgattatgaaagctttgagctccctgaggccagcaatccttcctgatttatctttgtgttcctggtgaagagcttgtggtacgtgtttcattaacatttgttctattaaaagttgaattaaaattattatcaaagacagttaaacattcatgcttttgtctttttcaatttttattctggcatattcttaccaagctgtgtattttataaattatacactattctacttgtttttatgcatgataattttctgtgaacaatcaagtaaagattgtatactagacacatctgattcagagtgctctgaacaatactagcattgttttatttttctatttcaccatatttaatgtgaaactcactgaaagctttaactgcttatcttgtacctaagagaataatcatctcccttgtgaaaacagtctttatttgagaacacaatatcttcagcattcatactatttcccaagatcccaattagaactcttgaatagtctgtctatggcgtaagagttatctttttacacataggtttgtatttgtctttgagctgatttgaaatacagttggagaaatacaattattaacaaggaaaagacaacatcaaatgcctaatcgagcagcaatgtggtttaagtatgtcacatgacaatacatattcacatcgcaatgaaaagacaggccatttgttcttttgatctataggactatggtagatgatagctccactagagaagctcaccactgacataagccatctagaataatctaggatgccgtgactttcaggggtgcctccctcatcacttacctcgacagcttggcctctcatctcctatgttccacgtcccattggcctggcaccgcaggagcctccagccttctaagtagtaaccaggactgcagctcagcaatacttgagcaccgtactcattcaaggatcctgaaaccagcctccagatgacatgttctgagagctgagcttcaatgctggggcaagcgaccgctggaagggaaacgtacatcacatcatcatttttcttttttggaaaacatcagaccgtgcttgctttggatggcaaggtcttgctatatgaaactgatcttgtttggcaaagttgatgccattacgtattatctcagtgtttctctaccacccacatagacatatgggaatgatcccatatgtaaaatgcattcaattgcctcactacagatgtcctgggaagtctgcagtcagactgaactgtaaagggggtaaatcacttccacaaaagtatatggctcattgaagttgatgaaaattttcatgagggtaatgagcatatgcaaataaaaatcttacatataatttccctcaatatccttggaggaacttggaatagtaattgtgtaattgcaaaccagctgggacactaattttcagaaactcagatgccctcatttcttcaaacctatgaaacacacatatataatatatctatatatcattgaatgtagaaacacacagaaatacataggcatactgcactaatactgtttccaaaaatgtttaacaagtcttaaaggagaccatctattcatgtccttagaaaagggcctagaatatagcagttacttaagaaagagtagtagcaattgtaatagtgacagcaacagtagtagcagtagtagtatactattaccagggtggacttcaaggactttctaaatatactgaaaatatatacagagtctgagttgtatgtgggtacatattctttgaaaagtgcaagatgatttaaaatacattacacaaaattagaaaccagaaccatttctctaattacgaagatttagtagctatcattcattaaaatcaaccaccaagaaaattgatcaaattgattaatttattgagctgggaagaattaactggagagactatagctattttcagaatcatagtgttatattttaaattctttttttgtgtgtgtgacaaagtctcgctctctgtctcccaggctgccaggctggagggcagtggcatgatcacggctcactgcaaactctacctcccgggttcaagcgattctcctgcctcagcctcccaagttgctgggactatggggatacagatgtccaccaccatgcccagctaatttttgtatttttagtagaaatggggtttcaccacgtgggccaggctgctcttgaactcctgacctcaagcgatccacccaccttggcctcccaaagtgctgggattacaggaatcagccactacaccaagcctatattcaaattctatacaagtttattagaattgagtcaggcataaccaaaattttacaaaaatcttgattagtcttttctcagtaatttccaagtactatataaaaatatacagaaaaatgtggctctttttgatatcatcacaacagtaacaatgaagtctaaaatgggaagaaaaattgctaatttaaaagtaatccttaggtttctttctctcaagtatttttttaggttgaaggaattattctaaatttataagaagattcaaatgtttaacctaatgataaaaataatatttttctccagccaaaatactcttacaatttctagcaaaactgtttctgaaaagcccttaaaggcttttagcctcataaatttataactcaacttgaatctgactgcatatttcaaataaaatgcatttaatttcaccaaaaacatgcaccgcatgttctcactcataggtgggaattgaacaacaagatcacatggacacaggaaggggaacatcacactctggggactgttgtggggtggggggagggtggagggctagcactaggagatatacctaatgctaaatgatgagttaatgggtgcagcacaccagcatggcacatgtatacatgtgtaacaaacctgcacgttgtgcacatgtaccctaaaacttaaagtctaacaataataaaaaaaaattatttttaataacttgaactatcttttacaaactttatttctgccaagaatgactcaactttgttctttctttctttctttgttgtttccttgttgttttatacagactaggtctagttatatggcccacgctggtcctgaagtcttgggtcaagtgatcctcatgctcagcctcccaaagtgctgggattacaggtatgagccgctgcacccagccaaaaattccaatttggttcacacaacggaatcagacaattttttgagctgataccatctacagtatcaatttccaagttcttcatgatgatctctttcttcatgaaaatggtatttggtttggtttgtaattatcttaggctagtttgattatttgctcacatctctcttttttttttttggctatgctataccctcatttattgtaaacactgtctttttacatttttttagtatagtgactgacaaattagacactatatgtgtgtatgtgtgtgtatatatatatatatacacataatataattatatgtgtgtatgctttgaaaaatagcctgccaagaaaatacattgccacaacaaaagaaagagaggaaagaaacgtgtatgagtggaaattaggagtaaaaagaaaagtgaggactgcaataaatattaatattaaagtccatcttgtcctttgttaactgaaggatgagagtggaagagtggagatttccagaaatttgtgcaaattatcattttatttaatattttttaagaatgataggtagagaacatacaaaaaaaactgagtttgaatactctgtgacgtaatttgggaggagaaatcccaaataatataaaccaagaggatgccagaccattttccctaaagagtggtagaaaaggtacagtctttgtcagttgtgtctccatgcacccctgcgttcatacaaaaacagtgccaacagcccccacggaatggtgggccctgatttgctgtggtcaataaggctgtcccaaagaatgtcctttatcttggtccaataaaataatgtggcaaaaatctgataacagaactgtgactctcgcgagagggtactgaattcaaataaaaacagaacattttacaacccccaaacacctaccccagtctactgattcacatgcctgtacgtggtttctagtcactgacatcagaagcctgaaaacagtgtcttcctgcagtccctgtcacatacactctcacaaaggtgtctacactcaacccccccaactccctatgttttctcctcttctgtgcatcctcaacctctaccttacttcagagtcaaatgcttagttttggcgcaaaatttcacttgcacacccttaaaagaatatttttaaaaaacactgatctctttatatacccttcattaaaaatttaaaattttcctcataagtttaagtcattgacattaccagtatatgaaatgcaaattatggtaaaagtgccattaaataaaataccacttttactcaagtccaagagaataataccacggcaacttgacacttctgaatattcatttaaaagaaattcaacaaatttatttcattccttgttctcttccaactattaattctaggctacagtttctataaaaaaaatttaaagatattttattttgaaagttctttatgaataatctataacacttaactgtaccaaacttcgatttttaaatttcctgtgaccacacattttcacagtgaaaacattctctttgatttagatgcaaatttcctattaatataccattgattgaataaacaatatgataaaattgttgataatctacattcaacacaaaagtaatgttttattggtaagacaccaattgatgctacagataaagcattgttgttcatgcactactgattgttagaaagagacaagctgtagtatcaattgtattgctattgtggacttcagacctcaagacaagtagtgttaaaataaatttggctcactgagaatgacggttaacacgggaacagaaaaccaaacaccgcgtgttctcatttataagtgggagttgaacaacgagaacacatggacacagggaggggaacatcacacaccagggcctgtcgggaggtaagggacaagaggagggagagcattaggacaaatacttaaaccacgcgggatttaaaacctagatgacaggttgacgggtgcagcaaaccaccatggcacatgtatacctatgtaacaaacctgtatgttctgcacatgattcccagaacttaaagtaaaataaaaataaaataaacttaaagtaaaataaaaataaataaacaaatttggcttcgagttacctttacaccttgaattcctacacagtgaactgcaacctcactcagtacacagcaaactgcaactcaactcaagaggatgtggttgtaacaaggagttgagtctcagctcatcacagcagccttgcttcagcccatcgcgggccccagactagtcagaccaccccctagtcgggcaggtgcccagacgtggctcctccagctgcctccccatgtgccttcctttttctatcagtgctgctgcccacattgctgggtggagctctctggaccttgcctggatttgaaggctgcctgattgatacacctatttactcaaataaactctgctaaatttcatgtgtcaaaagttttctcttaacaggtagaagaaaaatagttggaatgaagaaaaagatttgatgtggtttctggctgatgaaatcgcccatgcttttttgtccttttttaactgttttccatagtttccaggttttctatatattactaatggtcagagaaaaagccaaccaagagatcaaagggacttaggagtagtggcctgataggcacagacatcattttacagttaggctgaaaaactgaaagctgagaggactttatttgtttacaagaaaaactggaaatagttcaactaagtcccagtgaaaaaatcttctgtcttgaggtacaaatatatatgtatacaaacacacattacatatataaacacataaaaacacataaatatatgtacatatgtaatttatatgtatgtataaattttaatatatacctactacacataaatgcaaaaggttataaaaatcaatgcataatagtttaacaagggattatttaggaagactaggatgcttctgttatgttcttactttgttatttcttcccacaatatcatacttagagaggaaaaagtgaaaagagagtaaaaatatagtctatagggacattttcatttcatgacattaaacattatagactagggaataagataaaactgagaaatatagaggatggtagaatacatgaagctgaagttaagaactggagcaaaaatatgactcgaacatcacagaaggcaaagcgtgagccagcggcactgtggagaaagggaaggagggcctcggaaacggctttctactgagctctcatttctgcccagggatggccctaacactcaaaggcagttgcagtaaacatgcacgcctcccctaagacttaagacaaagtggagttacagtcaggaggcaacacgaaacagcctgagtacctctgtgctgacatttttaaagaaaacacttggttctttctaacaaaaatatcttagctagatctctcctaagatacagggctgttccctgtacctgccagcactccccagtcccccaccatcataggcagatactgcagagcgcggctgctcccagagacgcgcatctgtttaaaaagctcttttcacattgtgtatgtaattgtatatgtaattctactgtaagcggatcctcactcacaacgacactgagacagaaaaggagggtatcactattatttgtatttatttgcaagttacagaggagcaaggaagcccaggctcaccccaaccaagccagaatttccatctgtgggtctcacatcatgttgtgtttctgacttgtcactttccctgaacactagaaacaatacgggaaaatttgatttattctacaaatgactaaaatgagtaactccaagcatagtttcaggaattgaatcgacaagagctccaaacatactagcatacagatatcaaatgaataacaaactccttgaatgttttaaaattttggtcaacctgggaaaatgtagcaaaagaaagtgttttgctaatataaactttataaatcaatatttttaacaattataagtgaataaattgccaggtcaagttttgtaaaattaaatgttttcaaaaacataagggtttagctggcatgacagacattgttcaacttgccagtttaccttatatttcttcttttttatttttaaggaaatacaggctaccttctattaccttaaagaaaacaactataaaggaataattttcttcaattttcacaaattcaggagaacatttactggagatcatttcaaaatatttgacatggttaataccattgactatgttgatatggttgacacatttttgttctaaaaaccttaaattatgcttcccaaatccagatcagttgaaagtataaacaatatatagtcctgtgcataaaagacacattgccctgacttgtgagtgtttcagcaacaacacaaaatactttgcattttacttaagaaatatcagcctttaatttggccgtgagtaattctgatttattatagactcattcagccagtgacaggatagaagaataaacattgctttaagatatttagacaagggaagtgagattaccataaataaagccctttgcccttctctctcaaaaatttcagaaacttatcataaatcttctgtgatattctaatcagcccctagattctggatgcaattgttttgttttgctttgttttgtttcttaacagagaagtctcccctatcgtactcaatgtgggtaagtgcttcttataaccaactttaattgaagcacatttaatgagatttataaaattatgattagatgtcattggagtaaactgatttaatcagcctcataactgttcctcatacacacaactaaagcaaagtgtgcagtctagcactaaaaacctgtgcttactggacacgcgagagaaaaactggtgttagttctagtaccttagaagcctaaataacaagacaactttggtttgggtaaaaaataaatataaagtttttggggaaaactaggatactaagaccttttaaatgtgtttcataccatcgaatttcaacaatcctctcttaaaaaacccgtccaccaagacaaaatcaagaacatgggattcttttctttttggcttttagaaaattatttcaatagctttttggggtacaagcgtttttggttacatggataagttatctaggggtgatttctgggatttcagtgcacctgtcatccaagcagtgtgcactgtatccaatatgtagtcttttatccctcacccatcttcctatctatcatccccttgagtccccagagtccactgtatcattcttatgcatttgcatccctatagatgggctcccacttaaaagtgagaacataacgatatttggtcttccattcctgagttacttcacttagaataatggcctccagctccatccaagtccctgcacaagacattatttcattcctttttatggctgagcagtatttcatagtgcatatataccacactttcttttttttgtttttttgagacggagtctcgctctgtggcccaggctggagtgcagtggcgggatctcggctcactgcaagctccgcctcctgggttcacgccattctcctgcctcagcctcccgagtagctgggactacaggcgcccgccaccaagcccagctaatttttttttgtatttttagtagagatggggtttcaccgtgttagccagggtggtctggatcttctgacctcgtgatccgcccgcctcggcctccctataccgcactttctttatccactcattggttgatgggcactgtgtggatttcatatctttgctattgcaaactgtgctgctataaacatgggtgtgcatgtgtcttttccacagagtgacttctcttcttttgggtagatgccccgtagtagggctgctggagcggacggtaagaggatatgggattcttaaggacaaaagttgtttttggatttttgctttacccttacagcttaacgaaatgattcctaaatgagttatctagaataagagtagatgaccaattaatagagttttaaagttaacttctaggaagtaatttatgggctcacctgagagtgactagctttttagaaacattagacaaaaaggtctcaaggcattaagttctagcttcttcttccccaagatttccaactgaatctagaccttcataacactgtcatattcttagggtttcgaatcaccagacttttccttattcctgccactactgttttttccatttgtgaagcttctaaaaccttcagaaaatcgggcatctatatttctctggcccggctttcttattttttatactatggttattttaaaatacatatatttgagcagacttagatcctggaatatttaaataactaactatagccatgttaaataaatagtgttccaacgctatcggtagcctaaaggcaaaccagccatggaatctgatctcagcgagacaagaccaacactaaattcacctcatccagttagtgataccagcaaataggcctttgaagttttgcaactttattacctgagttcaatatcaaagctactttttaaatttcatgaaatgcctgatattttaattacataaaatgagtctaatccaacccctgggaaggattttgaaaaatagtatgactgatccaagcatagatttaaagtcaaaaatcttagtgttccattctttgacttgttgggcttaattgtaaaagcaatacacagcatttatattactggtggctctctttgaaaagattgtttccttatttacttctaaaacgttccttaaaatttttcttgtggttatttgttttgtttttatttacatgttataaggtttcacatgttgcctgcttttcgaggtcatggttttaccatgcactgcatataacgctgaactgggtattagacaattcctcaaattaagaatatccttagagctctttgctgaaaaaaaaattcgcttaagtattctttcctaattgccctaattataaaattttttcttacaatattttaaataagaatatatccacatactcaagcgtaatttgttgattatgatgaagacgaccttaaaccttaatgctattacggatttggcacagttagtgccatgagaacccagccagagccacatagaggcttaaacttcatcatggagacaagccataaaaaccagcagttggcatctgagctggtgactatatagattaggtaaactgataagaaattctacaagaatagatggcgacaagcagactaggtcaactcttgagtactttggatcttcgcagaagagatctagacagaaagtaacccaggcagcagagtgggagcaaagggtacttagagaaagtgggtggttggccattgctgtaaacaccgtgtgagtgaggcagacacaggaagctgaattacaagaaggtatattcctagattcctgcagagtgaagggtcctgaattttcaacttctagccttctcagcccgcaaaatctgactcccgtgcctgaaaccatttcttgacccttccttccttcttttccttacttccttcctctctccctcccttccttcttttcctttctttcttcctttccgccttccttccttcctcctttactttcctttcttccttccttccttcccccttcccttccttccttctctccctccctcccttccttcctccctcctttcttcctttcctccttccttcccattccttcctttcctccttccttctttcaattcttccttctttcccttcctccctccttcgttccttccttctttccttccttcctttcctccttattttcttcctcatacattatgacaataaacttccaccacttgtactaacctgaggaggcattttgcacttcttgagattataagccctaaatgacctcgtctgcattttacaacctttaagaaatgtgggttcagaaaggcatttcacaggcctaaggtctttcaaaatattttcctgtctatagcaacttgagttacagcacggccttaaaacccagagattagacttaatttaaggagattgcgtttaaaaattaagctcgtttagcactgatacatgctttgccaaatatcagcattcatattagatttgccgtccccaatatcaaaccaaacgtgttcctcttctaaaaattaatctggctttaataaacatagtcatagcacggaattctcttaaaagaagggtagtttccaagcaggtttcactgagaatccagaaagtgactccaacctcagagatgtccttagaccactgaggggtgaaaaggagtctcctatggattggtccagaaggctctcctctctctcacctctacttttcctcctccaatttcagagtgagaagtcaggctctagaatttggagaagatggaaagattgaaagaaggaacgaacatccaaactttatgttctgtttatttcctcatttctaatatcaccaccaaaatgttaatgcagccaaacactcccatcaaaaatattaacttcacctggctactattaagtaatatatagcttggagaagctttagtttctcaaatggattttaactcttattgagtgaaagggaaaatcaaggtgtagatagcatatacacattgaaatatatatatatatatatatatatataacagaaatatatatatgtatatacaaaatgattacaaattgaaatctatctatctatatatataaacatataaacatatatatgtatatacaaaatgataacaaattgggccgggcacggtggctcatgcctgtaatcccagcactttgggaggacgaggcaggtggatcacgaggtcaggagttcaggaccagcctggccaacatgatgaaaccccgtctctactaaaaatacaaaaattagccgggcatggcggcgtgtgcctgtaatcccagccactcgggaggctgaggcaaaagaatcgcttgaacccgagagacagaggttagagcgagttgagatcgtgccactgcactccagcctgggtggcagagtgagactccagctcaaaataataataataagattataaattaatagatgatttgaatgttttgtcgaaaataatctgttagaatatttctgagtaatattttcatataaaacatttaatggaaattgtttgcagcatcatgaacattttaaaacgtgttgaatgtttctacagaagttccagtgtcatatttctgtttccttttctctgcctaatattgcaaagcatttttcttcatatcggtaaataaattatcaatatttctgtacaagaaataataattttcttaaccaacatgaaaatggctgagcagaacttaaaaatattagagagctcctgacaattttgaattacatgaaattgatgtcattcaacatttttggacttaataaaaaggaaattttacagggttaaagcaaataatttagaaaattctcaaatattattttaacagttaaatagatatgtactacagagcaaaaatatatcccgtaaaatgcattttttcttgttttctttacagcattatattaatatagaacaagcaaattcttctattttatatgtattacttgttctctgatcccaaacataaagaatcccaggtaatatcataaatatgcttgaaaaggcgctaacatgaaaatacacaccttgaaaacctttttctagcaacatttaaattttttctaggcgtaatattatccatagcatcaggttatttctttttcttttgaaatgtcaatgtaagtgttggctgtgtagaaatatttttggttgttacatgcttgtagcatttcaaagaaaacagcaccacatctatctgtagaaatgtgaattttaaaaactcatacatagatagaaatgtgtgctaatattcccatctttactcaagtatacatttagaactgttaaatgaaagatgaggatgccaatccactgctattttataaaccgataaacttcatagttcaacacagcacagcgtttttgccagcctgtcacagcttctttctggcagccatcaaatggcggtaaaccccatgtagccgacagtctgtgggtgtaaagtgctttaaagcagtacagtacaatcacgcaaacgttatgctcatttctaaaatgtcttttgacatcacggtcctcttggtttcagaatatgttagtgattattggccacccttcatctctgggaaacatcagctctggaaggcacagaagccttaacaactttgtgcgggctcccatgccactgggaacccaagcctccctcatcatcacacaatggtttccagcacctgccaactctgttcccaagccacccaggcaggagggtgatggggacaattctccaggggtctctcatgcatctggttagctgagataccaaactgactttttggcctgaactatttcttccaagcatgtagcaaacagccttggaagagagaggtggatggatatgcaccctcctatctagcacagagactcgtgcatctccttagctaaggtaccaaactgaccttttggcctgaattatttcttccaagcaggtagcaaacagcctcagaagagagaggtggatatgtacctcctatctagcacagagacatttccttttatcaccttaataggtattttctaaatgtatttatcatctgcacatgatgatgatgcatttagatgaggtggggatgggacctttgtttgactttgtaaacctgcttacgggaatcccgtcgaagcacagctgaaagcgggacgggcactttacgctagttccacatgggtaaccctgtggatgagcataaaaggaccatcttcagtgctgactccatcatggagcaaccgagcaaccttgggaaaggtactcaagctcccatgtatactctgggcatgatagcagtacttcataggtttgttataagagctcagagatttaactcgtgtaaaatgattaaaacagtgcctggtgctcatagacataaccttagtttttctacattgagttatttatatttataggtcgtataaacctagtgctagatatgacctagtactgcaggattatacgtacacagagtactatagtgaatatagtatatggaaacctacagtacaaggtcactatggtgatatatatatagtatatatagtgatatacatatagtgatatatacagattatatagtaccataggtcactatagcgataggtttctatgacctataaatactagatatgacctagtactgtgggattatatgtatatatagtactataatgcatatagtacatgtaaacctacagtactaggtcactatggtgatatatatatagtacatatatatagtgatatacatatagcgatatatacagattatatagtaccataggtcactatagcgataggtttctatgacctataaatactagatatgacctagtactgtaggattatatgtacatatagtactatagcgaatatagtacatgtaaacctacagtactaggtcactatggtgatatatatagtatataaagtgatatacatataacgatatatacagattatatagtaccataggtcactatagcgataggtttctatgacctataaatactagatatgactagatggaactggtgatataaacctatcactagatatgagtatcaagctagtattgctctggtttgctttcccttttttatgatgtatataaattgcatttaatcatgtaaagtcctcatggtgcccagcatagagtaggtccacataaataaattgttaatgactgctttgcttcactgactagtagtagttttagctaaagaaacaatacccacatattgtgattagaacttaggggtttttttcatgcaaaaatcacacatttattaaacatattattaactgaaaaacaacataccagtttattttcaagtgctcttcatccaacaccttggacaaaaccgtcagctcaaagtgaattcaaaaaacacattataaggcaaacagtgacaagaggtatggacaggcactaccaaaaaaatgcaatttgttctctaattaaataatgtcattctcaagtgatatagagctgtcatcttgacagaattccttttttgtataaatattcataaataaaaatgtctccacatattggaaagagctgcaaacactctacaacagcagcttaatgtctacttcaggggaaaaaaaagcactaaaatcctcttccattgcaagctgtttatttctctggtgtaccacagctaaagatgagttatgatagcagcttgatgttgattatgttatattcttttaatcaaaaaggaaacacttataatattctaagtatctttagcccaaataccatgtcatagtgagcatttgtaaataaccagactgtactgtccttcatatgtgaagctgacactactgatgtgtcaatcaatgccaaatgttgggtaaagcatttaatttttatttatttattttcttgttgcatgaaaaggtgattgcattctaacttttgtgacctaccacatttaagatgtgtatacgttgttctttactttgtcccagaaaagacattttaatcctgtagtgactttgctcacttacaccagagaaataaacaatttagtttttcactggaaggctagcttaatggttttgttttctcctaaatacacagtatatgatacacatctttcatcattttgtcagactgttaaacccagtccgttaataccaatagccctcacttctttcatcatgtcattagcatgaatcgtgtcttcgatgatccaaatccagtctcagtaaataactgaaatgaaaaaaaaaagggacctcaaacatctgcctcggagatctgcaccactgcaagaaggcggcaaatggaagcataattccttattataaccttcattttactaaaaacctgagggtgaaacgaactaattgtatttaccatttgcatttactatttatcaaagctgaagtatttatctcttgagattcagtgtactgatctacatattactgcaattgctaaagaaacttaaaaactgtttcataccatcatatcatacaaaggaatgagccctggggaaatacatacttggacatttaatggtaaccaaatttttctggctaagaggtaaagttttatgcttactctgccagattttttccatttaaattaagtgaacaaaaacaatcccccgaataaaaattaaatcggttttccagcccttgaataccaaggaattttaacaaaacagccacatctcttttttacaaactttaaagaacgacgggaggaaatgcttacttgaaagtttcagatgatgcttagaaaatgttaacatggatttccattttattataaacgttacatttatttcctcatgttactgaacatatcatagttggtatcaaaagagtactcacgatgcaaattgactttttgctgtttaacaaccatttaatggaacctgcaataacttctttacaatgagaagcaattttgttaattgttgtcattgtaacttctttaaagcaattgtacatctagatatgtattttaaaacaaaaaaaaataggtataagtgaagctaccttaagccctgtcatatgttttacataggcacaaaaccgttctattgattgatacatttacctgtgaactgcaagagaccccttattcctgatttttccagaagattttagagaaaattaggccttgtccttaaagccactggtctattacctatggtgaccccatcacctacttaatacttctcagaataaaccacatgcaatgttaaagtggcacctgtttcctgcttgtgttctcagttttataatgcatcagatttaaaaatcatgagagctagtaagttcctagaagcaatatatcctagaaattaggaagacagattctcttctccgattttctggactttgctacttactgtatccatgaccttcaccaaattactcaactcatgccttcttttggttttcctctatacaatatggtgataatgaaattacatacctcataataattaagtaaattaacttgtgtaaagctattggaagcaagagtggaagacagtagggggtatagggttagttttaagctagtaattaccaatatggtgtgtagccctacttatgcacacagggactcacacacgatgtgggtggggctccaagtcggcctctttatcatacctgacttttacttttggagaaaggagctcaaaataaagagaagtttgtgaattttcttctaccgccatggaactctcaggagtttttctgcagaggagtgtcctcttttgattgctatgctcacaaagtcagtctggctgttgtttggagacacaagggaagcggaggtgaggcagcgggggtttcaggcgctcaggtggtgacctgggtggtgcagaagtgaagccacgtggacgcatgtgtttcagaggcagggcttggtgagggaatgagtgtgagagcaagaaaggagctaagggttacaggagatacctgtacgcctcctccggttccttccaccctacagtgtgtagctgggaatgtcctaaggctccaaaccaggcttctgcccaccttcttcacctctgcttctttttattcccttccgtggacatttcagagctaacagtgcgctcaaatcatgtctcctgatcctcgcccccacggatcatgaaaccaggtgaatactgaactatctctatgtacaggctgctggaatggacagagccttgaattctccctccaccacggtacagtgtacccccaggcaggccttggcagcgttacacaattgctgccttttcctgatgcccaaagcaccggtgtctaatcaaatcatttccaggcagccttccccgcagcagctgaagacttccaacacttccctagaggtttctgtgatgcccagccacatctgtgtgctcacatatggcaaattctttgatacctcaagttattttctttgtattaaaccactaagataaggaacataatatcttcttcctaggattgctattctaattgaatcacgtagcttagataaatgtctagagtgactcttcaaagagccgctctgggccaggcgcagtggctgatgccggcactttgggaggccgaggcgggtgaatcatgaagtcaggagtttgagaccagcctggccaacatggtgaaaccctgtctcttctaaaaatacaaaaattagctgggtgtggtggcgggtgcctgtaatcccagctagtcaggagactgaggcaggagaatcacttgaacccaggagggggaggttgcagtggaccaagatccagatcacaccactgcacttcagcccaggcaacagtataagactccctctcaaaaaaaaaaaaaaaaaaaaaaaaagagttgctctgattttcctcctattttgccaggccaagttctcgccccagccatctcttctgtagaaattggtcccagacgattcccgtgttccttcatctacatccgttattcttttccgctgctgtttgcatccggccttctgtttcatgtcctgtgcatatcttcaggctctaagggcaggagatatcacttaccagtctcacaccagtagttacaagcctgatgccccattcagagcacacgctccaggacgctcagtgaggggttgcgagtacacagctcctgcctgtaccaataatgtctctgcctcgctgtgcccatggaactcaccatctcacatgctgtcctgatggaatccagggcactttgtttgctcccgtcttttcgaaactctctgcttctcccttcctttacccccaaccaacgacttaaaacctacattgtgtttcttttcctcataattttcacatagttggctctttatttcagggttatgtaatgccaatcccttttttggcagatataaactacttgcatggacattctagagaccagcttgcaatgcagaggaaaacacttgagtgtgtctaattcctcaacccagctatgtgtggcctttacacagaaatatggctcatagggacataaaaagtagtttctgtttatgccgtgaaggcattctgttctggatgtattcacaaacacctcaacttgacggtgatagactgaaggttcttgttcattttgtcaatctgtgaagtaacaggcacatgtgcgagaaatccttaaagaaatctaagggtaacacatcattgcttacaataaaatttcactgagatgatgtatctgtgatacccaaagagctgaattattttcaggtaaaacaatttctatttagctttaaatgtaatgaaagtacccatgtcagtcaggacactgacctaaaatcaaataggtcagtataaatattcgcgaccaacaagaccgatcttgtaggaaactgggagatgttattttaattaattttacaaattaccaaattatattaaatacattttgaaaaaaagtgtccgatacatcatattctgtcgtagccaaataaaacggaggtaagaagacattatgttactggcaaaaaagtagacaaatgtgtcaatggaacagaatacagagcccagaaataaacccacataaatctagtcaatgaacttcgagcagaagagcaaacacaacccaagagagtaaagataatcttttcaataaatggtgctggaaaaactggatatctacattctaaaaaataatccagacacagaccttttgcccttcagaaaaattaatccattatgtatcacacacccacatataaagttcaaaaatataaactcctagaagataacataggagaaaattgtggtgcccttgggtttggtaatgactttgtagatacaaaaacagaggcaggatgcattttaaaaagaacagatatgttgaacttcattaaaattaaagtcctcagctctgcagaagacactattaagaaaatgaaaagaccagccacagactaggaaaaaagggtttgcaaaagacatatgggataaagaactggtatctaaactatataaagaactcttaaaaaaaaaaaaaggaagttaacaacctggctaaaaatgggcaaaaggcctgaacagacacctcatgaaaaaagacaaacagatggcaactgagcatatgaaaagatgctgcacatcatgcatcatcagagtattgctaattaaagcaataataagatactactgcacatctatgagaatggccaaaatccagacactgatagcaccagatgctcgcgacaacgtggggcaacaggaactctcactcattgctggtgggaatgcaaaatcctgcagtcttctttgaagatagtctgatggtttcttaaaaaactaaaaatactcttaccattcactctatcaatctcaaccttcggtatttactcaaatatgttaaaaacttatgtctgtataaaaaccttgcacacagatgtttatagcagctttattcacaattgtaaaacttggaagcaacccagatgttgtctgtacgtaaacgggtaaataagccatggtccatacagacaatggaatattgttcagtactaaaaagaaatgagagctagagccatgcaaaatcatggaggaaacttaaacgcttattactaagtgaaagaagccaatctgaaaggctaggtgccagatgattcccaatatatgacattctagtaaaggtaaaactatggagatgaaagatcaaggtcagtgtttgtcaggggttggatgcaggaaggcgtgaatgggtggagcacaggagactttaagggccacaaaagtcactttaggcgtgaatgggtgggcaaaggagactttaagtgtgatactatcatggtggatccctgtcattacacatttgtccaagcccacagatggtgcaacaccaaaaatgagctctcatgtgaacgctgggctctgggtgatgatggtatgtcaatgtaggtgcatccattgtaacatgcaccccactctggtgtgaggtgttgatagtggggaggtatgcacatgttgcggacggtgtgttttatgggaaatctctgtgtcttccattcaattttgctgtgaacctaaaactactctcgagaacaacgtctgtcaaacaaagaaacgaaagctctgaaaataaaaattacattttataaagtgaccttgtcatttagcaagtctttctcagatagtatacaaatttaaagtgggttttcctttaaaacatggcatatacttgacattttatgcataacacctagagaacttaaaaaaaaaaaaaaaactgatgattggtctccacctaagaccagttgcctcagaatccctaagggtcaaaactggacattaacatttactttaaatctctctagagtatttcagtgcatacccagtagagaaccactggcattataaaaggggtataggatttagaacaagagggagtagaattccaacttcaaatctgcaaattagtagttttcacctcatttgtgtcccagtttttcagggtttttatgagttttgtagataagctatttgaaatatttggcaggaaatacagactttaaaaatggaggcatcattatgaatgacctccaggctgtgtgcaaaagaaacattgtccataaatgtctgggacattgttcttattaaaatcaaccccaaacatatacatattgccatctgttaagttcctattttgagagaatagttctgtttaggactgaactcaaaaaacataccaatgtatcttgctatcctagcctcccatactattacttaattgcaataaaatagtaccgtcttaaatagaaaataaccaagaaatactaatgttgattcaatattgtctgactctcaggaaatgcaataaaaatgatgaaataaagaaaaataaaagcttttgggaagaactcaaccgccttccataattgtttgtctatttatatctaagtatatggatataagttagtttaaaatttttaacatgaccaaaatactgtagacaaaaagaagccaatgatctgactttattattgaagactatgtgaatccttctgctagtatcactggcgcaaaaatatcattgtaaataagtaaaaaaatagcagatactggtgaggcagtggagaaaagggaacacttgcatgctgctggtgggagtgtaaattagttcagccattgtggaaagcagtgtggtgatttctcaaagaacttaaaatagaatgctcattcaacccagcaatcccattactgggtatatacccaaaggaatataaattgttctaccataaagacacatgcacatgtatgttcactgcagcgctattcacaatagcaaagatatggaatcaacccaaatgcccatcagtggtagactgcatacagcaaatgtgatgcatacacatcatggaatactatgcagccataaaaacagtgagatcatgtcctttacaacatggatggagctggaggtcattattccaagtgaactaatgcaggaacagaaaaccaaatagcacattttctctcctgtaagtgggagctaaacattgagtccacacagacataaagaaggcagcaacagacactggggcctatgggagggtggagggtgggaggaaggtaaggattcaaagactgtctcttgggtactatggttattacctggctgaggaaactatctccacaccaaacccctgtgacacgtagttcacctatataacaaacttgcacatgtatccctgaacctaaaataaagtttttttttaaaggagatcattctatatgtactgacatgtaaagacatacatgatatattaaatgaaaaagattatagaaccataaaaattcattgtctatacagaaatgttatatagtttttaacttagaaaaattgggaagttacattatttccaatttgagtctagttttaatatacctgcaatgaaaatcttgctgtagaaatttagtgtgtatgtgagtggaactattcttctggtgggttttgcataacagactattattccataagactagagtttcagaaagtactccaatttgttactcttttaagattattactatagactgtaaatagctttctcgaaaacttaccccacttcacaaatcaaattaatgctttatttactgagcatcgatgtgttatgcagagcaggtgatacacaaataaatgaggcactgcttttgacttcaaagaacttaaaattatatggaagataaataggaaagattgtgttacattatgttttaacatcttgagtacagtcttattgcagggcttaatgtctcaatttcctctagatttcatccctccagattgaaaatggcagcacagaataggatgtgatgtgcaaattacatcgtgtctatactgtctatatttaggattcacctaacattcaagagtgcatagctcattctaaatggctgaaaatattttatatgaaatacattggttttaatattgctatgatgaaagacaccaaatcctcacaaggtgtgggagaggacctctgaacgtgggaacccggacttctcccgaaagcattcagttcccacctaaacccacaaagatgggcagatgcccctgaacacttacgcttacacgtgggcggcttccccttgttactccacaacccatcttcttgacacacggctgttgcttgctggctggattcaagcttgaagccctcatgacattcatagaccactttactgtccaaagtgaactcgttcccggtaaatgaaccgtttcctggggattctgggattccacaggacacagctgaaaagaaatgaaacaaatgtaggcttattcttacagaaattattttccagctattaaaaccattgattgattaatcattattattgactccatttttcattaaaattgtgaattatatttctttttttttctttcttttttttttctggagacaagagttttgtgctgtctcccaggctggagtgcaatgactcgatctcagctcactgcagcctccacctcttgggttcaagtgatcaagtgattctcatgcctcagcttcccaagcagctgagattacaggtgcacaccaccatgctggctaattctctatttttagtacagactatttatgttggccaggctggttgccaactcccaaactcaggtgatccgtccaccttagcctcccaaagtgctgggattacaggcgtgagccaccatgcccagcatgaattctatttctagggtatgggataagtatacacattttcaaaatcttaagtatattaaaggttaaatgaggaacaatggaaaatgggtcagaataaaagctcttcataattatttttctggaagataagactgaccactctcatgcagcttagccgcagtctgacatattttatcagagggtgtggccacgggagcacaatgtcacacactcaacttcatctcatattggaaagaaagaagaagggatgaagcagcatctttatcatcacaatgcttattgcagtgtagactctttggtgtcgaaattcctaagaatcagccgcctcagctctgaaaagtcttccctttttattgttcctctccccttccccaattcattttccctaaagccccaggaagttctgttacaagaaaacacgacataaggaattgatagaggaggcactcggggaagattcccagggcagaaggcagcatctagtggggatgtggaccgctttcacgggaaagaccatgcaagaaagaggtatgcatgcagatgaggttttataaaaaacaagatttggggagaattctgtgtaaaccctttcttcttaaatttgctatgtctgatccagatgtatctactatgggacaagaaaaaaattctcaaacgattacatgtgacagtcatgaagccaacaagcaggcagagggtgacatttcaataatcacgtacccacttcagctgcactcataaaagaaaagttctatggtaactaaataaagagccttcttttactcaatcagtattaaagatattgttcacaccatggatttaaattcagatagttcaaatttttcccatgtagattctaatgagaatatctgtgtaacaagatagagcgggaagggctggatgaagaaatgtatataaacacataattctacatataaagaaaatgactaacctaaggtgacacaatgacttagtaacctctggccagagagcaaatcttatgactcccaaacgagactattctctcttctgcaaaagcacaggttatctccggtattgttggagttccttggtttgctgtattggttctttcttctttaccaaaatattaaataaatacaatgggaaattgccagagaagtaaaagaaaatgtattccccaataaaatccaaactcctggaaatttcaagctctaaaatgtctcatgtttaaatggatgatcaggtactgcaaccatcaaaaatacatgtgggccgggcacagtggctcatgcctgtaatcccagcactttgggaggctgaggcgggaggattgcttgagtccaggagttctacattagcctgggcaacatggtgaaaccctgtctctaccaaaaatacaaaaattaggcagatgtggtggcacacacctgttgtcccagctactcaggaggctgaggtggatggactgcttaagcccaggagacagaggttgcagtgagctgaaattatgccagtgcactccagactgggtgatagagcaaggccctgtctcaaaaacaaacaaaaaacacatgcgtgtgtgtgtgtgcacatgcatatttacatgtgtgtacatgtgtccatgtgcgcacgtgtgtacgtgtgtgtacatgtgtgtagtacatgtgtgtatggcatactacaataatccatttgcagtagaaggaaaacgaaaaaccacagacataaaggcatcatttggggcaaagcatttcaaataataaataatcatctttggctctgtggaagcaacagatctgtgggaagactgttggcatgtggaaaatattcatcttaatttcctgaatgcagtaaatgccagagacccatcctttcttttctgtatctcacaatgttccaatatctagcttcctcatcattttctctcagatttcactctgaaaatcacgtgttcatgatcgcaagccttaatttttctcccactcgctggctggaatgtgcgcagtgttcagcttccttaaaattctcatttgggcagagcagggaaagaaatgacatttttctatcggacgaaatgggaaagatgacattctacaaacacagatgaagccccatcacaaaacaattcatactcgggagaccaaagcagaagatctttatagccccttctgttacatctggatgcttatttgagaagtgaacccctgcttgcccaggtcttaagacaacccattttatgttgcctgatcaacaaccgggaatctttttatggttttgaaccacagtgtttagccccttaagcgtcttaacaaaaggctatttggtagatttaaaataacggttggcaatgggtcaaaagtagaattataacacttctgatttaatggagacacagcataatccttatggactaaaatcaggctcatgggatgaagacagtttcctgctcaagtttagtattcattcatctctcatttattcccaaaattttgcatgattgctataggataggcatccatagatcactatttttttaaaaatgcgaattagcattggcaatgtaagaaactttcacagtttggagaatttccttacatttggtatatccaaagagagtaaaattcctcagttgttttttctttagttgtactaaggtattattatatgtcccagcagcttaggcgaataatcatttattgatcctgtaaagttaaattttgtttgggagcacaggcctcaaactcagacttctgagtcagttcttgctgtacctctcaataacagtgtggcttcagctaacttacttaatgaacgttgtcttcttacgctcaggttattaagacctatgtcaaaaggtaatcaggagggttcaatgaaatcatccttacaaaatgcgagccctctgtccacacgacataggcattcaatcaatgacaaattattatacgcagaaaatctaataattatgttataggcagaatatgttttgtattacacatacacacataaaatttttacttatttatttgcaaataaaaatattagttgcaaggattaactctctgttatctacttattaaagagagcaaagagtaagttggtaggtagtaagatggcttacttcacttacatatctcatgagaggtgtaacagtttgatttcaaaaaagtaagtagaagagacgtccagtgttgtctgaacctttaataccacaaaccccacatgggatttcttctttggatatctaagatccttcaaatagtggttaactttgtttccgcaggcttaaaacgtttctctgtttttttctttttttctttttgagacaaggtctcgctgtcactcaggctgcagtgcagtggcacagtccaggttcactgcagcctcaatctcctgaactcaacccatcctctcacctcagcatccccagtagctggggactacaggcccaggccaccacgcctggctattttttgtatttttttggagagactgagtcccactatgttacccagaatggtcttgaactcctgggctcaagccatcctcctgcctcagcctcccaaagtgctgggattacaagcatgagccactgtgcctggccagcctgaggatttctgaggatttttaagtatttccaatgtaagaattttttattaaagatacgtatttatatgaatatgtatatataactttaaatatgtatacacatatgaatgttaggattttcaagtatttccaaagtatttaagaattttttattaaaattatatatgtatatagaagtataaatatatgtacacatataaatgctaatcaaaattgtaatataagaatattctagattactatctacataggttgtactatacaatattagtgcctgccatttgtttttgagtttatgttcatgttgggccaagaaataacagttaattttttgcagcctaaagagaaaaatattagagacagataatggagaaatcatgggtttgcttcaagagaagaataagtgactatacagaaacttccacaaatataagccatataatgcttatatggtaagaaatgttgaaaagatggactcattttacacgcaaacacacacacacgtggtaaatacctatgagtatcatatataatttttcaagtaataattgaatttcataaaaacatcatcatcttaatggttattttcctcaatttgaattgtgtaagttaaatatgcatttaacttgcaaatacaaatatgcacgcaaaacattatgtttgtatatatttagtaagattataatcaaataattaaattcaaaatcagggtcattaaaacaccttaggaaacactaacttaagggaatcatcaactatatgtgtatttgcaggtatgtgtgtgtgtttgtgtatatatatatgtatacacacttatagctatatgtctgagaaaacatatataagtacatatgtgtaattatgtcttattttatacatgattttatagttatagtgttttcacatcatgcttttttacttaattttcactacaagcctattagatacaaacgttattcgactttcttacagataaagttacagatgctaacattttttatatcattttccccaagtctaatagtcattaaaaggctgaggcctcaaaacggttctgctgaattcaggtagactttctcatcccattactaaagatgcccggactattgtgattatgtattttcaattttaaatctatcagattagtcttcactgaagttttcataatttcattttcagtttaaaaatttatagtggttccttatttcccgcgacactgaacaaaaactacattttttgtcttcaaacctcaccaaaaccttcccctactctccgtaactttccaccgcctggccagcagaccctcgccaagtatccacgccgcccagtcggcttattctcactttcttgccttagttttctctgggttcttccgttctaccccaaatattcttcttattctgcacctatttaagcctactctagagcagaaaattggcttcaaccagcgagtcctattctcatctgattggtagtgctattgtgtgcaactgtttgtaatttagcaaatatttatttaaataaaaatattgcttcacaaagttatatataactgcactttctatagttgtctgtattaaattaccgtgtgcattgtcttcttaaaattactagtactttaaaaataaatatcaatgctgcttcaacagatctgtgcattctgaggcccatgaaaccagaatattagacccgtatttgtgggtagacagtaaatatatacaaatattttgcaatcattacaatttgcattaccaactttcttgatacacgaaaacaatcactagttaatttttcaataaacatgatcctttttggtgctaattgctgacaaatggtttaatcgcaacatataaggtgctaagacaggaaaaaatacacagttgtcgatttaccatgcaataaataccaggcctctagaaagaatgtttgtgccacaacttctcaaacattaatgtgctccttatccccaggccatgctgatggcactaatatcctgatgaagtacatctgggggagggggagatttgagactctacttttctaacaggctgcgtggtctcggaggagcaaggatttagactatcctaaatgccctagggaggctgctaagcctttgcccacacacggtttacaaacacctgctatataattcccctgctgagtgtcctagcaggatccacacaaatgcctcaagtaccctgcagggacctcccacctcctcctccattctgaagggtttactaccccttgctgcttctctgaatgcactttgctcaacaaccagccctctctttaaaaggaaggtgtgatgttggatgttgacatgtttggggaaaggaggatgtgttggtgatttttttttccgctaaccctgcgctaaagtgagaatcctgttccccgcatgtgtctcctcactattggatgagaccataggagacgctgcaagtgcaaatgaaggtctccccatcccatcaaagcgtattttagcacgactattaataataatggcttgttaagaactaaaaaaaaataaggaaaaatattaaaagtaacataagaagcaggcaccccagacatcaaaaaaaaaaaaaaagtgcccttaaaaaaccaggataaacgtttaccaaaaacacgagggcttctgtctttataaggtgatccttgcactcccttccctgcacaactttttctctgcttttctctgcaacaactcatgctttttaagcaacatcctcaggacagcctctcagttaacagttttcgagaaatgattgtcatgtgggctgtttgtgagccgctgtgaagcgaaaatgctgtgggataagctggagaggagaggaggggacacacgactcagggcccaggtgacaggcatgtagcttataggaggcacgtcaggacacccttcagagtttgaagatgggcagtgacaccaactcatttgtgacctgataaaaccctctggttgccatcaggagatgaacggagagagggtcctgagtggggcagacgtaggaagcccagtagggcagcccatgagagagaggagagtggactgggggaggggaaagatgtggatggacttggacccactgagtagctgggaccaacagggtgtgggagtcacaggaaagactttatgtgcaagcaagagagagaagtgattcaagcagttggatagactgagatgctaatttctcaaacgggattcacttcagggcaagtagattcaggggagaaaggagttttatcttagcagtgggatcgtgaggcacagtgggtactgcaattaggcagtgggtattaggtctggaactgagaaggaagggcaggcagcaagtgaagaccatgaagtatttctaacatttaccgcaaactggaataaagtactttccggctctttctatgccttattcaaattgtgagattacatagctaagactatacattgagcctgtcctaaaaattactaacaacttttttttttttttttctgagtctcactctgtcgcccaggctggagtgcagtggtgtgatctcagctcactctaacctccacctcccgagttcaagcgattctcctgtctcagcctcctgagtagctgggattacaggcgtgcaccactgtgcctagctaatttttgtatttttagtacagacagggtttcaccatgttggccagactgatcttgaactcctgaactccttgaactccttgaactcctgaactccttgaactcctgaactcaagtgatccacccaccttcgtctcacaaagtgctgggattatgggcatgagccactgtctattaacaacttttaaataataaaaaattactattagaacagaccacttacttggctaggaagttagacttgctcacaggcatgattgttgtaagttggtttacaagcacttgaaatttgatttcagagacttaaattcatgtttcactttctccatcaacttgtgctatggaaacaatcaggtatttcaaatctgatacaggtgatagcccccatcatgctttgaatgcatctcctccaaaattcagttttcaatatgatagtattaagaggtggggcatttaaaaggtgatcaggtcatgagagctctttctttgtgaatgggattaggtgtccctataaaagggctttatggagcagagtcatgccattttgtcctcctgcctcctgccatgtgatgacacggcattcctctctccggaggagagatgctgtgggtatgctgtgaagtgtctgtcaatttcagcttcatgtttgttacctcaaagtgaacaatggtgtgaaaccatgatcaaatatgcacatatatgtgtaggaactaaagatttgtatagttattttatactaatgtttataatatgttatagaaacagaataggatgcttgaaagaacatagatttagacatagcaaagtctgagtttggtatttgtctgtttgtttatgactcggacaatgtatataaagtatccaaacctttgcttcctcacctgcaaaacacaaatcacccatacctcctcagcaggggttctttgacagatgtacagtttacaaagcaaaacatctggaccctactaggccagcagcaaatagtcacatttattattttgtcatgagaaataataattttccttcagatttaatgtaaaagaaagcatttttctggtttttaaatgaaggtcagctaaaacctaaataaatatgaaagaatatttttacttttcatcagaatgttcgggacatttaccatcaaatgttttctctgcaccgtggatatccccttatgccactgtcaatggaatttaggatgcactcgagcaaacactgggagacgtgaagcttaatccacagttggccaggggttgacagtgtctcctcaatcatatgacatcttgagcttacacgaaccagcaccgatccatatacaataaagcactgaccccatgactcagaaagtcatatacacaggtggtagaaatgacaaagttatagcgaaatctctatgtttcaacattactgcctttatcagtataatatctgacatcattgatcaaatacaaattccctgccattgtgaaaagtttttctaattgcattacttcatttaatcttggtaacaccctacaagatagactctattttttttattacttgtaagaaaagtgggcattagaacattatgcaaatcacccacattcttatgactagtaaacggctctgtgaggggtcagatatcagagtagctgatgacgaagcctgcctttcagttactctcctgtgctgtctctgggctacacctgacttatttcaccatatgtatatttactgttattttcaatgtccacctatcaacattcaatcaatcacttagaaatacattttcaaatatgattctgaaaatacaaaggccacattgaatttgagcattaatgggaatatttctgggtcctttcttttttttctattttcctcccttatctttgatttccaaaatattttcttggaataattaggcaccaagaaacatcttatttgacatgtagccatcatccaatataccattaataccatgctgaaggctgagatagaaaataacagcaagagaggaggtgcagtacggagccacctctccacccacggggatagaactggtcacactgcttttctttactatgtgtaggtggtgcgatgtcgggtgtttccaaggagtaaacaccagcaacagaaatattcttccgtttgtttgaaaggataaagaaaagtgtgtctgaaaatgaatgtccatagagggaactaatgacttggcttttgcagacactaaagcaaacttaaaaacaacaacaaaacaaaacacattaaaaaaaaaaaagcccagcagctatgaaatgcaaaattgaggataataggattgagcgagaagtatctttagatgttctaatcctcttgaaaatatctagcacttcataacccaaggaagaaaaaaaagcatttatgaatttgaaacagacaaaaaagctatgaaaaagaaggcagcagaatagggttggcaaataaacagctaattattacagtgaaaggctctggcttggcaaataaagcctctagaatgtttactcaggggtaaattggctgctcagccaaagctgtgcaagtaactgacttttacccatctacttttagagtgttgttcaaaagagacaggtacaaacatttttaaactgtctttttttcggaatataaaacaaagatttattcaataaaaagaaaattcctagagaaaaaaagctggaggaacgtaaagtgacactgctgtgtgtcataaaaaactctgattcggatgccaaccaccaatgtcctatggaacccaagagtcccaggctcactaagcatttaatcaatctcgtatcataaaaacttacagaaggattttatgcacgctctttgtggccgatttcaaagggaatctgcattttggagcctatcctcatcctccctgataagtgggcttgttgggcatactctggtaaactagtcaagcccagaagcacatgttgtctctgataatgaacaagtgacttaacctatttcagcttcagttttaccttctgcaaaataagaataaaaacgatagcaaaaactaggaaataatgagtgctgacaaagatgtgataaaattgaaacccttgtgtactgtcaataggactgttaaacaatacagccactgttgatgacctatggtggttcctcaaaaaattaaaaatagaattaccatatgatgcagaaattgcacttctggctaaatacccaaaaggattaaaaacttgtacagttatgtccctagtagcattattcacaatagctaaaatatgaaagcaatcgaagtgtctgccaagagatgaatggctaaaccaaatgtagcctctacacacagtgggttattactcagtcttaaaaaggaagggaattctgacacaccacatgctacaacatgatgatcttgaagacactatgcgaagtgaagccataaaaagacaaatactatgtgattctacttatgtgaggtgcctagagtagttgaattcagagagacaaagtaaaatgatggcttgtaggggctggaggaggaggaatgggaacttgtttaatatgtgcagagtttcagttttgcaagttagaatagtccaccagagatggacagtggtgatgattatacaaccttgttaatgtacttaacaccactgaactgtacacttaaaaatgaaaaataataactatatgccacagatgcacggtcattaggataaagttagatagggaacattaagtcttgctgcacaatagccaatcagtacttttcaattttcattctctttcatttacaggtgaagaaatgaagcagcaagcacagctcaagctgcctcttagaggacacaggttactgaatacgttttcaacaaaatgaactttcaaggcctgataaattctcaaaacattgatctgaagtttggctacatattaaagatatgatttggatttgtgtacctgcccaaatctcatgttgaattggcggggcctggtgggaggtgactggatcatgaaggcagctgttctcatgatggtgagtgagttctcaggagatctgatggtttgaaagcctgtggcatttcgcccctagctctctccctcctgctgccatgtgaagaagggacttgcttccccttcgctttctgccatgattgtaagtttcctgaggcctcccagccacgtttcctgtacagcctacagaactgtgagtcaattaggcctcttttcttcataaattacccagtctcaggtagttatttctagtagtgtgagaatggattaatacaattaataagaatagtaaacacagaaaataaagaagaaataaacatatgatccaaacgtggaaggttgataagaatgttgactacagtaagcaaaccagctgctgagaataaaaacatccccgcattttctcaaagttggccattacaaatccttacatggttttgcaagaaatgctttatgggttctttccgaaaatgtgattctgattatttagaaataaccagcatgaggttaagcaaattccaacttaaaatctcaataaagtaggcattaaagacaagttaggggcttagtttcagaatcaaggaccaaaaatctttttttttccttttattcccagggtataagcaatgtggaagggagaaaattagagaacaaaactttgaaaacgagtctattccatgtgcactgggaaacatggctggaggagtttgcccatgcttccttctccagtgggtcaggctaactttttacttaatggaaaaagtaaacaaacagatgtacctggactagaatcttcacaggcacatctaaagaagaaataaacctggaaatcctcatttcataaataagcaaataatgtgtctatcattaaatttcaaaaagaaaaatatataaaaagaaagatatatagtgatagataaatgacagatgatagagtagatagaaagataggaacatacacagagaggaagactggaatatgatacatagatagatagatagataggtagatagatagatagacagacagacaacagatagaaagatagatacatagataagtggatagataaataggtcaaaagaaagatagaaaggtagatggatagattgctaaatcagtagagagatgataggaagatagatacatacagagagatatagatagaaaaatgatagacaataggaagatagatatatataaagagataggaagatgataggaagatggatacacagatggatagttatatagaaaggaaaatgatagatgatagatacatagatacacagatcgataggaagatagaaagataggaagatgataggaagatagattgatagataaaaaatgacagattgattgatcaatcgctaggttgattggcaggaagacagagaaagaaagatgatagataggagatagcctacaaagcatctgataagtattttctcaaaatataaaaggaaaattaggcataaactaaaatgcatggataaatcaaaagtattaacaaagctgagaaactagattccctagtgataaaaggcaagtagcagaaaccataaaatctggctcattataaatgaaaatgagtgaagagcgtagtttctacagctttgaggttatcacccactaagccagccagagtctttctccgagcactaaataaactataagcacaatggcaaatgactgttcagtcatttaaatgaaaaattcataataatgggccaactttccaaccatatttccaaaggttacagaaaaattgtctattggcaattagagaaattgccaaaggacaattcaaaggagtgcgggcctattgaggtctgtccctgcttccaagggctgctggttctagcatcgtgtacaattctcttggcacttaaactccgcttcattaacttttctactacaacagctaatgaaatgaagcatttcaatatccaaactccagtaattatttaaaacagatttagattcattcaaataaatgactccatgaaaatctcatagttttagctctatttgaagctcaacatggtcagagaataagtcacacatatgaagatacagagaatcagtgacagaactcaaatgagaactcccttcttgctgacttttccattacgcatttgaacagaccctgcagccaacaagaattcattacgcatgcaggtaaaatgaactgacgacatgtattttgaagtggactctgggggtcctttaattcttgagtaatcatggcttccttgtgatattttgtcttaatttctgaggaatttcaaatacagacagacaagagagtaatagctttagtaaaacaataatcacctgttttaaaaacacaggacacaatcgtatttgtcaaatggctctgtagattccaaacagactgaaggctggtcataagggagattaccaattctgataattgcatggtaatggaaactccacggagaacagaaaactgagctacacagaaaattggaaactcttatttaagctcatttctccacaattcctctggcctcaaaaatgcatggaatgaagtgtcagagttattaacagttaatatgaaattattacttgtagtgtctttgatcaggctaagtaggagcttctagttaagagaagttgatgggtgtaattaaattgctaataaagaggtacagactgacgaaaatccacaaaggctttcagaggttaactgatttaccacccctccttcaacctcatctctttcgctcagcctgtgccaggtgctaagcctggggcctggcacagaacaagaggtcaatacaatcagtctacggaatgaatggaccccacgtatgcacctctcgacctgtctgagagtgtcagccaacaaggtgcgtggcaatgttattcccaggccccatgcgtgagacaggagataccatgatactctgtctcttatcgtgacgtttttccaccatttccaccatgtacaaatcattaccagacgctctcacttcctttgtgcctcaaatgcccatcttttgacctcgatgcctccccgcactccaagcatagccatctcatcatagtccactgtagcttccttgcaggctcatgcttctttcaagttggaggagattatattggtttactgaagcaagtcccatttcagaagcagaaacattgaatgattttctccaggtccacacagacatttaacagtaaactgagaatcagaatttaaaccccagtactcctgatctaaagtgagctcaactctaatgtcaccatccttctcaccatattaatgtataatatatagtatataatatataaatatataataacattgatcaacattcttcaattaacatataataaaaatttatattcactaactagattgtatatgaaatatacaataaacgagtggttttaacaattatagtttatatcaaatattaatgtttaataataataattttacaactttatggtttctatccttggttccatgtgctgtaattacctaatttatcttactgaattctcatactaacaatatgagtcaatattattaccctccattttcaggggtcactgttgtccagaaatattagatgatttatccagagttcatctagtaaggggtaaagccagactctaatccaaatgtccagctctgaagtgtgtgttccttcccaataacagaatggctttttgttgtaataaataaaataaaaaatattttatggtttgccttttcccttatatttctatccaaaagggaaatctcactgcatgtgtcactaatgcctcaattatttcagatttttcaaaatggcttgaacagaggttcaaacactgtctcaggtagttttcaccatttctctctgtggtaattttcttcttgtcatttctaaaaaatgtgaaaactttcttcatagatttgctcatgttcttttttcttttttctttttgcagtatgttgaatcccacaggcttcaaagaatatgtcactttttcacctaacataatttaccactcactttgtgtagaaaaccatgacttttttagactctccaagactcaggacttctaacaaaaaatccccacacttcacatcatggaaactaaggaaaagtctgttgcattctaaattccattaatgacataatattaataaataaatacatatgcacatgtgtattaggccattctcgcattgctataaagaaatacctgagactgggtaatttataaagacatttagttggctcatgtttctgcaggctgtacgggaaacaaggtgctggcatctgcttggcttctggggaggccttaggaatctttcaaacatggcagaaggccaagggggagcaggcttctcacacggccagaagaggagcaagacagagttgagggggaagtgccacacacttttaactgaacagatctcgtgagaactcactatcatgaagacagcaataagtcgtgagggatccacccccatgatccaaacatctcccaccagacattacctccagcattggggattacaattcaacacgagatttgggcagggacaaatatccaaactatattatttctcccctgacccctcccaattctcatatccttctcatattgcaaaataaaatcatgtcttcccaacagaagccaaaagttcataactcattccagtattaagcctcatctgagacaaggagagacaaggcaaatcccttccatttatgaacttggaaaatcaaaaataagtttgtagcttccaagatacaatggagatataggtattgggcaaactttcccattccaatagggagaaattggccaagagaaaggggctgggccgggcgcagtgactcacacctgtaatctcagcactttggtaggctgaggcaggtggatcacgagatcaggagcttgagaccagcctggccaacatggtgaacaccctgtcgctactaaaaatacaaaaattagctgggtgtggtggcaggcatctgtaatcccagctactcgggaggctaaggcaggagactcacttgaaactggaaggtggaggttgcagtgagccaagatcacaccactgcacaccagcatgggtgacagagtgagactctgtctgaaaaaaaaaaaagaaaaagaaaaagaaagggattacatgccccattcaagtttgacacccagcagggcagtcagtaaatcttaaacctcccaaataacttcctttgactctgtcttacatccagggcacaccactacaaggggtggtttcgcaaggccttgggcagctttgcttctgtggttttgcagggagcagcccccaaggctgatctcagcagctggagttgagtgcctgtggctttttcatgctgagggggcaaactgcttgtagatctaccattctcagggtctggagggcagtgatcccttctcacagctccactaagcagtgccccattggagactctgcatggggtttcaaccccacatttcccttggcactgccctagtagaggttctctgtgagggctctgcacctgcaacaggcttctgcctggatacccagggtttttcatacatactccaaaatctaggtagaggctatcaggtactcttcattcttgcattctgcgcacctacaggcttaacgccacacggaagctgtcaaggtgtatggcttgcacccttcggaacggggtctgagctgcacctgggcacttgtgattcaaagatggagccagaacagccagtatgcggaaagcagcatcctgaggattcacagggccgtagggccctgggcctggcccacaaaatcatcttctcctcccaggattctaggtctctgatgggagggtctgccataaaggtctctgaaataccttcaaggccttttccccattgttttggaatattagcacttagctcccttttagtcatgtaaatttctctaacaagtagctgctccacagccttcttgaactcctcttctgaaaaagcttttttcttcctctgccacacggccagcctgcaaattttttaaacttttatgcattgcttcctgcttaaatgtaaatttcaactttaagtcatttatttgctcctgtatttgaacataggctgtataaagcagccaggccacatcttgaatgttttgctgctttgaaatttctttaaccagatacccaactcattattctgaagttcaaagttccacagatccctagggaaggggaaagatgcagccaagctcttcactaaggcataacacacatgacctttgctccaattcccaagaagtttctcatttccatctgagaccccatcagcctggtcttcattgtttatatcaccattagcatttttgtcacaactatttacccagtctctaagaatttacaaactttcctttatctccctttcttattctgaggtttccaaaccttcccaacctctgcctgttacccagttccaaagctgcttcaacatttccaggtatctttatagcaatgtcccactccttggtaccaattttctgtattaggcaattcttacattgctataaagcaatacctgagactgggtaatttataagaaaaagaggtttgattggctcatggttctgtgggctttataggaagcatggtgctggcatctgttcagctcctggggagacctgagggagattttaatcatggcagaaggccaagggggaataaccatgtcacactgtcacagggccagaacaggagcaagaggtgggtggggatgccacacacccaggtctcaaaaacacttattatcatgaagatagcaccaagccatgaaggatccacccgcttgatccaaacacctctttccaggcccacctccagcattgggcattacaattcaacatgagatttggccagggacaaatatccaaaatatattagtatgtatataatttcatgctgaaaggatcattaaaatgtaagtgggagatgaacaatgagaacacatggacacagggaagggaacatcacacaccggggcccatcacggggtggggagcaagaggagggagagcattaggacaaatacctaatgaatgcagggcttaaaaccaagatggtgagttgacagatgcagcaaaccaccatggcacatgtatgcctatgtaacaaacctgcacattctgcacatgtatcccagaacttaaaataaaaaataaaatgataaaatgtatgtctaacatacatttttaaaaatagaaactcaagccatatgccccaaagtaattttcaacctcaagtggattatttctcacatgattttcaaatttaaaaataaatgcaatattcattccatttgaatgcataaggctttttggaaaatgtgagcaaaaaaactaccattcatcaacaccattacagccactaattcacctgacatcaaaacagcctaaatgcagacagtccatctgaactctactccatggattcattgcaaatacgtcatttcatatatttataatttggtcaccaaacctgtccagttatgaaggcagcatctatcacagaacactgcaccatgtgcacataattgaaactcctgtgcccctcagttgatctctactgttttactcctcatgacacctggaagcaacccttccagtaaaagaaatgcgcatgtataatccactggtctattaacagaaaacaagcatggtaaatgattttctggataatgcattccatacaatgctcgtctaagttattttttagaagaaaatcaatagtacctcagaaaggttcaagagtaagagtgaatggcagaaagtctcgagtctcagggcatctgagatcaattcttccggagtctatgtctgcacagattcaaactattacaattagaggtcgaaagttttgtttacaaacttttacatggaagagtccaattaatgattttctctattaagctgaccaaactaggagtatggaaccgaagaatatatcaaaccaatccacaaaacaaatgctctgaattagaatcaacaatgaagattttaacaattaattatcaccctctaaaaaagcatagctaagaacaagcttcagaatttttttaaaccagtcatagaataaatcaatatgccaaggaggtattattttaaagaatattatgttaatatgaaccagaaaatgttccaccaagcttgtcatgtcatggtcaaaatacttggaagagcacagttcttggcgtaggtgtttatgtgcatgtgtgcctgggtttccagcccaaattaaagagctgttggaacaccctcagatgtttcatttgtgggcctccttttaatagtatcccaattttaattagcactagggaagcagatgtggcagagaaacgatgccaagaatctgaacttttcatctccacttggagtgaaggcatgaggttcttccatttcagtgcatagcatcgtattggttagcacagcttgccgaatatctgaatactggtcgatgtatatatataggtgtgtgtgtggtgcccacttttcagtattaatgggaacataaatatcatgttaattcagagtaatgcaaaacccagtatttgccttcaagtgtcagataatattaagaatagacaaaattggcttggaaaaatctccccagtcaactcttctcctaatgaaaaataaaatcataaaattaattttttccactcttttttgtaaaaatgaaatgcaaccctcccaaattcccagtgctatttcttaaagttagttaaaatgatgctaaagttcttaaataaatacaaaagtcctattgtctctgatgaaaactttgcaaatagagtgaggaaaatgacttgaatgcatttgatatgaaaacatattattgttatttcaattaaagcactatggacttggcataggaaatcatgcatgtaaacagaaagaacagcatgtccagaaatagatacccacctaccagatgatttaacatagaaagtagttggaattttaaatcagcaaaaaaaaattagtggagaaaataatgaaaataattacccagcaaagtatttaataaatgacactcagaaaactgggtagccatctgagagggtgacatcttaaaacaggatcacactgagatcaacacagattcactctagaataggaagcaaatacttacatgtataaatgaagcaaagctacagattagaaaattagtagctctatgtataaatgaaatcattcaaactttagaaaaataaatcaattttaacagaaaatagagaggacttttctaggccacagttcataaagattaagatgtttcaattcatagactataaaagacatttgaaatacatatgactgacaagtggctaataaattattgtacaaagaactttcaataaaattgaataaaaccaaagaaaaatgagaacatgaactttaaaaaaatataaaatataatggtcaaaaaattaccaaaaaaaaaaagtattctctactgagtaatgatcaaatgaatgaaaatggaaacaatgagtgattttttttgtttcattttgactgttagatgtgcaagaattaagaagattggcaattataatgatttctttttattgcaacataaattattccacacatagaggcccaaaacagcacacatttattccaacacgatttctgcagttcaggtacgggcgtggcctcaccctgagggtggcagcgggctgctttctcacctggaggcgcgggaagaatccacttggaagatcactcaagtggtggcagaaatacgtttcttgcatttgcgcagctgaatgtttcctgactggctgtgggctctcagcgtccagaggccctgtgttccatgttctgtgtctttcttcatcttccaagacagctacaaaggctctccctcacatccagtctttctcaggccttcaatctctgaccagtaagaactctgcccctagaagagcccgtctggtgaggtcctacaatctgagcacattctcccttcctgaagtgtgtctgtgccaacaacataacgcaatcacgggaggagggtccaccgcacccccaggtccatagggagctgtctacccagggcgtcggtcaccccacctcctcttaggattctaccttcaccaggctcctcaaacatagaagcttccagaagcaagccgtcacacctgtagtggagcagcctatttggattacccgaagatcagtttgacaagataacccaatatgtcatctgttcattgcctgtatttcactttcaagaaattgtatcctgtggcaatgagtggaagaaagtgcaaagatgtttctgaatgagtatgcatgtctgcattttatctaatagttagaaacgacataactggtcattgaaattgcaataaatatacaaacatatattttagaatagaatttttggcattttattataatttttggatataaaataatgtgtatgccatatcatggaaagtgtgatatcattcaattgatataaagacatagattatagatataatagatatgtttactgatgtggtttgtatctatgtccccactcaaatctcatgtttaattgtaattctcagtgttggaggtggggcctggagggaggtgattggatgatggggccggatttctcatgaatggcttagcaccttccttttggtgctgtcctcatgatagtgagtgagttcttgcaagatccagctgtttaaaagcatgtaacacctcccctctcactctctcttgctcctacttttgctaggcgatgtgcctgatcccccttcaccttctgccatgattagaagtttcctgaggcctccccagaagcagatgctgccatacttcctgtccagccggagaaactgtgagctaattaaacctcttttctttataaattacccagcctcaggtatttctttttcttttcttttctttctttctttttttttttttttagatggagtttcgccctgtcatccaggctgcagtggagtgcaacggtgtgatctcggctcaccacaacctccacctcctggattcaagtgattttcctgcctcagcctcccaagtagctgggattacaggcatgcaccaccatgcctggctaattttgtatttttagtagagacagggtttttccacgttggtcaggctggtctcgaactcccaacctcagctgttctgtccacctaggcctcccaaagtgctgggatgacaggcatggaccaccatgccaggctagcctcatgtatttctttacagtaagaacagcctaatacatttatagaggtatgacaaaaacctaatagctttatatcagttttgtgggttgcagcttatttttttgtcccttccttttatatttctggactatgtaaatgtatttttatctgcagacacattaagtaagaaatacattggctgggcgcggtggctcatgcctgtaatctcagcactttgggaggccaaggcgggtggatcacaaggtcaggagatcgagaccatcctgggtaacatggggaaacactgtctctactaaaaatacaaaaaaaaaaaaaaaattagccgggcgtggtggcgggcgcctgtagtcccagctcctagggacgctgaggcaggagaatggcatgaacctgggaggcgcagcttgcagtgagccgagatcgcgccactgcactctagcctgggcgacagagcgagactccgtctcaaaaaaaagaaaaaaaaaaaaagacgttgtcactgtttatttttaaaagtttgtgtctgtattcttttgccagggctgccataacaacacaccacagaacaacagaaatggattttctcacagtcctggaggccggaagtcccaccgcaggtgtcggcggggctggttctgcctgaccctatctcctttgtgtgtagacatcatcttcttgctgtgtccctgcatggtcgcccctctgtgcacctctgtctctgcaggctaacttcctctttgtatgaggacaccagccacattggattagggttcaccctaatgactaactccatcacctctgtaaagaaagaccctgtctccaaatacagtcccattctaaggtactggcagttaggactctaacgtactttttttgaggggactcaattcaacccatgacaccaagtagcaggcagaacctgcagactttctatctctggtgccactgcccagtcacaggactctgtggctctgctatgccggagatgctccgattgctggaagatattcccataactgctctcactatttttaaaagttgaagactgcaccaccgctggcctaatttcaagctgtttcctcccagcaacactgtttatgttagaaacctcatgaaagaaaggattggtgagatggttgagccaaattcatttctccataaattcatattgatgacaactgtggcccaggctttgcgcaaaatgctggggattcgaaggtacagcagaatctctgccttttctttaagaagtgtgttgtctcatatgggtatatgattttttagattgagggtacatgtgcattttgctacctggatatactacataatgaaggagactgggcttctggcatactcatcacctgagtagcgaacattgtatccaacaggcaaccctcacccctgctcaccgtccttccttcctccctgtttttggagtcctaagtgcacttctttccatcctatatccatgtgtgcccaggtatgtgtgttaaacccatgctcattaggtgcctgcacgtctggtatgtatttgaaagcagagactccggacttcctggagcctgccaaatcagaatcgtgcagggctgggagtcaggaatgcattttttaaactttgcaaggtgagaaccattggtcatggaggactaaacagctgcacaaataggaaatcaaagtaagaaatgccaagacatggacaaaaggccacagtgggtgcctaggtccccccaagacacagcagactgcctggggactgagccctgaaatgagaagatgagaagcaactccacacctcaacaacagtgcatcaaaggtgggaaaacaggcaaagcacacactgtctgcatcgatgtggtctacatggacataaacacctgccttccagcctcagagcaaagcactcattctccctgtgatggtctctgggcagaagcctcatcctggctggcaggtccagccacctccagaacgtagtagtcacttcctttgaattgtttgcttatttttcctgtctcagctatctctaccttaagaattttggaaagccaacttccccagtagcctgaggcttatgcctgcatgcccatcggggccttacccactgcagccccgaccccggcttgcctacacattttcccccagagctgctcttctttctgccagggactgacattttcaaactgtcactttcacaggtagaggctgccgctgtgcctcttcaatgaaagaccataacctatccttcagtgtcagctggtatcttaaactgcacacagggcatttcactgtctttactcctctttgccttttactgatttaggagctgtcattttcaaagttcctcctgctgaagtggaaagttctgggctgactttttcatctccacttccatttgcctccgtttcctttatcctcacacgatccctttgtttgctttgtgaaatattttgagtattccatgtcaggtttatttctcaacgcgaagcacattaaactccattatagcatttttaaaatgtgtgagatatatagttgatctctattagccactcttatgcataggacccttgattcttttataaaatattattactttgcatattttgtacagttccttgtgcagaaaggtcaaggtcttcatatcactactactattatacaaaattaccctttttgaacacttccactgactacaatactgcttttattattagccacatttcacacagttagaataggtgaagttttgggatgctcgatgtgtgctaagcatggacagaggaaatgcgttatttaatttaatgaataaacatgctggattttagcacatggtagagcaaaattacatgtcttcagtaaaatgcctgacatataatttgcaaactgcagaaagtaactgatattgacggcgttggactctgcgtttcagtctgatcttggaagattaatttgatcctgggttggcagactatggcctgtgggtcgaaaccagcctgcagcctgtttttatacacaagctaaaaatggcttttacatcgtttttaattgtgaaaaacttaaagacaaagaatatgccactgagactgcatatgatccccaaagactgaaggtctacgtggccctttacaggaaaagagagccagtgtctgatttcagctaccatgaacaagaagggaagtatgttaccagcttagttacctaaacactgctgccttgacattcaacaacattctgcttgacagccaaccaataggtttgcaccaaaaacactcctgggtgcagacatgtctgactgcatgcgagttccttttttgttgggctcctgttcttagctggcagtatgataaaggtttcatgccaacatttgcgtttagtccttcaaaacgggggggagcacctttatgcccatttgcagataaagaacttcagtgaagtcacttgccctgtccagggtcacagagccagcaaatgctggggatgggaggaatccatcactcaattgcgggagcctgactgcaactgcactgcacagtactgtacccaagcactcctttcaaatcccctaagattgtgtgaggtagatttaagcaagggcaactgggataaacctcattttacaatatacttgatgggagttggccagtttgagctatatggactgtgtggattcacattctgataatttacaatctggctgacataatgcctacaacctatataaaagtgtgtgtctatatataaagagagacacaagcatactcacacatacatatcatagcatgtgatttgacatttaaaatcccagaagttcctatttaaatgtaagtttctaatgaaatctaaatgtctggaaatattgtattaatatcacaaaacagaggagaagattgataatgaaatagaagcaaatagatatgcatataaaaaaatcaagataaaagtctcaaatacctatgctctttatgttcataagtgaaggattttaagatttacaaaatatctcagttaattcatttatgccaggtctcctaacatatcctcctaacatttgagaatgatgttgttttaaaaattttgtataaagtaaaaggacagtttcctctgaaagatgccctctctgtgggcaaacatcatgtttcgggggtgaatgcagggtataatggaaatggcttcgattttggaatctgaaagactggagcttaaatcccacctgagataatgaggcattttttttttctggtaacatcatctgtgagcaacagcatctatgacgattgaagagatacacacagacatatccacgtgcatcctctgtcccctccacccagctctttgcaccagttccgtccttggccatgctatgtagaagcagaatataggcagctatctctatctaaaaggcctgactttaaaaacagaagcttaatcatgtaatttgtgagaaagactgttttttgtactctttgttgcctgcaaaatgctagcaaatcataaataaacaatagacaaactccactccaagcaaaagccacagctgatagaaggctctgagaaccagaccttgaaagtaaatagctgcctgggagttgctctctctttgaccagggaacttgaaagcagtgcactctgatgtgccagtttaactggatctttgagataatacagagaatttcagttctaattcaggcttctcctcaagatgaataagattagtgtgctgataatggaaacagctgcttggcagagtttcttgctttaaggcaggaaatgaagcctgaggacagaagatctgcctggctttatcaaggtcgataagaaccaacagagattttcagagagaaataatttaaaaggtcaagcaaagtgagaaaaacaacctggagttccctgaaaccaataaaatacattttgccggctccatcttctcactcacagacaattggtagcgaaacttttatttgctgaatccagaagctaattgcgagccatcaaggggtcttgggaagatctctgtccgggttgtggcctggggcctgccactttgaaccccacaattcgggatgggtttggagtgggtgcctcccaaatccccttcaagacctaacaatcataattggcatgcatgtaatatctgacggcttatcctatattatttattgaatcctctcaataattctgggacgtagatatcaaaatctctattttacatggcagaaagtaggcttagggagatcagggctccctggccttttgggggctactttggagggggatggccctcacaatgtatcctccaatttcaaatccgagtaatttttctctaaaaatatgatgcgtctacaatgtcattggcaaaaaaaagtgaattaaaatagaagacaacaaaagccaattctaaataatctttaaaaggaaaaatattctcccatatttatcttagaaagtgatggattagtgattttataaatttaaaatgtttaccaaatggctacaaggggcagggtattttgcccgggtccgagggacacagtggcatccacatggtttataagattggtagctggagggcctaaaagagaatgagctcaacgtgccaggtttgatcttgctcatttactaaaaggtacctgttgcattttagtaactatttgaatatattcttctagatatttttgtaaaggagaagaacgaatgtcctttatgcattcaggaagtttataaattgtatttattttatgtaagaataaacggactgcttttcaaatcattgagaaaaaaatagaatgtcaactcaaggatgaatgtaatattaaaatagatcaatatagattttaagttcccaatgccacaaagagatatttgctattttttaaaattatttttctttttttacagttttcaaataaaaattttcaaataaaataattaaataactatgatgacctttaagttggacgtggaagtcttaaaatattttaacatttgcattagtaattacattcccaattatctcaatgaccttctctatgatttattgcaggatttataaccacttttgaccaaatgtgagatactgtcagagtctaaactgttatttattttgtggtagagctgcctagtttgaaatttattacagcagatagtctttctttaattacaattttattcatttcgattggtccttataaaagttacaaagtcaaatatgataaagcaaatgaagcatccagtatcttaaactaatttaaaatccactgcctcattactggtaatttttaaaactccatcttttcttagcctcagagtcactactggggacagcttgccccgtggacctgaagcacaaatgtcaaaatcaatttcatgaagcttcctttccctcacatggtccttatttcactgagtggcaccaaatactcccagcaatcatgtcccccaccaacatatgtcatcccagatttatctcttcctttttacctgctttcacgagagactgtggactctgtttcctaagtattttcaatacctgttttcatgcaaaacttgtttctcactgtatttctggaagtcttcatatccctcaaacacacattgctataacccactaagaattcgtgtcttccagacaggatgcgtgccaatcattcattatgccacggaaagatcaagctttctaaaacacagatgggattgtatctcttttgctctttaacggagtctcgtcaagcaaggacaaaagctgaaagccacgtaaacttgcagctgagatttcctatgggctgctcctgccagcttctccaacccatcgtcctccaccatgtccccttcacattccagctcagacatcccaatatcctggaccttctctgctactcccgccggatgactatccattcctgctgactatcatattgacttgtacttatcagtttttaagactctctccctccggactagcagagccataagagctgggaatattttttattcaccttggtacccgcctgcagtgcgtaactcagagctaagtctgaattgaaaagaaaacagccataacttccttaatacttgtatgaggcttcagacccacagcaacaaccttaatgtacaaaaacagacacatagttaacatcgctttgcctgtactcttgaatacaaaaagaaacatgtcaagaaattatacaaaagataccctctccataaacatagcccttgtatctacttttattttggacagtgtgcttgaagcctagaagcctcagaggtaaaacctgtaactctatccctacagatgtgctatgtggagattctcatgtcccagctttatatcgaatgtgaacatctgcgggaaaaataaaatcatgaaaacttctgtgctgatttgggtggcgaagacgtggtgatgtgttaatttagctggggtttttgaaaattgtttttcccacgtggagttctaaacattttaaagaaagagctcacctagtcttctgtttcatatttcatttttcttttcttttatttatttttatttcataattatgaattgtcagcaattcaggatcacataaacggtgacgattcttccttatatattaactctctttaaacaaaaatgctagtttttttaaaaagacagaacatgtcttcaattttcttagaactgaaaataaaattctctaagtgtcatatatctctgcttgtaaattaaaattactaattaagattccaagaaccaaatagaaaatagggttcccttaatattttatttttaacaccagaggaaaagagcaacacatcgttgataatcagagtgctttcttctttttaaagtatttcagcctcaaaataacttttcgaatctataattttttttaatttttctgattatatatatttttgaggcagtcatcaaagggtcctatttgcacatcagtaaggaagtcgcttaatctgttatacacagccaaatgtgcaactctatattccaggtcatgctctccatccacggtgacagttaccataatttttatatatatatatatatatatatatatatatatatatattttttttttttttttttttttttttttttttggtctcattctgtctcccaggctggagtgcagtgccgtgatctcggctcactgcagcctctgcctcctgcctgggctcaagtcatccctccatctcagcctcccaagcagctgggactacaggtgcacaccaccacatctggctaatgtttgtatttcctgtagagacagggtttcaccatgttgcccaggctggcctgaactcctgtgttcaagcaatccacccacccaccttggcctcccaaagatgcttggaatacaggtgtcagccactgcacccagcctacattctatttttcgttattacactgtgaatcccttggaaggaaacaaatctttttgttgttgttgttgtcatttctccttgggtcagtacacacaactgctcaacatatctgtgagtggatgggagaaggtttctagcataatccacaacacaccatatgcaatttgccaaagaaaagcagctgaaaacccacaaagtctctttctgtcatatgaggccaaagtgtttctacaacttagggaagtatatacagcgtgtaaaagatctacattctagagctgggcagggtggctcatgcctgtaatcccagcactttgggaggctgaggcaggaggatcacctgaggtcaggagtttgagaccagcccgagcaacatggtgaaactccatctctactaaatacaaaaaattagccggctatggtggtgggtgcctgtaatcccagttacttgggaggctgaggcaggagaattacttgaacctgggaggcagaagttgccgtgagccgagatcacatccattgtactctaccctgggcaacaaaagcaaaactccgtctcaaaaaaaaaaaaaaaaaaatctacattctaaaagtaacaaaaggaaagtgtgtaattaatactaaacaaataaaatctctctttgttgcacactacaaaaatcacacatttatattttatatttaatatagctaaatcacctttaacaattctttaagcataagcaaaaactgttggggcataaattgccaatatatgttgtacaaccttatgctatttaaaacttttataattccttcccaatggcctttatccagataatcatttttactcttcattttaaaggtttaattttgtctttaaaatgataaaaatgctgatttaattgtaccacacaactttaatgttcaaaaatcctactttttgctacattttgttttgttttaagcattataatctatatatataatgaaaataattttatattataattaaaatgctattttacacaaattgtaaatatctaaaaggtgactaaaagaagtcttgcacaggaaatgaatttaagtgcttaaaatatagattctttcagaattagtatttgcgagattctattttaagtataatttcttctggcaaggaaaattccactttaacaatggtcaggctcacagaaagactgaattctagatcaacatttttatgattatgaagtcccttaacttttatgtgtttcagtttcaaatacataaaaataagtagttcaactggattgtttttaagatccctccaagtttaaaggtcaaaatgcatgaagaaaaaaacaaaaccatattgactcccaggttaacagaaaggttaacaggaagtgtagaaagtcacagatctgttttagaaaaatgatacttcttaaatattttataatttgagaacaaagtcgtgtaagttatttattgccaagaataaatctgaaggaaggtagtctaactcttcttccaaaacatggtgtgcattctagcatcccatatacacaaagccattgcctctctgccatgttccacacaaagaagagataccctgatcatgttcccacagattccttggccacagctgtaaagatgtcagaagagcctcatttgcagtgtgcactatttgtatttctgaatcatttaacttagcattaaatagttctgctggggtgtggggaggccatgggagaagaaagaagtcaagacttatcccaaacctatatatgtgacatcctttaatccttctcaaccattcactgaaagggtaagccatgtctccacctcataatccgtttccagaactccttgcatatccatcagaaagatggactagcatgtgcctggcatcacccgaatccctttgggacatgaaggtccctctccggacccctttgtgcttaggcctggagagcacactctctttaggctctattttgactccacctctagaggacaggaaatgacttcaggagtttctgcccattccaccgaatccctttcctgtgtccaggctgccgtttgggctgtggttctgtcattagccagtgctagtggggcacagaccatggcgtgttctctgagctgaagttgggtctcttcagcaacagattctacgactctgttctataaacagagtcatagaacatttaaagcaaatgagaaatatatcttcttctaaaagaaaaagtattcttgtaaagaaaaaaaaattatcattctaatcattcctaatgaagtaagctgcttgagtctatctctatgtttattttacattaaatacgaatttttagaggtaaaacataaataatacagtagaggtaaaacataaataatacaggctgtctgatcaacttcttacagtcaaaggcacctacaataactgtgataagtatctattactgtctcacaaagcaataccagaaaatctaatatctaatgaaactgacaaaaaagagagcctatatgagctttcactcataaatcataattagctttcaaagactaatataattcattatgaatataaaccttgataagataaaactatgaaaatttcatgacttcaaagccttcaattaaaattaaaatgtgttatttgaaaacctgatttttatgcacatgatagataaaatgccaaaaaaaaggcatgaaatactgaaatcaactttaacaagctctagatttaaataacaaaacaaaatcaaatacagagcttagggctcaaagaatgagtttttaaactaaaataaagaaaatgagttttccagaaattaatgtttttaaattaatacaatggtaaagaaaaattattttgaatcttaaattggatgacatgttttttacttcaagaggaagtacaactgttagaataacttgacccaggatctagtgaatgtccaacccttctccaaattcaggctatacaactacatgtcaggaaagtttgcatggccactagaaggtttaattcgtactgttataagccaacattcaatttttccttaccttttattcttagttagtgcttcatttattttcagagagtgattaaaatgagagcaatacacaggaaacaaggctggggatgaaaacgcatttcttaccctggcagagtggcgtgagggagtcccactggtacatgccaagtgggtttcgtctacaggttgcattgctgtggccgaccattcggtatccaggcttgcaaaaataatgcactttgcttccaaccgctcctgcagtcctgtttagaatacccccattcttcagggggtgggtcaaactgcagtaaggtgctgtgggcagacagacacacacagaaataagtcaacaagcaaacaaatggccagtgccattgcctttgtgagagtctataaatgaatggcttctcatttccaaaaggtaggaaatgagcaccagtatgtaagtttgttctaaagagcattccaaaacttgagagtctaagaggcaagtctcttactctgaagttgagatgatctgcagctctgagtcaatgtgaagctaggatcctgaatacagtactgtgagaaacatcaagagtatccaatctttaggcttccctgggacacactggaagaagaattgtcttgggccacacataaaacacactaacactaatgatagctaaggagctataaaagaaactgcagaaaaatcttataatgttttaagaaagtttacaaatctgtgttgggcagcattcaaagtcatcctgcgctgtatgcagcccacaggctgcaggttgacttggtctagagggatcattttgaatgacctcactcacctctctaaagcagcttactgacttaaataagcacatctgtcaccaggataaaagtgatagggtactgcacaagacatcatatttgaaacaaaaatattctgcgtgttttttaagtgttgttaaaacagagaaagtagaaatatataacattttcttaatcaaggccattaatttctttccttttgactgttcagtgaaacttctggactgtacaatgatgtagatattaaccttcttttttagcatatgggatttgaatgaaatctttgaagaaaatgcattctcttgagtcaattacaatctcacaatagctttaatcatccctctttgtaaggagacattttaaaactagagatgggcatttgttaaaataataattttacccacacagaatgtcatatttatggctaaaagtctctgcatcttatttacacgtttagacaaagaaacttgcttcatctgcacaaggctaggtcactactgcataaggcgaggtcactactacacaaaatcctaggaactcacttcagatgaatttaaacaatacaacagagaaggtccttaagaactgggaattctcagtttctttttaaagaattttagatcttccacttccctctggggcttccatataaaagcacacacacgcaggtctgaatgcttaacattgctcctttccttggaaatacattcagaagaaaccttctgaaggttttctatcatagtggtgcccagaagcaacatctatgtgtctggcctcagttgtcaaccatgttcctacgagaagtgtcctcagaaaatattctcagctgggtgagcctctgaagtaccatttccttttttttaatgggctgatttttcttaactgaaaatccactaccataagaatctcttgattcacagctccattggccacaccatgttctacctccagttatttctagaccaaattcttctaagttttgaatgaaccaaaatacttagtttagacaaagtatgagtacaatcaggcaccctgaatatcaatggcttggaatcactgtgctagtaaaaaaaaaaaaaaaaaaaagttaataaaaaatagaaggaacaatcagactgtagattcctctccaaagtcatagataagttaaataaagtttgcaggaagtgagaccatgaggctctaactctacagattccaataaggctccgttttcttttactgtgtttcttctctcaccagcccctcaacatacctcttctttcctaactcacttaggataagacatgaagggccctacaggggaaaccatagcacagaatacaaagagagactggagcaggggccctgccagcccaactcctgctgcaggaagaggaattcagaggagcagggcctggtccttccactctgctggtgcagcctcggaaaagctgggatatagaatgaaaagtctaatgggtacccaggtgagagaagactgggacaggtggatattctggaatttcggtgtgaatgccaaaccagtctgtactttcaacccgcccaatacagaagctttcatttgcttctcatagtatgaaaaggacattgttaattcagcctgcgcttagcacagtttacggaattgtccagaaccactgttcgcaggcatttctttgtcgtttttaactcggatttccaattatgatgattcattatattgcttttatgcctgaatgatcaagagtttacgtgcatagggcaaatacatgttggggatgcaacgtgtggtcatgtgacaatatcatgggctagagttcccttggccacatgttaatattttagggacactttcatttaatcaatgctcaaaaattactgatgctgacctagcagagatcactgagtcatcaattctaagtaaaaagctgtgagatagataaagaattttttatattcacatatgacacgtgtctatctatctgcctctctttctctctctctctccacttaaacaacataaaattgtgtattcttcttctcccaatacagtttaacaatgaggctctccttgtggtatgacaacaaataaaataccttttgaaagacgtagaaatcattgttctcacaattgaggatataatcatatcaccaggctactaagaatttctctgcaggtaaaacaagataaattatgttcatcatgattttctctgagctgaccatgtttccacattggaaaaattcaaacacctttaagagtctgactatcggccgggcgcggtggcttaacgcctgtaatcccagcactttgggaggccgaggcggccggatcacaaggtcaggagatcgtgaccatcctggctaacacggtgaaaccccgactctactaaaaaaatacaaaaaaattagccgggcgcggtggcgggcgcctgtagtcccagctactcgggaggctgaggcaggagaatggcctgaacccgggaggcggagcttgcagtgagccgagatcgcaccactgcactccagcctgggcaacagagccagactgtatttcaaaaaaaaaaaaaaaaaaaaaaaaagagtctgactatctattttttggaacaaggagtttgctgaatgcaaatcccatcattgcatcgatgtctttgcagcaaaggtctgagtatattttattaaaccttccagaggaagaatatctgaatttcttgcctgttatcctcacatcaagggcctttcaaaatcttgatgctttttaccattttatatgtctaccaaccagagtgagctaaaaccttattcttacaactgctgttttaacactgtttcctggttttccctttggacgctcgtagtccctaaagacgtaaaacaccaacacagtaataaacaatcctccgtcagcacatattgttcacttcccatacacaatgagcatctttcacgggaaaacataacttgaaagctgtcaagggcattgctgagtgagattttgagaaaagtttagattttctgcttagtaattgaaatgtgctcaggaattaagagtctgcctactgcttctgtaggaaagtttaaagaatagtgtggtcagatcctactgatgattgtatacaggatttaatgtctaataaatatattgactgatttgatcaatttgttactaattgatttagttaatataaatcactgctggcagagaatgattacagtatataaagggcaaaataatttacattttgatgaggaatatatattaaacatatatttattatgtatatggttatttgtacaaatatatatatacacatatatgtagtgtgaaacatacataaagagacctgcagatagatacaaaaacataactattaatagtaagagattatcatcacttatgcaattaatagaaatacaattatctttttctatttgtttgcttaccatttaaacatattttaaaattaattttgattatattagtttatcttttggaaaatgtctttgctttctataatatgaatttcagcagtttataattttaacaataaaattctaaatattaagcaacaaatttcctaatgtagtttagaggaatcattcagaataattacccatcatatatttctactgtagttaattattaatctttaagaattaggattatactataaatttctatttaaattgttttattcaatgaaaatcacctgttttaaaatactttcatataaaatctaaacctcatttacttacctgcatagcgaatcttgaatcctttcttactggtggcatggtcagtggaccagcggagatataactgattactcctgcttgtaaaatttgattgttcagtatgattcccacttaagactactagcagaggactttgcccagaagaacctaagtgaaacagaaaaacaaaaacattcagagatgagtgagcacctaccaaatgcatactaggtttagcttttgattacactggagtctacgtgtgcaatacacagatataattattacaaaagtggacaacaaattccaaatggctatagtgacagatatattttctgataaaaataagacaataatgtacaaaaagaatttcaggtgcatatgctattaatggtgtcatatttaaataagccttgtctataaaacagcagtacccgaaaaaaatgaaagtaatatgtattgttgttagtatttacaatattgtacttacacaggaaaatagaaactttcatgtaatactagtggaagcgtaaagtagtagaatcactttggagggctgtttggtaatatccagtaaaattgaaggtttaattatatttctatgaaccctagcacatgtacgcaagtattatttatatagtgaacatgtgtattctaacactatttctcatggcaaattttagatcaaactagtaatttggagttttaaaaaaagaattgaagattccatgaaaaagaattagattcatacagcattaaaattaacaaactagatatacacatatccacataggtaattcttaacataacagattattactaaaaatatatatttagagataaatataataggataacaattatacaaaaaataaaaaatgcaacatataacatgtgtatctgtggacgatagatacacaaataattataaaacatgcataaccatgacccatgcaactccaacttcagaatactaacttcctctaggagaggcacaagtggaattggatatgggtgaagcttctaaatttacctgtacacattgcttctttataagatgagggcctaaagtaaatttgacaaagccctgaaattcatatctagttttttcatttttcacctgtctatggtatttgaaattgttttaaaaacgttgagacaacaaagttaacattgaaagtataggtaagaaaagaaagcacagtggagagtcacccggcattgccctcatcaccataacccaaaaccatttttcaggagaaattgcttcatggcactggggcttgccaacaacgctactctgtaatgagctcagcattatctcatactcgtaaaagcgttcatggcattttgcatttcacagttcactcctagggaacacattatggactgggagaatgcagctctcattgttgttcataatacaaatgctatgaagtaaagtgacagctgtctttgttgttatacctaaaattttatttgtgcaaagatactgagaaaccatactccactcaccgtgtaactcccaatcagagcagttctcatgatttttttcaagtaagactgttatagactagactgggtccccctcaaatttacacattgaagtcctatgaagtcctaaccctctgggcttggaaatgtgactttaaagagagagagggagggtccctaaagacataactaaggttaaacgaggtagtatgggtgggtcctgatctaatataactgatgtctttctaagaaaaggagattaagacacaggcacgccctgagtgggggccacatctgcaagcctgggagggaggcttggaggagagtcccgcccttctgaccccttccgcttaaaggttcagcatccagaattgtgagaacataaatttctgttgaggctaggcatggtggctcacacctgtaatcccagcgctttgggaggtagaggcgagtggatcgcctgaggtcagaagtttgagaccagcctggccaatatggtaaaaccccatcattactaaaaatacaaaaaattagctgggcgtggcggcaggcacctgtaatcccagctactcaggaggctgaggcaggaaaattgcttgaacccaggaggtggaagttgcagtgagctgaggttgtgccattgcactccagcctgggcaacaagagcaaaattctgtctcaaaaaaaaaaaaattctgttgaagccactcaatttatggcactttgtcatggcagtcctaggaaagaaatgtgaaacaaacaaacgaacaaaaaaccacaaaccaaaactagcatattaaataatcgggcaatgctgactttggtcagagagaaggaggatgagaagaaatgatattaatagatctcactatgaaaaatgtcatggctaaatttcctgggagatgccctgcaaaagagtggctggtatttcataatcaaagacaaagcgtgtttggtatgttggtttgctttttggcgtttaaaaggataatgtatattctgagataaaatgccactggtaaattaattaacctgaatttatgatattttgaaatgtcatttttaatgacagaactcaagagtagagttttagggttttttttattttattttattttttatttttttattttttgagacagagttttgctctgccttccaggctggagtgcaatggtacaatctcggctctctgcaacctttgcctcctgggctcaaatgattctcttgcctcaggctcctgagtagctgggattacaggcgcctgccaccgcgcccagctaacttttgtattttttagcagagacggtttcaccacgctggccaggctggtctcaaactcctgacctcaggtgatccattcacctcggtctcctaaagtgctgggattacaggcgtgagccactaagcctggccagttttaggtattcttaatccagcatctgaaccctcataatgttctatctgttctctttgtctaaaatgtaactaactttctagaaggaatagtctttaaaagcacatattcaaactggcatgtgcagaaaaccagcacggcagtaaaggaaggtatccatttctgttaccaaaatggaaactaagtattccaccagtgtacactgtaattttaattttgacagtcttctcaactgagtttcataatgattaaaatactgtgttttaaaaagcattatgggatatccactacttaagccatagagagtaatatactcttgagataataaagtataaaatcaatatattcaacatgttttttggtccacctatgaactataaaagagcccgtcttacaaaaaaaaaaaaaaaaaaaagagagagagaaagagacagaaagatatgaacatgacatttactgcaacaaaaatgtcatcgcttaaaaacatattcacataaaactctgacctttcactttgtagaaaaaactttaagaccagacaatcctagtcactgatttctgataattttgacagcaagtattatgctattgtctctaacgtattttacctgttgtttataatggctatgatctgtccaaatttgcaggagatcaaattgcaagccatgagtgcataaattattgataaataatttgctcctgaaagtaagagacttaaaagcatggccagtatatttcaattcaactactgtgaaacaaaagaacatgcataagttcaaaataattaaatatacttttatgtcctttgtagggatatatatgtctatatatacacaaacacaaacacagacatacagcctgtgaggttggatgctctacattttaatttttgcataatacctaataggcctcaaatagagtttacctctcttcttcctcaacaagagaaaccccatttttatacttgcgtaatgagttacttctctctactctacagactaaagaaaaagttgtaaataatgtatgtttgttttaatatacacatttaaaaagccatgctctgaaaatgaaaatattgctctccagtcctctgcttctatatacaaaaatgtgagtttaatttccaatttattaattcatttttgaaaatacattaattgattcagtgatgtctatccatacaagcaatttgactcatcaactcagtaaagtgaatacaaacacacatcaaatccattagaataatttatttttttcactgaattgattgtaatttatctgaactcaatgacaaatctttcaaaatatgtgaaaaccctgttattatgtacagccataattgtaactggtctaattttctgggctatgacggtttcacacaaagagaaatattaacattccttccatttcaaattgacgattcaaccacatattacttttaatcatatcactgttaaaattttcattgaaattgcaaaaaaatcataagactattgttgaaaacagtattgcacgtgttcagttaaccatatttcactatttcaaagaatcacacttgaaaaactcctgtagcatttatcatctagaaatctctgtgagccatgatttttacatatttccagtaaaataattatttagatgacaaaaatacctctaggcctaagtttcctaaaatatcttgtgaattgatattacatataggagagagagaaagagttattgagatcatcttctctaaatcactgtgttaaaaaaatcaaataatggttaaagaaaatttggtacactttcagggtgtattcctaagcattctaactgtttgaaaagtgacaatgttaacaatcctatggtttggctgtgtcccctcccaaatctcttcttgaattgtaaatcccacaattcccacctatcgtgggacaaatctggtgggaggtaattgaatcatgtgggtgggtctttcccatgctgttctcctgatagtaagtcccacaagatctgatggttttaaaaatgggatttttccctgcacaagttctctctcatgtgcgtgcacccactctttctctctctctgtctctcatgcctgccgtcatccatgtaaaatgtgacttgctcctccttgccttcctccatgattgtgaggtctccccagccatctggaactgtaaatccattaaatctctttttcttcctagtcttgggtctgtctttatcagcagcatgaaaatggactaatacagtacaacaatcatatggtaatgttttacagactgcttgatctcttgagaatgcataaccccaaactagtttattttttgtttgctttgggaaaacataagttaactcaagaatatattccagtctttatgttactaaaacattgtaatagtgtttttatcaatgatgccgaggtcactgctctacaaagattaaagaaacttaccatcaaacacttccagtgcatcaaactgcttttcactttgaaatgtgtccacaaagatggtaatgttgtagtttggttccactttaatactccaagagcaagtctgggagttaaaataattacccggataccctggactgagaatgactcccgatgatccagtccggacttcatttgctgggcattgtgctggagagaaaagtaccagcaaaagtttgctttaataaaatgattccaactgcaataggatagtttctatccctgtataaacaagtcaatgaaaggaaaaagcaatcttattgagctctggccaaatttaataccgaatgcaaacacagagggagggcaacattgaataatcatgagaattgtgcatctttctctttgcagttctctacactcagcctgcacactcctttggcccctgcatctcccacacaccttaatttggggcagatgcatcctggatttcatcatacaatgcaagatttcctaactctactacaaagaagaacctcaccatttcaaaagagtattacagaaatacagtgaaatgttatgcaataagaaaagaaaactcatatttattttggctttaaatatacagtaggcccccttacccctggggatacattccaagagccctagtgatgcctgatgctgcagatggtccagaatcctacgtcgtttctggtgcaatcacatcatacagggcaatggatatactggacaaagctgggattcatgtcctgggtgagacatagcccggggatgatgacagatttcatcaggctattcagaacagtgcaaaattttaaatgtgttgttatttctggaatttttcatttaatattttcagactgtgcttgatcacaggtaactgaaattgcagaatggaaaacctcggatcgggggtggggggaactactgtacttagcatagtaatatttaaacgttcgatgtgattgctcgggaccctgggaagaggaagaattagagacctggtctcaatcccacatgggacatctcagcaggagccctgattcctaagggatgaattaattgtaaatgtatcatgaagatactatggatacatcgtatcttttctcctcttgctttttgaaaaattattattcaactacttccagtttaatcaacataaaaacaatctgcagagatctggacatgcaaagcaaaacactagagtctcctaattagtaatttctctcatcactgaattatcttccagaaacagtttgtgtataaaactattaagggaaatttttttctattactggtaatggttcaaaaataaaaaatgtatatcaaaattacttgtagagtgttaagagttctatagttaatcaccttttccttaatgaaaaagagcttttgttaaatttatttattgagttatcgccttttaattagttaaatgtgtgctatttatacatacatttcaagatagaagcttttcaaacagatgagcgaagcttatgatatgtgtttttattcaagtaactgccttttgaaaagtaatttatttcctattttcttccatttatcttagcattctaattaacatatattttaaaatttagaaaatgtttagacataagaccaccaatcataaaacatttcatagaactctttaaataacatatattttaggtgagattttaaaaatacttacaatgataaattaatggcaataatataaactaaaataatcctaatcagaacacacagattgaaacaactgagttaaaggtctaattttcttctgtgatggtgacctcatcgctttgtaaaatacacgatgcccattcaaagttaatgtgatattttaagaaagaaaaaataatgaaattagggtccgtgcctgtgtatatctgtgcaggctaggacctcaagttttagaagctccacagacccgccttgactttgcaataacaaccagggctttccttggctctgacgtgtaagtacagagtaataatagctccccctcagggttttaattagagccaatatacacaatttttttttttttaaatctaaagcactatgtgggcagaaactgttgtaaggactagggatgattacaccacatgcctaccttttcataactgttagggaccaaccgccccaaaaagcttctcggtactgccgacactccccccaaacccctctgtactgcccacctctccccttaatgccctgcaactcttctccgtgccgttcacccttcccccaagcctctttacatttctaagccttatccaagcgctgcagtgaagccagcagacttcactcatcagaccttactacaataagcaaaccgcaattacaaaccatccagaccacacagagggaggtcgtgggaagcataaataaactttacctacaccctcctgtaagttccttcatctagctactgccataaacgtcacaagataatatatggcaaagttaaccaacaaacaaccccagggtccctctcccccatataaacccctcattttgtaagctcagggctgcctcttctgtctgtggtggagcagatggcaggttcaataaacttattcacctgactttgggtctattcatccttctctaggctgaccttatactaacaaaaaaatgctaccagagggcgtttcattttgtgggattacacttgaaaaacagttagccaatctctctaccctgcatttttatgaggactgagattttataactgcagctatagttatcagttgacattggaacttcaggccatctggaagtaagaaacctttactgagttgctaaaatccacctgaaaacctattcgcacatcctggggtttgacagcagtgcaatgatctaacccagaagcagcattttaagcatagccattcttattcctttcatatttgaaatgctgattttgtttcttaggaaagacaaaatgaaaatataaacaacttgttatataattcccactagtttacagaggactctcagtttctacaattctctccaaccaaagaggtagcagataatttgtagagaatttgtaccatttttcatttgtatcatttatcatttgtatcatttttcttaaaatacttagcaatacttttttcagtcatacatattgttttcaaaattcatgtggggttttttggtgttttgaggtttggttttgttttttaacttgtttgtttgtttgagatagggtctcactctgtcacccaagccaggctggagggcagtggcaggatcacggctcactgcagccttgacctcccaggctcaaacaatcctcccacctcagctgcccgagtagctgggactacaggcgcacaccacccctcctggctaatttttgtatttttattttagaaatgttgttttgccattttgcccaggctggtctccaactcctgggctcaagcaatccttccacctcaacctccaccatgctcggcctaagaagcatttggaggtgtttacccatgagcgaaagtgatttgttttcttgtgtttcttctgctctttcatatggaaccactccttctcctcagtgttataaactgttgcttagagcaatactcagttggagtgggagagctgaaagggaccgcagtgcggtcctatagctgagatgtttatttcttagcagcaatcacacattagaaaacaactgtgtctccacttgggaatctgggaaacctctcaccataggggagcacctgtcaaaaacacacgtgaaagcttgcctctctcagacatcacctgcgcctcgagttatgatccttctgcacaatgttagtgccccagattgtttttaaagaaaaataaaatgtgaggcttaaaacccaaagcatcttattcaacgcatctcataggccttcagcaaaactaatagcagatgaggattagtactctaggattaatagcataaattgggatttatgagtaactaagattattcttaaaagcacctataggtatgacagaattggagaaggtgagccctctgtgaactagggaaaaggctgccccagagcccttgtgatgcctgctattatccagcacatatagaaggaagctggagctgggcagcggcggtttttatgtcgcctccatctgctgctttcgaatgatcattatcagaaggtcactgaatctccttaatgttcactgaatacgtatggtgttttttttttttttttctaaagaaatgaatattctaaaaactattgaaggatcccccaaggtccacaggatgaagaaacctgacgttgaagacctttaaagtcaggtcctagtctagctttccagcctgatttaatttaccacctcttcccccaaaacaccctgagagcaagcagtaggaagccatctcctcctttttcctcaacgccacaccctcctttgtgtttccaaacctttgttattaattctcttcactttttgaaatgcctctctttccttaacaggagaaaagccacttctgtgatgtctcttactcaggtttttctacattaagatgagtgtctagcacagtaatatctccatataaggctgactactttttttttgagacggagtctcgctctgacgcccaggctggagtgcaatgacacgatctcagctcactgcaagctccacctccggggttcacaccattctcctgcctcagcctccggagtagctgggactacaggggcccacaaccatgcctggctaatttttttttgtatttttagtagagataggttttcaccatgttacccaggatggtctcgatctcctgaccttgtgatccgctcccctcagcctcccaaagtaataggattataggcatgagccaccgcatccgaccaatcctgactttcaaagaacaatgcactctccttgtttccctaaaattggtgataattttgtttctttctttttctttttttttttttttttttttagacagagtcttgctctgtcgctcaggctggagtgcagtgacgtgatctcagctcactgcaacctccacatgcggggttcaagcaattctccagcctcagcctccagagcagctgggattacagatgtctgccaccacatctggctaatttttgtatttttagtagagacagcgtttcaccatgttggccaggctggtgtcgaactcctgacctcaggtgatcctcccacctcggcctccaaaagtgctgggatggtgataagtttcaaagcacaacttctaaaagtgtggttatgacatttgaagaagacagactaatagctaacgtaatttttctgaagaatttattgggagatgggcccccacttgagcacaatcgaatcaatcaaatagtagaaaagtacttaaagaaagatgataattaagtgattcagtgattaaggatttggtaaaagacatctagggtcttatttcctgtttgttttcaaatgatgagttgtttagagaatgacagctaagatcactctccggttgttttaaacaaattgactcgtgacttgaaagagaagagaactaggttatcctgttcgcctcctgaggtgtggagtggggcttgggaaacttcagcgtgagtaaaagtcggcaaattttgtctgcagaatgctccctgtaactgtctgtgacaaatgaggaaatttagagaataacgctcatgttgtgttgatttagacatgtgccacttaaagatggggacaggctgggagaaatgcatctttaggggatcatgtcatcatgcaaagataacagcatgcacttctgagggaggccactctcaccaatgcaggcctccataacaactgtttccatactaacggagtgtttcagttacatattaaaagctgaaagagccagcgcctttatacaaagcctggaacggagtgtttccgttaaatattaaaagctgtaagagccagcgcctttatacaaagcctggaaggtaacaaagagttttccctaggcttctcctgggccttgaagcatgacaagataacaaaagaattcttaacaggaggacccttttagaattcaacgagttttattagcggtctgaagaaactccccaggcctccacaaacaagtttattggggtctaaaggagctccccaaacctttgtgatttagcgggagacaaaacaagactaatcaccccagcacctggacccatttagattcagtaaacttactgaggctccagaggaaggtcttcagcactcagaccttagctgtagattttaaaaagttaatcacttatgtctttaaataaatacacacttacacatagacatatagctaaggaggtacataagctctaaaaaactttgtaattttgagttggtctggcgataatttccaggccttctccctgtaaccagttatagaaataaaaactctcttcctcctcagtttatctgcatctcgttattgggacatgaaaaatagcagccccaccttcagtttggtccaggaacacttaaacacacccagatggtacagcctgctacacaattaagccatatggtgtagcctattgctcccaaaccacacacctgcacagtatgagactgtactgaagactgtaggcaactggaacacaagggtaagcattctcacatctgaactcatctcaacattgaaaaggtaatgcgtggccccgtagtactgcaactgctagacgtcactcggtggtaggaattttcagcttcattataatcttacaggaccacatttatctacacggtctgtcacggttcaaaacgtcatgcagtgcgtgattattctctgctcttggcttgtcatgaattaaacgtcatttaaataagaacttggttcatctggagaggacaccctaatcaaattccttttttttttaaaaaaaaaaaatgatgtagttttgctcttgttgcccaggctggagtgcaatggcacaatcttggctcactgcaacctctgcctcccaggttccagtgattctcctgcctcagcctcccaagtagctgggattacaggcacgtgccaccacacgcagctaattttgtattttcagtagacacggggtttcttcatgttggtcacggtggtcttgaactcctaacctcaggtgatctgcccacctcggcctcccaaagttctgggattacaggcatgagccactgtccctgaccaaaattccctgtttttagagcagcacatttgatacatacgtatgcctttcttctcttctcagctaagatcacctttagttaaagtcttctattctgagaaacttgaggctttgtttgttgggattaaaatgtaccttaaaaatgtgaaggtttgcctgggttcatttccatatagaatggcagaagatgaacactttttatatccccccaccttgaggaaagaatccataaatagaccattgttgctcctggaagatggcacagacgttggctttcttctaagaagacagtgacttggatctcctgactttgcacccaatgcaatccccacttctaagtaaggcaacctagaggcacagattttgatgacttccacagcctacggtctgcttagcgtttaaacagacgagcaggccaagggtctggccctctgctcaggtagcggtttcctgtaatcaatagttctcatgtagatacaacttcaatgttaatattttttcaaaaaaaaaatctaagttattatggatatctgataataattcattccaaaatgtatgccaatttttcttcagatgtagaagactgtttctctctttcagggtgcctggaatcctgcctcattccagaatgagaatgcacaaagttatcagacttttttttttcttttctttttttttttttttgagacagagttttgctgtgtctcccaggctggagagcaatggcaagatctcggctcactgcaacctccacctcctgggttcaagcaattctcctgactcagccacctgagtagctggcattacaggcatgcgccaccacgcccagttaattttgtattttcagtagagacaggtttctccctgttggtcaggctggtctcgacctcccagcctcaggtgatccacccacctcggcctcacagaatgctgggattacaggcgtgcgccaccgcgcccggccagttatcagacctttgaagaggatccatgcacaggtgtgagcatctgcaaaaccactgcgaagtcgatacttttgcaaagaaaacttccatttacagggaaggcagttaacattataaaacactcaaaaagataaattcatttaatactcggtgagtctttacaacaatctcaaaaataaagcggataaatcatcctctgtgtgcacagtgcagggaagagtgacttgctcaaagctgcctgatggggtgactctggctccgggtcctgtcttcctaaatcgtgggcccttatagctgtgtcactcaccctaaggaatgacaatagttggattccttgaaagagccacaatgctcaaaagcactacatctgcacttcactatgattttgaagtcataaaaactattctaattaggaaagcttttggataggtgaactaatgatgtttcgacttacttgagcatttgagcttatgtaaagtttttcaagcctttttcattcaatgatacttgaaagtggtgtctattaatattttaaaagtaatctacttgtcttctaatagattaaatcaacagattcagcctcagtatcttgttctattattgtatattgtctatactcttgcacatggtctacatatgttaaacatatgtgagaaaaacttgagatgtgcatgtttcattttttataaatttacatcaaaatattaaacaccagctaattatatgcatgctgaggtatttatagcaaaacgaaatgatattcaaaatttgccttgaaatgcatcaaaaatatagcgtagcttaataaatggctagaaagataacagataggcatgtgataaaggaaatactttgtaagttttcatagcggaagctaggtggtatatattcaggtgttacattattcaggtattaaaattatttcaactttgccatgtttgaacatttacatgataaattgctgtgagaaacatgatttcttatttgatatggccttggtttattttctaggactagataaaagaaaaagcatcattagatatttctgttagcatgttagtttcattgcaatgggatcagagcacagattaagtgcaggctgggtacagtggctcatgcctgcaatcctagcaatctgggaagctgaggcaggtagatagctcgagtccagaagttcaagaccagcctgggtaacatgttgaaaacccatttctacaaaaaaaaaaaaaaaaatccaaaaattagccaggcatggtggtgcatgcatgtagtcccagttactcaggaggctgaggcaggaggatcacctgagaccagggaggttgaggctgtggtgagccatgattgcaccactgtactcccacctgggtgacagagtaagaccctatctccaagataaataaataaataataaacaaataaataagttcacatctatacaaagaaatgcagaccaatacaaacaatacaattttccatgttgaataagtttatgtagttttagtatcgaacagtgcataccttcacatgttgggagagaaccctcaaactgcaactgggaactgagcttgcaagtcagaatgtcggtccccaccaaggtgtacccggggtggcactggtacttcacaaaatctcctagaagagtcaatgcaacaaaccaggaaattgtgtgtgaccttctgagtgtgtgaaggtgtgacacatgtaggactacttaaatgaattaaatcaacttgcaaatctttttagaaactatgtctgtatttatttttagtcttttaaaaataataccgttttaagttcttaatttataaaaatgctctattaagcttagccgatattagtactgaaatgatgtggcagcttttcttccttgactgaggcatccgtgttggtttcccttccccagtgattgctgacgaaaagaaaaaaaaagtaaagtagaagctatggtttaagcaagactgtaaaatcaaatggctttacagcatccacagagactcatctctgaccttggtacttagcacaatgttccaattaactaagccagggtgaggacagcagaaattgggtcacgtagtttgaccagtggtctgaaacacagggcagagttttataactggggctgaaaaatcctgggttgcaataactataccataaacatatgccatcactgctttctcagtatgaccagaagagtattgaataaattagatcattaatgtaaaaagatacagcagaaatcctaaatatcatcactaaatattttctcttattatatcccagtttcaatgaaatgtcactgttatgtaatcatcctttcagccgcaaatgattcagatttttctcaagtgcatgaatgtgtccccctaactgaaagcaaatatctgcccaagtctgtctctgaatactttattaaaaactatgaactaccaaatgttgtagaggaaaaaaatgttcaaactgacatcaaaattcaaatggcaaaacaaaaaaaaatcatggtaatgaagagggacagacattttctatttgatacatgacctccgtataagttctcagcaatactttaaggatagtttgttctttgtttctgtttttgtttctctgacaaattactcattaacttgtctgagtaatgattacaatgagaagtgggtgtaaaaaaatgtcgtgctgaattcatggtattgtaatgaagaaagtattacctatttcgaaatcatcatcctcagtaagcatttctgcctgtggaaccgctgggggaggttgacatttcttgagctgaaatgctaaatgattaatggaaagaataataataattgcaattacacttgctgaataaacacaactattacaaaacattcatcttgcagttgttataatgcttaagtacacggactgaaatgtctctattcctgaatcatagctttataaaattcccaagcttcaaatgttcatattattatttagtgccaaaaaacagttaaagcccaaggaaaaaagtgtacaattattttttaaagtataccatttaaataaacacactttacagatgtttggaattctgcaagaatgactcaacagtcacaacctggctccctgtccatgtgcagatttgataacgtctgccctgtcccgtgtcctgaggaattctgtaggtggcagtgttcgtgagagataagcgattgattgacagatgttctacatatcgtttagagtgcattcccaggattattggaggtttgctttcacaccatttatagttacatgacatttgctataacaccttatcttgagacagggatgagtaaatctataaaaggtaccaaatctctttcaatggtcttcatcttagagtttcacttaggatacatgtatcttggaataaatccaagctggatacgatgtgaaataataaagacatcattaaacaaaaaaaggaccacaggaaacgctggcctccagtgcaaaagaatcatacacgccctcggctgaatcaagaaacttcagctggaaacaaggcgtgggacaacactgcaggaaacaccacatggaattctcagtcttaactaacggagtgaaaatcaactgaccgtggaaattgaggacaaagaagcctccatttgaaaagtcgctgtggaacttgagcaggacttggttggtggagctatacgccgtttcgagggctgtgttgccactgaaaactcccagctggggtgagttctgatcgggaccgtccctaggaaagacagaaagaggtggctggctaaggatatttacttctgagtgagatttatggaaactttggctaatgaattaatttttttaataaaagcaataaaacatatgcattctcaggatactgtgtttgtaaacatcaagatgttgaatgtccacaaagttgaggaaccctccagtctctgtctttcattaatgttccacaggcactcggcacttgtcaaatgtcaacactcaccggtgctggtggctcatgcctgtcatcccagcactttgggaggccaaggcaggcagatcacctgaggtcaggagtttgagaccagcctggccaacatggtgaaaccctgtctctactaaaattacaaaaattagctgggcctggtggcacgcacttgtagtcccagctactcggcaggctaaggcaggagaattgcttgaacccaggaggcgctggttccagtgagccaagatcgcgccactgcactccagctgtgcgacagggcaagactctgtctcaaaaagaaataaattaaaaaaataaaataaaaatgtcaacacctgtgagattttccattctaaatatggagcttaatctatggggcatggccaaccacagaatgctgttttgttttggttttaaaacggcagtttcattgtggtcaacctaatatttcaaattctgtttctcctcactctcacatccactgactctggtcgttgtcatcttagatgtctgatttacttccacaacctcaaagccagtctcctttcttgccctctgctactttatttcccacaaaatgagcccgtcattctgcagcccatatctggccttggagctctgcctgtcagagcccaggtgcatcctcactgccccaagaacaaagcccaaggccttcacatgcatttccaggtcctgccttacttgccctggctgctggcttctgctcctgctccccctgtgggctccaacaagagtgcagccacaccacacacaacacgcacacacacacacaacatacacaacacacacacagacaccacacacacaaacacacacgtaagccacacagacatacacaagccacacacaccacacagacacacccacagagacacacatcacacacccatacccaacccaacccacacccacaaacacacatccaatacatacacacacagatgcagacacacagacataattctgcctatttctaccatgtagcaaaacccacatgtactatgtgaaattgattccctatatctctggatttcgttggtgaatttcttctctagtatctaagaagtttattctaaatatgtgccttgtatataagtggcatatgtatgctaagtcagaattgttgatcacaattacagatattttgacttgagaggttctcataccaaacagcaatgtaatcgttgacagcttccgtctgtaacagggtgaagttgatgtaaactccgtgccctggaggcaccgtgatgagccaaatgcagtccttcaggatcggatactcatcaggaaagccaggggagtagatggtgccgttctgagaagttacgttgtacccacaaggggctgcaaaggaaaccaagaaaaaacaagcgccatacagctgattttagagagtagaaagctaaatatttgactccaaagtaccttagccaacatttttcctgatgggaaataggtgtgaaatatttctgaatcaccattttgtcaaaattactgccctaaaatctgaagaccttagaagaattatacgtctaagctaaattatctcagttttatttaatatattctccatatcttcaaaatccctttaggataaatttattcttctatgcctcaaataaaatccttagttaacacttgtgacctgctgataacccatctgagtgtccagcacaatgaattatggggaaagtattcataaatatgtaactgctttttctaactcacactgctagaccctatttataagccatctgaaagagtgtcatctaagtctacttgccttaaaacaaagacattatcaattctttacagatctatacctgaagaagtaagataatgcaatgtaagattatgtaagtggtgttttgcggaagcatttccagtttttactagtgttcaatgacttgaagaactaaaacaatacccaatttattttcatttttgttaagaaatttatatttattattttaatggcaattattttatttatggaaaatgacatgtccaaacactaatggaataacctgaaatatagtctttaatttaaatattcatatagtgcatcaaagtcataaaactttgaactctgaaatcaaaccaacagctaagaggtgtgagatgagtgttcacaactctcttgaacctcgaagggctgtcaaagatttgccacaaatggtatagaattcaggtagaggaaaaaggcccaaatacacaaacagataaacaaaaagaaaagtttagtaacaaatgagaatataccatgaggcgggatatgatacactgttgaactgcacagatgtgtattgatttgaaaagaacattggattgaacctggctggagatttggatcttttcatcagaagaagggactgtatgtagagactactttagaagttttactgcgtaattattactaagtgaggtttggagtcagacaaacctggatttgtaagctggagaagcaaattatccctgggagcctccacttctataaattctatgaggtcagggtctgcgatactcctgaagcttgtcatctctaaaatgggaccataggctgggcacggtggctcacttctgtaatcccagcactttgggagactgaggtgggtggatcacctgaggtcaggagtttgagaccagcctgaccaacatggggaaaccctaactctactaaaaatacaaaaatcagccaggcgtggtggtgcacgcctgtaatcccaagtacttggggggttgaggcaggagaattgcttcaatctgggaggcagagggtgtagtaagccgagattgtgccattgcactccagcatgggtgacagagtctctgtctctaaaaataataataataataatgggaccataaaccatgctgtccccataacaagctacttttgtctcctgttggcagtgcacttttcctcccctccagacgtcgagggagtgttcacatgcttttcttctatttttctgccaaggcaaacttgtctcttcctttaaaactcaactccttgtcaccgcttccttaaggtctttcctgcttgctccggctctagaggtccaggctctgctcacagagcacacggctcccacgagactgtcagcctctagcagacagggtctgcatctcctcccaccccagctgctacctcctttcaagagtccctactgtctagctcaggtcatgataaacaaattgataaattggtgaattagagaataaccagagagcactttaagagtgaactcatgaaaccaattaggctgaaaccctttacaggtgactccgtgctagtaatttagtgtggacttacaatgctaaggtttcccttttgcatttctgcttttctagttgaatcttgtagttacataaccacattatatatagtagcacccttcctgttgggaaaacaaaacaaaaagccatcgttcccacctcttaaagggcaaaagaaatgaggtggtgattttcttggtagaacacattcctgattccagtattatttatgccactgaatacctctataacattgagcaagtcagtgattcttgccatgatttatctatcaaattcaaataacaaatcttttcactcactcactcaacaagtatctactgagagtgggttatgtaccagtaagggtgcctgggatggagatgccatagtgaaccgtagagaccctgttgctgcctttgtaaaaagcttattgaatagtgatgaagagagatattaagcaaacactacagaagtttaaaattcaacgggtgcaagtgctgtgaaggaaaataacagacgctcatcatcacataagataacaatattctatccataagcacacaaaattctctcaaagcaaaatcctgttgccctcccactgggtagtccagagatagaaaaaaagaggaccctaagaatctggagtcaaaatttcctctctcatttcccctggcctgatctttatctacttccagaccgtctttatcctcgctgcagtggcatcaaaggcacgtttgcatttccccaagtggtggcgtctcactgagctccgcagagacgggggcctgtgatctgccactgcaggaagtgtgcgtgtctcggcaggaagcgtatcccccctgccttcctttccctgaaggcggggttcaaagtggagtctggactgagatcaaagaggaagctctgcgtggagcacagcaggtacctcccagctcctcacctgtctgcctgggagacactggtccaagccggaccaggaagacagacagctgaccatggcatcagcaactgaaagggatagagaggctacactccctccactctcaggagccatggagtaaagagacgcgcaggcatttccgtgctcatgaatacccggatgttcacgtgggagagagcgttgctgggcaagacagtgaaggagggaattgctcaagctatttgctcatgtatttttccaagaataagcacataaagataagaaagctacatattttgatccgattctagagctagcagtcgctgtgttgaaagtgatggcggtgatgtctaacttgaatgtcacgcccaatgggaaacatgcccaggtaccctggcgccactggcttcccccacaacgccactctctatcattgcctcaaataccacggaggcttcccttcgttcattgacatccctgagaagtgggaagggggtacttttggtgattcacacacacaaaagttatgggtatatgtgactgactcctgctcaggtgtgaagccacagctcgaagataccagaaaatcaactggggggttggcacaccttggcacaggagggcggaggtacaaggaaacatctctttattgtgctaccttttcctctctttatgcaatgtgactttctgtgaagagagatggataggcatattaagtgatattacatcaaattaaaattaaaacaggctggctgttatggctcatagctgtaattccagcactttggtaggcttagggaggaggatcatttgaccccaggagttcgagactagtctgggcaatacagggagatcccatctattaaaacaaacaaacaaacaaacaaacaaacaaaaaacattaattatccatgcatgcgagcacatgcctgtggtcctagccacttgggaggctgaagtaggaggattgcttgagcctggcaggtcaaggctacagtgagcagtgattgcaccactgcactccagcctgggcaacagcctgagactccatctcaaataaataaataaagtgaaaacaaaataatttaaattttaaaaccttgaacgtttgctaagagacttatcatttatagatggttttctctagtattatgttaagttttttgcctaaacaagaatatgaaagaaattccatattaaaaagctaataaatacacttggcataaatatgaatataaaaatataataaatatgttataatatatatattaatataaaaatatcttgactctcaatatatcgaagatactgaaagtttaatctcccctagtgtgtagagaaccagagttattcctgccatcatttttcttccttctgttactctggtttccttagaagcattttcagagaagaatccagagcgcactctgtcttggaaattgccggttggtaatggagattttaaagactgtatttgtgaatgcaggtaagaaaaataaggagacagagttgcattctttatagttatttttattctctattattgggaaagattattttctgtatttaccaatcagcttggtaaaccttaaatttaaaaaatatgtatgtaataatacattgtttagctgcttgcatttctcatgtcaattttgcaataaaattgttttctgcttacaaaatctgtcaaattcaaagaagctgttaacatacctatcacaacatattatttacactaataattatctctgtctgtgcaattccccactctacacatactaatgcatttaagtcaagtttattatgatagtgtttaagatttatttaatgcctaaaattatatttttatgcataaacatttcagtgttaaatgattaattaggtcagcaaaatattttaaattgttgaactatatttgtaagtgtgaatgcatatttaattagaaaattacatttaataagttaataaaccaaattctacttaatcatattttaacaattacaatccccccccccccttttttttttttgagatggagttttgctcttgtcacccaggctggagtgcaatggcgctatcttggctcactgcaacctccgccttctgcgttcaagtgattctcctgcctcagcctcccaggtagctgggattacaggtgcctgccaccacgcctggctaagttttgtatttttagtagagttggggttttgccatgttggccaggcttgtctcaaactcctgacctcaggtgatccacccacctcggtctcccaaagtgttgggattacaggcgtgagccactgtgcccggcctaaaacccccacctttttttaattttttaactgagacttctgtgtaattatgttactgacagaaaaataatgtcttcaatttctcagataactttcagagacatattctttcatttgtttactttcatagatatcataatttcagatcacagtttttcagataaatttatactatattaatttcataaagtagattcttatgcagcttaacatgtattttcagtatataaatacaaattgatttcatatatacttgtgaagactgatgccttgggatttagaattattttattaattatctaaactggccaatttttaataaagacatcgagaagttgtttaaagtatctgtgttttttctgaagttcttttcaagtctacagggctggacctttgaagatggtttttcagtacacttgacctatatagcaatcactgacctgaaatgataaaccactgtcaattaataaaatacatgttacatgaagatactgggttgtcagcagtgtttaccgctgtctctgggaaagactgaagtgccatataactgtaactaataggcgtttgaacagcctccgcattcttatgaagcaacgacttttttaagaaatataaactttcacaagtaaagcaccttttgcgttaaataacaccttttttaatatgaaaaggatattaaacacacattggatggttcttagaaaatcctttatataggtcctctaattgttttcaatatttatgataaacttttacatgaatcgtgcgtttcggtttctttattaggtttacgagtactggtaaaaatagaaatataatagtaaaaatgtttgtttagtaaagaacttggcatggatcagagagatatgtggcatcctcctggactctgccacatgtgtcttttccctggaatatattgacatatcccctccctgttaaaaccataatgacaagcatgatagttttagagatgtctctgagttcttctaatggagaatgaagcctcaggctggttttgggagtctgaaggggtttaggctttaaattcatgcagagtttagctaattctagatggtgttatataccatgttagaattaggaaaggtggcaggcatcactttaaattctatcaaaaaaggtagattttgttattttcacactgacaaaataattcgaagccagagcagttatttccatattgaaaaacaaagcttgagaaagcaataaaatcaaattaaatatttaattgtagttttttttaaatatcaagccagagtctaccatttacatatgaattcaaagtcttcacaccaaacttgcaaataagaagaggtttcaatcctgataatttcaaaagaatttatacatatatatgagtttctagaacggaaagtagacttaaagatttaaaaaatgttttaatgaaaaacagcccagataggttactgctatccttattttataaaattaattttaagtgctattttatatgtaattaaataaatattagattaagataaaatacttttaaaatgtggctaaagaattgtttgtagttattttttattttatttatttatttattttgagacagagtctcactctctcgcccaggctggagggcagtggcacgatctcagggcactgcaacctcagcctcctgggttcccgccattctcccacctcagcctctggagtagctgggactacaggtgcccaccaccacgcccagctaatttttttgtatttttagtagagacggtgtttcaccgtgttagccaggatggtcttgatctcctgatcttgtgatccgcccacctcagcctcccaaagtgtgtttgtagttatttttataataatacagaataggtaaatacagataaaaactgtgattttaaaagcctactgatatgcttcttttacttcttcagtagaaattaaagcacagccagatgtcttccccttttccccacaggatacaagtgcttagcatttcaaaggtccacggagttggtaatttcattattttttcattcaaaggtcctgtatgtatagtgtgagaatatcgggtttacagtaaattttctattgcatatgcattcttcctacacatagtatggatctatttattttaattagatattgaaaaaatgtcaaagtcatcataaaaatgaggcagtcacacagaagcattaaagtaaggattcctgctcagaaaaaggacgtctaaagagaccaggtcctctgttgcaccatcaaacgagaacttgcctccagcctctccgtagagcccctcttgcactattaaaccactctactattttctcctatggctacctgtacactgcgctctttcttacactgtttcttctacctggagtgttccacctccgagtagcaaaatgctatgtacctttcaaggcccactacaaaaatgagctcatttttctgaaatgcaaaatcaatatgaaattattataaaagctaaacaaaaagaaacaccaaggatcaaattaataagtaccctttttccctctggtcctacaatctgatataaccactgtaaagctgaacgctgctgacttcgcggagatttccctgatggcttcccaagcctgtgccatctccttccctgcagctcagtataccattcctcttgtgtttactattttgccatccttataatttccttggcaacaaggattgtttctttacttctaacttaacagcatgcgacatattccttaaatactaagtggagtgagtaaaacataatagattctcaacgaatatttattgaatacattaataaattactggatatgttcatttaatatttaatgtgctattatgcccatgaaacattaaatcgcccccatgcaaagtgatgaacttaccatcacatcttggaaaagggtagttccagtttctgttgatcccatgctgacaagtgaggacaggatggcctattagaatgtacccaggataacactcgaaagatactgattgccccacgctgtaatccgagttgatcatgtacccattctgaaatgggggtggatctggacagttctgtaattcataggctgaaagaaacaaacagacaaaataaagcttatatttgtgaggttaaattacttcggaatttgcaggagtgtcatcacatgtgactgcttgagatgaagttgttggataagtttaataaggtatattttctaagtagtcagttgccatccagaccaatataattattattagtagtagtagaatcataaccatatgcatttaataaatagtgtgtactttaaaaggaaagtagcacataccaaaagtaaattttataatgcttaccttggaaaaaaggcatatgatgtaaattatttaagaaagtaatacaggctgggagcggtggctcacgcctgtaatcccagcactctgggaggccgaggcgggaggatcacgaggtcaggagatcaagaccatcctggctaacacagtaaaatcctgtctctactaaaaatacaaaaagttagcctggcgtggtggcgggcgcctgtagtcccagctactcaggaggctgaggcgggagaatggcgtgaacctgggaggtgaagtttgcagtgagccgagatcttgccactgcgctccagcccgggcgacagagcaagactctgtcccccgccccaaaaaaaaggaaatgcaagtaataataaaaggagcctacaaaaaatgttgggtgaacatatacctaataattcccttttattttaaataggaaatatactaccagtctgagtactcctaactggaaaatatgtcgttatttggtttaactatacaaatataacaggaaaatccattgcagtttttttagtctttttctaaaaaaaaaaaaaaaaaaaaaaaaaaaacactgtataatccctaagctgacaactactatcagtacaattttttataacatgatttattgtgctttatcattcagtctttatgttccctagaataaactccaggtaagacaagagataataaatgtttgcagtctgtgtggtttaaacatttactcattaatgagtaagaattaactaatccataaatcaggtatcatctgatactgtaattttaaagctaaatgagcctctcgcccactctgggaagagggcgtgagtactcaatgcagtagaagccctctctagcatctttgaatatttaggcacacctttgtccataaaggcagttcccatgagactgggaacctgctcctaatgcagcagcaaagccacaccatgcagcaccagttctgggggaacctccgccctgccatgtaattctgctgaaaccaaccctcagcgccaggcaacacaatgagtttcaaaatagcatgaggtcaccggtcactgtcctcacaatcaactgaaaatcaagtcataaaataaagtctccgagcttctgcagaggggccttttctgtggagaatgaagtgaaatggaaatttcaattttatgtgtaaattccttaaccattgacaatattggagtgagcctgtagtttggaaacttgtaaacaaatgctggaaaaggaaacagtatattattatgacaggtgtttcccagaattctagacttttttgtttctgtgttcaggacctgagaaaaagagaggtgggccagaaagaagataggacagggcagaggggccagcagacaggggatgggaacacaaagagcttgatgcgggattactcagggattagatttaagaggcagctaaggctcagaatatgaatcagtctgtgttttatattaaagcaattggacatcaacataaagataatgtgagaacatatggaagacagcaaccaggcaacgcaatatgtgggcctacagcgtggccttggcgttcacaagattaatgtaagtgctgtttggagtttgtcttcattaacatttgccaaatgttaagcattccatagagccatgaggtttcgttattatccatagctttctcctatttaataaactaatgaaatggcattgttgcctctttaaaatgacaatgtgcaggctgggctcggtggctcatgcttgtaatcccagcattttgggaggccgaagcgggtggatcacaaggtcaagagattgagaccagcctgaacaacatggtgaaaccctgtctctactaaaaatacaaaaattagccagggggggtgaccggcacctgtaatcccagctacttgggaggctgaggcagaagaatcgcttaaacccaggagcagaaggttgcagtgagccgagatcacgccactgcactccagcctggcgacacagtgagactccatcacaaataaataaataacaatatgcaatgctagtgagtcatttcagtaactcaatgatggcaacattatttgccacaactgtttgggaaagtcattagaatagggccataaaaaatcagttgtaatattaaacctagtaatacatttacagaaatctctattatgagcataatttctaagcagaaaaaggtgaatgtttaaagatgttcattgcagcattatttacactacagaaatccaaacaacaacaaaaaaaaaatagggagagactcataaatgccagtgatgaaatgtcatatctttcaatagtcacagattgtatagatttctgtgtatttatttatattttcagtattgtaagcatactatgcagttgacaacagcttcctgtggttaagccctgactatagtcagcaggttaaaaaaaatcctttatttaacctttcagcatcccttggttttaattattttcatttatgcaatgatatgtctctgaacaagagtcagagacgcagcagaaaaatgattgagaacaagaaaaatcgagatcagaggacacatagtggcaaaagcatcttgagataattcctggcattggctcccccagggacgagaagtgggaagaacactatgtgagacaaattcctcccagagcgggagaggaggaaacttcacctggagggaagcgctgggcagcctctgaaacccagaaacccactggattatgtcgctcattactaacagagctttgggggctccctaagagctccagacatcacctcttttacctactatctaaagatgtaaaaggctgggagcagtgactcatgcctgtggtcccagttactagggaggctggggcaggaggactgcttaaggccaggagtcgaatgctgcagtgagctatgatcataccactgcactccagcctgggtgacagagcaggatcctgtctcataaaaagcaagcagacaaacaaacaaaaaacagatacaaaggagtattgcctaattaacaagatcagtgtgaatatcaagtaatttatatgataaaacttaataaactgtcataagttcaaataaagttattacattttatttataatgcacctaaatattatagagaattagctgtattttaggttggtgaaaatgtaattgcggtttttgccattactttcaatggcaaaaacctcaattgcctttacaccaacctaatgtatatcgataatatgaaattagaaacagtgtttgaaaatgagtattctgattaactcagtgctatcttttgagatgtaatctttataactcaatatttacaagctttatatacagaaaatccaagataaattactagttatagaatgaatgcttttaccccataaatgtatacaattataatttgccaattaaaaatgttattactttaaaaatatgtaattacaaataaaaaaatgaatgaatgttccagtgctgctttctggtaaagctacattataccatggaactactgcgttgattagagacactctacaaagatttactatagatcaataaaccttataagcacaattgctattaataaagtttgcaaaataaaaaatatttttaactcacaattttgtgaaaatggaatttgcagttgacgtggtatggctgtgtccccacccaaatctcaacttgaattgtatctcccagaattcccaaatgttgtgaatgtgggagggacccaggggaggtaattgcatcagagggtccaatcaatctcatactattctcgtgatagtgaatgagtctcacgagagctgatgcttttatcaggggtttccacttttgcttctttctcattttctcttgctgccgccatgtaagaagtgcctttcacctcccaccatgattctcagctcccccgaccccagccatgtggaactgtaagtccatttcaacctctttttcttcccagtcttgggtaggtctttatcagcagcgtgaaaatggactaatataacagtccaccatacagtagctacattatatacaatagtgtttctcagttgtttttgtgtctgataagtagaatattggactgttggaatcttttacatcatacttggcttcaaggaaaaacttctccaggtgttcgaaggaagaatattcaaacccctatgaaacaattatgtcttaaaggacgtagctcaaaggctacagtggcgtgtccctcatgattgattgtttttgttgttatcacctatttgaaaaactagatgcttagaaatctaagctgataaatgtagggacagggaacattaaaacagaaagccaggccaaatcagcatctctctctttctctgacacacacacccctcatctgcattcccccatcgtgtggctccctgggccaacctgtcaaatgcatagcaaggccaccgctgcctctgccagggaccactccaggctgaagtccacaaaaacagccttttcttgaaagccactgccaaatggcctagaaaacatccacagtgcctggaatgcctcctcccaatactgctatttggacctaaaattgctttagagacccatgctcacaaaaaagaatgaataattccacactgagtttcaactatcaacacatttccttctttattattctcttttagaatgaaatcagcaattcatttctcattcttgttttgctttaaacgtaataaactctcttggaaaaatgagtcctactgtacagcaaatatgaacgctaataaaacgttaagaaaaaaaaacatggaaagctgattgctggtttctagaggaggagaagcaaataaaactagattcaatagaacctcatcttcattagaagatttcatccacgaattagcagtgccttggaagtatacaagcctcaattaccagaatacaatattaacaagttaatggttcataggtactcctggtgaaccttcacttaaaacagcgtttaacagagacacacacacatttacaacacaggagtgttaatagtatgtaaggcattgcattgccttagtttggctgtgtagtctttcgggtgacttaagaagtacaattaagttcttttttgggataggtaaaactagtgttgaaggctctagcgcccttctgctcatgaaaataacctctatgaaaaacaccgaaataggacatttgaagttgtaattaaagattctaagcccaatggctgcgggctactctaatcactgaaaaaaattgttgttgtttttttttcttttctcaatggcaacaaaacaattatcctgtgtgcgtgtggggaggggggagcagattagcccatatgggcagtacagtggttttcattattcatttattgagtgaaataaagattatttattgactctactctgttataaatgctagttataaatggaaactagaaatgcgtcttactctggtgaatttaggcaaattaaagcatagatgattgtataaaagaattgtaagttgcataaattattattaaaaaataaaaagtggattgaagtaaagaaaatataaaacctggttaaggttatgcagtagtggtcaaaattgttttgttgaagaaatgacgtttaaattaagatctaagtaggaaaatggtgcagatcaggaaaagaccaagaaaggcaggcttttcagccaaaggaaatagtatgtgttctaaacatagaaagagttcagtgtctgggataaggggagagtttcagaagagagatgacctctgcagccccttctcctaaagtgtgtgccccttttcacactctcctaaagtgtgtgccccttttcacactctcgccacctcctaagtggagacgaagtagtcgtcaaattgttcagaccacaggacgttcattagaacacattttataagtggacacagacatattataaaaacccaggacccattttttcacctgataaatcccatctgccagtcaacatcataatgatgacaatgatgattcaaaacccatggctcatttcagaattatctcaagaatttaaaatgccaattagtttctttttctattgtaaactatacactaagtaagagtatcactaagtaagagcatcagttacactattttttggtctttgttccaaatgtcttgttaaactgagtacttaactacttaaatattaataccgatattccctcaaacttttgatgtataaagtcatattctctcttttctcaaatgtcttttccaaacttggattcactgtcacacttcacacaataaggtataaaggactatattaggagtctgaatggaaataactaaaaataagtcatgaagataattcctgagtatgctgaagaattttggaaggatcctgttgcatcctgtttagtgtgagtgtgatgggtttcatagtgcctgtgctggcttcttgcaggtgcctctgaaggacttgcaatgcatcacagtgccaggccacacaggtgtgagagggcgaaggaggcgtcaatctgctgtcagaaccctcatcacgcatggccttcttgctctgtacccatcataaaagcattcaccctcataaatgggttgtaaacatataaaaagttttaatttaagaaagaaagtcatcaagtgagagaaaaagaaaaaaagatcacttcagtggaatttgataaagaagttaccttctagggtaaagggtggtaaaagccacgattatcaaacaaattctgattcagctgaaggtcacaacttctgcatccccatactgggcaattcctaaagacttctgaaggcattctctctattagttctataagagttgttgtattatctgtcattaaaaagttgaattaaggccaggtgccgtggctcatgcctgtaatcccagcactttgggaggccgaggtgggcagattacctgagatcaggagtttgaaaccagcctggccaacatggtgaaatcctatctctactaaaattccaaaaattagctgggcgtggtagcagatgcctgtaaccccagctactcgggaggctgaggcaggagaatcacctcaacccaggaggcagaggttgcagtgagctgagatcgtgccactgcactccagcatgggtgacagagttagactccacctcaaaaaaagaaaaaagttgaattagagaatcatcaacacatgaagaaatctacctcggcagtacatacatgagccttgaagtagttttgcaaaataggtgaggcaccctggtgtgacctgagttcagcctggttgtgccaatacggggacttgaacattccacttaatcccaggaggctcatttcttcattcatgaaaggagactaaatatacccatctatacaagggccacagaattaaatgggatgctaaaagaaatgaatcagtgttggcatatattagttcagtaaagcttagtcttgatggaaagaattgtctagtttctttgataaaatatttctcattaatcaaggcaaagccctcgagcaactgctctgatggagacagacccaggaggaggctactgcttctggtggtgggaattagggtgaatcactctaagaaaagggcattgctacagagaatagggctgcagtttacatcaaggtgtacactgaagactttgaagccccgcttgagtcctcagcttccctatcaatgaaaagatccatctggggtctcagtagcatgtcagccatgaatggtagtccacagaatttcccaagtgcacacatacagaagctcaccaatttcccatatctatcggctattctaaacttctgggatagcatatcactctttctttataaccaaggatatcaccctggttctcaactctaagacatattttctgcctaattatgctccatttgttctcttagctcctagtcccagcacctgcttatgaagccaaccaaactgttgcaaaagttgtcagagttttgggcctcgctgagactacaggcttatacatcaatgcttcgggaggaccagcctgcacatgaaacgtgctccctgcattgcaagagaggcttgcagcaagtggaatgtggaaatctgaaggtgccttcacctaggagacgggtctactgatgcacgctgagaacgtcagcttttggttcagaggaatggatcatttaaaggagaaggtgagagtgttgcttttgctttcagaaaacccatacaagaaggagtagatgcctgtgatctgcagggagaacatccgtcaacaatgaagattcaggtcctagtttctaagagtcttgtccacaaactaaggggaatcttagccttttctgtctcgtacatggttgccctagcggggatggggattgctacaactctttggggtcactgttggaagcactttcatgcaaaagaggcatctttgtaaagccttaggttgaaagctcaattcactcatgcagacgggtaaaaacagagactgagtaagcacccttgccctgttcccctaattactcaaagtcgctcagaatcccccgttgaaaggaaaaggaatgatgcagttttagaagcatatcaactttatgtacaaattatggtttgtatacaagcaacagtttgcatgctcacataattcagaatgaattgttcagatgttcattgtgcctggaggtggcttaattgcttgttcttctaaaggggaaaaattggtataacaaactatagcctattttctaagaaaatcatttcacataaaattcagcagttttatgattgtgatgaagaataaacagatttaacacattcgattatctttaaaaatggtgtttggcacacatagcaaaaggaagaagaaaaacagtggaactttgaaaataaaagacatttttacttgctatgcctaaagcattaaaattatctttgagattttggcattgaataagttttctttcccaaaaaagtttatgcattagaatgcagcaatatgctttataacacagaaaagaaagagaggaagatactaaagaacaaaggaaggaaaggagggagggaaggaatgagagggagggagggaggaatgaaggaaggaaggaaggaaggaaggaaggaaggaagggaaggaaagaaggaaggaaggaaagagggagggagggaaggaaagaagggagggagggagggacttaacttctccaaattgcaaaacctaaaagaaaaggaagtcactaaaatctttaacatggcaaaatttttatgagtattatgaaaatctaagtatcaataagcccaaggcaataccaacaaaagtaaaataacacagagaattttatcttttataaaggaatcctttgtttagatctgaaaaaaataactattattcacatcaagtttttaaatcataagtgcaacgagaccatgcagtaatccccctaatgtctattttcccgctaatatctagttagttgataaatatcttcatgctattatcaatttttcaattcttgacttagaaatagagtgcatggcttgattttaccaaagttcttaataagtcatttaacttcaagacagctacgtctatagtaacatctctgacctttacatggtcataaataaatgacaaactttaagaataaggtgtacagcacagacatcattgaaaatgacaagaattctctgtatgatttatgcatcttcttaggagttattaattataagcttagcttctaaatctcaagtagaacctaggaatgtttatttgacttacatatcagagttaagtgtcatcttatcaatttatcaattttataaaatggcaaacactgacaaactatctaattaagtgtcacctctgtcagatatgataccctacaagaaaataaaatagctcaaattcatgttctcatttatttgtattatttatttttatatctcagtgataggaaattaatggcgtacaataaaaaacatgttgtttcgagtttttgttttttttttaattgaaagtcctttcttctccttgacatctggcttggaatggggtgtcaagacatgggaaagcaggaccaatgtttccagatcctcctattgcaagagacaaagggaaagcagatctaagggtatctcacaaatcctttaaaagctgcgtgacaaacaatactagcatggagttaagtgtgaagcaaataaaacacttgcttagccaaccagatgcttgacctaggagaggacttatgctttctaacgctcaaaggccacggagtcaacatcaatgagcaagacagtaagaaactagaggaggccctgaagtcaggcccactttgccagggttctctcctacgtgggaatgcaggacaaatatttccagactctgctattgcaggagaaaaagggaaaggggatttatgggtatctcataaattacataacatggaattctaaatactgataattgatttttgtaaatattaaatattttgtgagtcaaccaaagcaattgtctgacctgtgctctagatgattcctacatgggctttttgcaggtttgcttgtttgtttatttatagaccattattacagattgaaataattggtagcttttggaactacatagacatggccttaataaccttacctgtaaaatatcaagagtaaaacacaaaaaactatggagctgggccgggttcagtggctcatgcctgtaatcccagcactttgggaggccgaggtgggtggatcacttgaggtcaggagttcaagaccagcctgcccaacatggtgaaaccttctctatactaaaagtacaaaaattagccaggcatggtgacacacacctgtaatcccagctactcagcaacaaaaccattttttaaaaaaaaactgtggagctgggccgggcggggtggctcatgtttgtaatcccagcactttgggaggctgaggcaggcaggtcacttgaggtcaggaattcaagaccagcctgcccaagatggtgaaaccctgtctctactaaaaatacaaaatttagccgggcatgttgacacacacctgtaatcccagctattcagcatgggagaatcacctgagcccggggggcggaggttgcagtgagccgagatcgcgccactgcactccagcctaaataacagagtgagactctgtcccaaaaaaaaaagaaaagaaaagttaaatgttgaatatggtattaagaatattcaaaatgtgggagacttgcaagtgcttggtgtcaactgagatacaccaattaattgacagttaatggtttatggcatataattatgttctatttttcttattggctcagatattaagatcatgctcattaaaaatggaaattaccatgtaatgagcaagtttaacatgatgatcacggaggaagtgtttgtattttaacaggatgtagttcactaggaatggggcaagggaggggacagttgagcaggaagatgggagagaagcacaacattcatcattcacattattcaaattgtacgtcgtgcatacagccagacgaggcgatgcaggtgtgttggagctgaaagcctcccgcccccaattcctggaagcctcttcactgcttcccctgctctactcttccctcgcttcccccaacccccatccacatacaattcattctctgcatgtaagcaacttctcatttgcttgagcttcttcagtgacatcacattgcacctagaaaacaacctgaatgcgtcacagccaaatccccaggccccctgacccggggaagccctctgaccttccgctcccagtgcaccagccttgttcctttctcttctctcaactcatcgggcttctctccacccagaactcttcctagcacgtgcagccatgtctccttccagtccttcaaatctcaatgccaccccagagagtggcagaccccaggcccccgctcacaacctaaacatcaccccaatcatttcctccacagcaggcaccactaacacagcttcagcctgggcacggctgcagcctctatggctgcaacttcaaatcaatgccctaaacatatgtttttgcctccagtctcactctatttgcaacaagtgtttctgtaacagtccatatctacattgtaccagattaggctcttaaaatgtgtctaaggtcattgtcattctcactttaaaatccgcgatagtttcttacggtcctccagcgttcataactgttttaatctgaactactttggcattctgggaagtctaataagtttctcaaactaatgtcttactgtataaaataaaatacataagattacaaaggaaaccagccattttaaaatattcctacaaaagtgcgataaagcaaaatttgtggcttaacattatgtatgttatttcactaaacaacacatggccaagtctaataactgaggcaacttcaaaccatggtgtagtaacattttgaaatatctgcacatgtatacatatgtaactaacctacacaatgtgcacatgtaccctaaaacttaaagtataataataaaagaaaaaaaagaaaaaataaataaataaaataaaataaaaaaagaaatatctgcactaaatgaaacaaagcaatggattatctatgatttggtgacaaagtcacaggttatgctaatactaattttttttttttttttttgacatggagtctcactctattgctcaggctaaagtgcagtggcgtgatctcttctcactgcaacatccatctcctgggttcaagcaattctcctgcctcagtctcttgagtagctgggattaaagttgcctgccaccatgcccagctactttttgtattttaagtagagacggggttttgccatgttggtcaggctggtcttgaactcctgacctcaggtgatccacccgcctcggcctcccaaaatgttgggattacaagcatgagccactgtgcccagcctgctaatactattttaatattattgcctgcctttaaaatgtaaggaaatgctaaatattaattaaagcttaaggggaaaaatacataatattgttatgtatatatttaccatctgagtaatagattccttgaattctatcctcaaggccccagaactattggtgtagagaactaaattcatggtcttaacaggggatgcaaattccttcacaatccaataccatcactccactggctcatgtccaaactcatccttcacctttggtagccataatgccacctctagtgtaagccagggttcacacgtggcctccaggttctgctcacgtggaactttctcagggaaagcctgctcagtgtgcctgctctgcgaggccacccagtgggttttaccctcagacctcagcagatatctcagtcacagagaggatcatgttggattttaattttgtaattgaaaatctagttttctattaaattatgacattattttacaaaacacccatgtatcttttttttttttaattcctagctcttggcacagaaattacattctcatgctagcctaatacatagacggccttcaaaaaaatttgacttaaaatacaacttaatgggtttagattacagagaccttcacaagttataaaatactacaataatgttttattcaaaaatggaaataattaaacactgatctatgaaagtaagctgtttgtcttcaaagtgtcactttgatgagttcagtctcatcagttctagatagtgttggggctcaggacaccaccccaaaatatgactctagaagaccagaatatgccaccccaaaacacacttctttggtatatttccaccagattattctgagaaactgcagatacaaaagtagttctgaatagctgcatcaagagggcagttgctttattacctgagcaattgtaatctgcataacaagacaactattcaccatatcattccttccctcactctctcctaatttgactccactactctggagaagcccaagctcttatttctttctggagctcaggagctacacaagctccaacttcttgccctttaatcctaggaaacaggaaacaggaaggttaggaacccactcccagccttctgtgctccaggaaatatctaagtgggaagaccctccttcgcccaggtctacaagaaggctgagggtgccgctccgttcacctgggaggaacctctcccacttggcctcatatgaggttagctgacttgcctgtcctatggatacactggaataaaaggcgtattagcccagctctgcgtgagcctgcatccttccccaggcccctggatgtcacccactgcagcgtgggccggcacacagcttctcctcagcgacctgggggaggccgacctggggccccttcttggctgctgctgtcctcctgggccttcttggctgctgctgtcccaatggggccccttcttggctgctgctgtcttcctgggtcccccgcctgctctttctatctcactgctctctcaacaggaggctactttccactaccctccggggatgccggctgacctgaggatccctcagagcctcccctttacaatcgtcctcagtctctcctgaaagagcttgggtctgtcttgtgttggatgccacttatagcagctgggggtgccttggcctcaggggaagagaggcgcccctgggagcagaaggcaatcctgttactgttacactggaaggctcacgtggacaccggcagacgagagtgaagcccctaacccaccaggaatgaaggggttctgaggagaaacctatggctgggctttagggctgcagtcaggaggggcgggcatagagcttagctctgggaaggggaggggtgagtgtgatcagaggtaggcgaagagacaggaggctgctggcaggagtgcccagcacctctcgctggctcaggacctacaggttggactcattccccctccatgaactgaccactgctcatgacactcactgccaggctgcgctgcagctgcctcacaagtcaaactgagaaagggtggcatggccttaaaggccggtcgaattcttgcaaagtcctagaaagtgctctgtcaggccgggcgcggtggctcacgcctgtaatctcagcactctgggaggccgaggcaggcagatcggatcatgaggtcaggagatggagaccagcctggccaatgtggtgaaaccctgtctccactaaaactacaaaaattagccaagcatggtggcaggcacctgcagtcccagctactcaggaggcaggagaatcacttgaaccagggagttagaggttgcagtgagccgagagtgtatcactgcactccagcctctcgacagagtgagactccatctcaaaaaaacaagaaaaaaaagagaaaaagaaaaacaaaagaaagaaaagaaagaaagagctctgccagtgtttgctgcacaaatcaagggcaagggttctgatgtccggaggccgtgatgttaggcagttcctgaaccatgaccctggatctgcaagaggcaatgcagccacagcggacatctggattccacggtcacaggcagcacctgcatccaaccacgaaggcatgcgctgcaagtccttgtggagaacgtttgactctcagggttttggcgaggctattttcacagccgtaaaacttgagaggagcaggcagatctgtcaggtgtcaggtccaaaacgaaaaactgtgatcggagttttcccacagtggccgttctgcagcttagggatggtcgagtggttttgcaacttgtgggagaaaattgttctttttaaactgacttcattaggtttaaacattctttcccctgttagtgcactgactaaatcgttggatttagaatccaaagacttcatttcccttccttctgctgaaatacaatagcttggctgacactactactttggtgtctagcagacttgattccaaatcatacttccacaggcagctgtgcacattttcacaatttgccaacctctctgagcctcatttttcttatctgtgaaatgtgcataacccttggaatttatgtggaaatcaggaagcatagagtgtggcgcagagtgagcacaccatacgtaacagttattattgtcattattattactgagacagggtctcactttgatgcccaggctggagtgcagtgatgtgatggcagctcattgcagccttgaactcccaagctcaggcagtcctcccacctcagcctcccaagtagccaggaccacgggtgtccaacaccacgcccagctaattttttgtagagacagggtctcaccatgttacccaggctggtcttgaactcctggccttgagcaatcttcccgccttggcttcccaaagtgctgcaatttatttttaatatagtaaaacaggggcaattagctcttccaaaccaactaataatacttctgcagaagcacatgaggacataagaaaacactaataaaaatctcttgcatacaaatacttcatttacatagagttttaatccaattatatcactgttccatggcatatgtattatgttgtttttccaggtaccttcttaaaggaactggcttcttcccctttaaaacatgctcttgagtgaagtctgctgatcacatttctgactctgtgaaccggcttcttcccctttaaaacatgctcttgagtgaagtctgctgatcacatttctgactctgtgaaccggcttcttcccctttaaaacacgctcttgagtgaagtctgctgatcacatttctgactctgtgaaccggcttcttcccctttaaaacacgctcttgagtgaagtctgctgatcacatttctgactctgtgaaccggcttcttcccctttaaaacatgctcttgagtgaagtctgctgatcacatttctgactctgtgacccaagttgacctaacacatagtctctgtccacctggcctcagtggctggacttagacacaagctggcccaccaagaaagtgttcccaaaatgtttagcaattgcagtaggagaagcagggtcctgtccttgctgagcagggtatggttagattggggacatatcatccatgtgtattagggcagaaaaagctatgaaaatcacaacaggggcaaaaagaattcaggtgtcactgaggcccaggctccagacatgccccagcccacacagctgtcaccttgcacttctttcctaaactagtttcattcagatttctatcatttacaatcaaagagggcagactcatggggaacatcctggatctttgtccccccctcatgcattacatctagccactaattgatggctcatctatggagtccgggttagtcctagaatatgatcaaggctctattttcacaattatatgtaacagtgatacacgtgtctatgtgttgcagagaggacaaccaagccttttttttttctttttttttttttgccccccgagatagagtttcgctctgtcacccagactggagtgcaatggcatgatctcggctcactacaaaccccggtctctggtctcccaggttcaagcgattctcctgcctcagcctcctgagaagttgggatcacaggcgctccccaccatgcccagctagtatttgtatttttagtagaaacggggtttcaccatgttggccaggctgatctccgactcctgacttcagctgatctacccacctcggcctcccaaagtgctgggattacagacatgagccaccgtgaccggctcatccctttcggatttctggtagcgacggaagagatgcagtgaatagaagagaagaacaccactgccattgataatatttttatatcagtggttatacccagggtacactcagagctgtttgcacacatgggtaggaccaccagtgcctgaggtaatccttggggtcatgtttcctgaaagtaactgtgaatcccaccatccctgggtaactgatacttctctggctgaaagcacaatcccttaaagaagccttctacaaaatccaacattaccaagactggacacatggtatttgtgccagtatctgcagtgacatgaattggctaaatttttttaaaaatttttttctatgtaatactgttttgaatttaaaaacatattttttttaaattttattattttaattgagagataataattgcacatattcatggggtacatagtgatgtttcaatacatataatctaagtgatcagatctgggtaattactacatctgtatgttcatcatctccagcctttatcatttctttgtggggggaatgttcaatatcctcctggctctgtgaaatgatgggacatattattgttgactacagtcaccctaaagggctagagaacactagaccttattcctcctatctagctacaattttttatcctttaaaagagttttgctagcaatatccgcaatgcgtagggactaaaaattgatttaatttaatgaggaagccggagcacagacctcaaacaaataaaggcaagccctgcacaggtgcttccgaaaatgtatatgcagcacggcagaaagtcccttagcatcagggggaataaacacctcaagtatggagctcacaggtgtgcactggggagcaattacaggtaaggcactgcgcttcctgctgagcgcggagcgaggtaaaacagaaatgaccgtcaccttcatgcagtgtattgttttcagtaaggcatcctttaaacatagaaatacagttgtcccttggcttttgcaggtgggttacaggaggaatataaaataatggtgcattttcataaaatctaagcacactctcttgtatacttgaagccatctctaaatttcttataatactgaacacaaagcaaatgccgtgtaaatagttgttattctgtatcgctcagggaacgatgataagaaaaagagtctgtgcatgttcagtggaaacacaaccatgtgttgtgtatttcagaatattctgatctctagtgcttgaatccacacatgcagaactcatggatgcagagggctgactgtatacaataaattcctgattttaaaaagtcccagggtatgcctgtcagtctaggttcatttatatggcattaacaacaatatcccggctgggcgcagtggctcatgcctgtaatcccagcactttgggaggatgaggagggcaaatgacctgaggtcaggagttcgagaccaacctggccaacatgggtgaaaccctgtctctactaaaaataaaaaaattagccaggcatggtggcgggtgcctgtaatcccagctacttgggaggctgaggcaggagaattgcttgaacctgggaggcagagggtgcagtgagctgagattgtgccactgcactccagcctggacaacagagtgggattccctctcgaaaacaaaaaaccatatcccatatctcagtgacttaaaataaggcagcttccttctggttccaggttgggatggcagggaactctactcctgtagatactcagggatccagatgactgagtggccattagagcaaactaaattttggctcttcagggttccatcccaagtgacattcactccaatttcatcactgaaagcaagtcacaccaccacacttcattttgaaggcacctctatcctgagtccagaagtagagagaatgggagagatttggtgggaatgctcgtgaccagcacacaagaagaagcacatcagaattcaagcttctgaatgaggagacctcccctggtcggagtactcagacattgcctcctgcagggtattacatagaaacagttccgaatgactaaccaaagagtgggagtggagatggaaagcattgcaggctgagattgctacacgtgcaagagctctgaggtagaaaggactgtggctgctggagatatttcagaggggcaagtgagaatcgagacagagaaagaaccacagcctgggagacagaaataagagcttagccagagagacagcagatccttatagatgttgaacgatttcctgaaaatctaagaaagcatggtaaacgctttcatcacaaaaggaataagtccggtctgccttttggaaagaagagagaagttggaagagtaaatctggaaagacatttaggagtttggccattttctaggagaaaggtctgagagcagttacggctactggtggtgacacagggaggcagccgcagattccaggaacactgcacctcacacttagtgagatgggggcactggaggataagctgggaagcaaaactgcgagctcagcttcgggcacatgtttcagtgcctgcgtcattcccagaggaggtggaaaacaaacattgtgtcctggcgcttgcagaagacttgagctggaggcacaggcacaagagttatcagctgtgaatggccatcatgggctttgaatccaggagtttgaatcacggaaagcataggatggaaatataggaggattccaacctcctatatagctaaagtcagttagaagtggtcaaggaagcaaagaaaataacaacttagccagagagatagcagaataacccagagattttctggcccctgaagccaagggaaaagggcgtcaagagaaatggtagccatgctggatgtcaccaggagacatgagaaaggaagtgtgcctccagggctagtgacattaacatctcctgcaatagaagatcttgtcgatagaagaccccatcatgttagacaccaggtaaatagataggagaagtgaaaaacaggtgtagaaattgagaatgtttacataagttttctggaactatgttttagaaattagaagctggaggaagacaagaggtccaaggtacattaaaattataaatagatatgtacgtgtgtatgtgtgtgtgtcgatgtgtgagagacagatctgagttatattcaagatgctattggggaaaatttcatggatagtagctgaaaatgcagaaatagaaaatattctctaaataatgtctctgaaatagtaggaagagaggtacctagagcataggatagattaccgttttttttctttcttttttcttttctttctttcttttttttttttttttagatggagtctccctctgtcacccagactggagtgcaatggtgtgatcttggctcactgcaacctccgcctcccgagttcaagtgattctcctgtctcagcctcctgagtagctgggattacaggcgcctgccatcatgtgccggctaattttggtatttttagtagagatgtggtttcaccatatcggccaggttggtctcaaactcctgacctcaggtgatcagcccgcctctgcatcccaaactgctgggattacaggcgtgaggccaccacacccagccccgattacccttaagtaggaggtacattctcttccattgaaaaagagagagagcagagaatagatgcacaggcaagcagatctgtatccattttgttgtgggaagttgcttcctctctgatgttctctctctctctctctctctgtctctctctctctgtttttctctctcgtgcttcaagtagggaatgattagtgagtgatactgtttgctaagtagtaagaaaataaagaaggggaacacagaaagagtgtttcatagaaaaatgctggcaatgtctagagacatattgctcactggtttagtctccagtttcctctcttttttgctcctacctagatttccagtttaacagacctcaatcctggaagtctgtgtctatattttatattttaggtgagactacacataataatgccaaagagttcatcataaaatactagcctctttcagtaataaatatcaaagccctgtttctaagcattctgtggaattagggaaacaagtgatttaactatattaaaaaaaaaaaaagttaggctctagatttaacgttttcaacctcatttgatctagcaatattcaaggaaaggccatacaaattattttgcatgaaattaaaatgttgaactttttcacatgtcaaaaatgctttgatgatgcaaacttttcttagagattgcatatttgaaggaataaaaaggataaagttcaatcactgattttttttctctttttgtggtgaaagttgaacatgaacaatgcaggtacccattatctgtgctaaggcaaggcatacatacctgagagacctacagacttactgccatatggatcaactccgtgcacaatgggactctctgtgtcctgaagggacgagagctcagagggacatagtgacaaatgggaaagctacatgatgatgagactccccagttgagcacacagttgactacggccatgggagagagtgtgtgcaggtgggatgggagtacaggtgaagcttaggtaacacccgtacctcatcatcccctgtgcgtctgtgaaaccgcctttacaaaattatacctgaggaaattatgacagtgaaagaaaccagacctaaccaactccatcttgcttctaacctttaagctgtccttgttcattcctggacatagattgaattaatttgggaaggaattcaattcctggtttgactctgaaacaaaattgatcatggccctttcccgaaaagacccccttcttgcctggggaccagtctgtctttgcaggactaacaaattacctgtaagattagacattatggtttaggggtcatgcagcctctggttccaagtctgaacctccccaaattgctcctgggatcacatcactattgtaaaacctaacatcagtgcttgagatatgttgcagaccctgcacctggtggatcagctgacaccacccaaaccggtaatctggcccaaccagttctgccatcgcactcgggaacagcagacagcaagaaaaactcacttccgccccctgtgattccatctccaacctgaccaatgagcactaccggcttcccaagcccctgcccgccaaattatctttttttttttttctgagatggagtctggctctgtcgcccaggctggagtgcagtggcgcgatctctcctcactgcaagctccgcctcccgggttcacgccactctcctgcctcagcctcccgagtagctgggactacaggcgcccgccactatgcccagctaatttttggtatttttagtagagacggggtttcaccgtgttagccaggatggtctcgatctcctgacctcgtgatccgcccgcctcggccttccaaagtgctgggattacaggcgtgagccaccgcgcccggccgccaaattatctttaaaaacttgaatccctgaatgctggggagactgaattgagtcacaataaaactccggtctcccacacatctggctctgcgtgaattactctttctccattgcaattcccgtcttgataaatcggctctgtctgggcagcagaaaaggcgaacccactggtggttccgtctgtgtccttacctctgttttcaaaaacaacaagtgttccactactaaccagaaaccaacattccaccaaaaaattattccactcgtacaagcttggaaccagttagggagatttatacttaaatacaatttacatgtaagaagtgtatttagatttgggtttcggttctcgttgttgttccataccttggtaagcaagtttaaatccttgccggttttgcgaatggtcactataaaagtggatgagggtttcatgcgttgtgctcagcagggccgcggggagatccgtgccgctaaattgtccaatcatggggctggtgtggtaaggtccattttgaatttcaaggaagtcatgattagcttcggtagaaaaattcagaaactgaatatgtgcacctatggaaaaacatgcaaacttaatgaaagttcatatcaaaatgtataaaatcaatgctcataaaaagggactgaagtgttagcagtctccccagacaatccctctctgtgagacagaaccatgccgtggaggacggcattcactgtggatgacagcaaaccctggctccatcttacctctgccactttttgccgcatggtctttttccatgacactcacgtccagaagtcaatttgtttgtgaaatatgaatattaccagcaccgtaccacagagctacacaggtggaatccttaggtaacaactagcacacacgcactcggggatgattttgtccggtgacttttacaattatgacaatcttaaatatgaagttgtgatcatctgttacatcacccaaaagctaactgatagctttatcaaggaaaaacaacaacaacaacaacaattttggttttaaaacatgccacagagttttttttgtttttattttgtgtttgtctgtttattttgtctgtttgccttgtcccacagttctatgcaaccaactttaaaggtggcttttactaactggacggtcataccatagcacaagtttattagtttagcaagcggtcattttctattgtgttacgtgtgcaaaacaaattattgatgtttgtgagaaacccaatctaatcaaccgcaccataactctcacaattaaatctaacagcctggcacagttgagaataccaaaagactgttcaaatgaccagtatctctgatatcatactcatctgtgaattaaataaactatggctgataatttaaaaggaaacaataaaaataattgagagttatttgcattgtggcattttttttgaaaacttatttgactactatgtcttagatattctaactcatttaagcaatttatatagaactccaaagacattagtctttgcataagtccatgcagttaagctgggccgtaaaacctaaactgagccaactaacagcagttgtagagtgttattccagtataaaagaaagctttactctgcatggttcttctgtttttgatagatgagaactttaaaaaaatttttgcatctaatatatttcctagattgggaaaattaaagataacacctacttgggttttcctacttcattggaagtgcataaaaatattcacacaaacacatccactcaggtgtcaaaggaaaacacagttgtcagagggcagtactttgtaaaaaggaagaaaaaagtccaagtgaaaaattgtagggaggaaacacctaaaatctctcaacaaaatttaaagtcatacaagaaaaacaatttcattaattatggagaaacttggcagggagaagcaaaagggtaaatagtgccctgcttggtgggcatcacgtagggccaacagtatgcctggggtccgatttgccaaccaagtttgctcccagcacagtaatcatcaccgtgctcataatttacaggcgagcaaactaaggctctgaaatgttagatgttctgtctcatgtcacacgggaaatggcagagtgaagtttaaccccgcactaacggacaaaggcctcactttttctggtttggtatgccaatagactagacaagagctgacagtctcatgatggtaaaaatattccactcttcttggagaaaatcagtttgtattatgttcaacctagattgaaagaggatgaattaaaaaaaatagaacgtgaaaaactgcaggatgtggctgaggagacaaaatacagaagaaaaagaaagatctttaataatttaagcaaaatttagaattctttttagaatgagtaactagattcatatcacgttgtccaagtctatagaccggtactacatcgccagtcaagaaaggacctgtgatggtcttggccattctaacatcgtctgctgtatataatcaaggtggagcaactctttaaatttacaacatttctgcaaatattcaaaaatgtcaaatactgctgtttgttgaacaaccaccagtgagctattgtttctaaattccagaaaatatttttgtttaaaaggaactcagaagtgagaaaaaaagaaagaaaaaaagggagagaaagaggcaacaagggggggggggagggagggagggagaaggggtaagggagggagggggtccaggggctcctgtgtcccttggtttggagctgtctcctctgcctgctgtgacagctgcgctcctggactgcccagccagtggcacatccagatctgcttgtccacttcccactactgagctaaaaacacagtttggcggtatgcccacaaatctaataagaatgaatcttgttactaataagtaaactagagtaaagagttgtgtgtgtgtgtgtgcatgcatgcatttgtgtgtctgtgtgcacgtgtgtttgtgtgactgccttatgaacattgaatccatgtgctccacagagttttatagacattgctcacattaatcccaatcaggcggaatcaagaagctgacccgagagtaacaaaaaacaacctgctgaattgctggcacttctacgtatgtccagagtaccagacagaaggaaaaccggggccagattggaacacttaatattttatggtagggaaatggctgagaatgtgctcacttcagatgcgcatatgcagacttcagatatatttatccagaaacacattttgaaattcatgaaccggcacagtcacgaaacataacaacttgcaaggggatcagggtgcaaagaaatggaggacatccaacgtctcaaaagtacaggatctagtgaaagtggtttgttactgatttggaattcagtttgaaaaggaaatggaattatgacaattataatattgtgagcaaaattaccattttaagcaggataaattatacagccacatatcaaactacctaatacatatcagaaaatagaacagagcccagctctaatctggcttaaaatagaattatctagctatctaattttcagcaaattgcatccagtttgacattgtaaagcccaaataaaaggattaaaataagcataacctggttatccttctattgtctcagagagtactaaagcatatatattatttcaataacaataaaaaatctgaatacttacctttggtggaacttacccagcactgtcttatcccattgggattacatattgaaaattaagtgccagtgacaagtcacctgcacagagaatttttgcctttggcattgacaaaactttgaatagtaatgtgaccatgatctcagagttaaaccctagtttttagttgatagaacctgtgaatattacttcctctgttttgcaccttctgtgtgtaataaaatatagcaaaagtgttaatacctatggaatttattgaacattctaaagaaccttttatattgtccctatgtttctagaaagtctgatggcatggtaattttggagagcattgtgtgcactattagtgcagtagattttaagtataaaagataatggggtaaggcagacagaaagcttcattgcatttctgttaactgtgcccttagacactctcaagaaaacggagaccgaaatcctgagttggttgagctctgccagagcatcacaaaacaacaagccaagtctgtgaaaaggaaagaaaatggcacacaactatcaggtttagctactagataagtaaactagaatttggtttaactattaaaaacagcacttaaataataccctatttcatgcatttacaatacttcaaaatagccctatgggactgatatattatattccctttaaaaataaggaaacaagtttcaaaaacatttgagtatcttgtgcaatcattggtaggactaagatttctactcagctaaactcagagcctaaaattgtgagcaaccacagcttatgctgccaactgcctcagttcttttggctagagttcccttggtcattttgagggacaggctgtgtgggtcactgtcccgcagtaggtcactgtcggttactgaggcagggtatagaaaacagctgtttctggaatgagtaattaggaaagccaggtaagatgatttccacatgatgccaaaccagttaatcgcttttgcttatttaaattgtggctcgatccatgggaatgggctctgggagtagagttaatcaaaataattatttgactaaactggcaactgcttaactcctggattagacaatcgatcaggcaatcccatgcttatccagttgtatgggaagattcataatacccaataaaatcctcccaaggtgaaaaacatcccatatatttttcttcaagaaggggcaataacgtcttatattccggataagtgttattactcagagtaactggaggagcaacgcttactggtaggacagctgtgccctgagaatccaaatcccaaaactgtcaatcaaggaaacagatatgtatgttcagatactagagatacaatctgaagcctagaaattacatttaagaatgttttgcaagaacgattttttcttttttcttttgtaattcactttggagttttgatttgtcatgctgtttgtttcatactcaataatcttctatctctattttcaacttcccaaaatctcatgatttctacatttttacacgaaagcaacttttcttaaataagtaatatttgtaagaatcttgtgaaaacctttgtgcatttctcatcttatttagattgaaagtgctcttctataaattggagaaacgcttcctgaaggagtctgactccagcatccaaggaactggagctgcttcgggaagatgccaaattcatttcctacttcagctggggcactgagtcagaatttaggaaagagaccacgggaagctacattgtaacagcacaaccgccattgaggcttcctgcacacagtaaaatttgagcaccctggggggcagtcattttccttgttacttagtgttgcaagtttaagtagacacaaattactataaatctgacactctcttagggtctaaggcaatcaagtttcccataacgtctgtttcttgttgaaatttccagtgatacttcaaaggaaatattgtttaacacagtttcccaaacctctgaaaaccgaggaggggagaggcagagtagtgatagcaatgcaccatttgcacttacaggaggagctggttaactggttacttgcgtgaactacctatcacatatatgccttttctcagcattaaggaagacaaatcttctggctattcttttgcaacctgatcaccaagatcaccctaacagcattatcctggtaagatattttttgtgtgacgtcagttgaaatacctgtctaccttctcaatctccctgcttgtcccattaggaaataggggacccttttctgagttgtaaccacaggaaatgttccagaatcactttatggtttgggtgttaataggaagcaacatgagagatcaaaaaggggagaaatcataattacaagataattgtggtcacctctgctatattcccattttgttttacgtaaaaacttctggagtgagtgcttcatttgtaagtgcagatgtctgagcttaaaccccaaacttacttcctcaaaatttccaagggtgtgatctgatattttcttatgattccggagattctgagaagagcttgctgacaagaataaggcaaggttcagagaaacaaaaatgagctgtgcagtgctgtgggtataaattaggaattgaacaggagaatctgactcagaggaaatcattcacatgcggccgaagtgtggtttgacatttgaaaacaagactcatgacgctgctttaaaactcatgtgcatagaacggagacttcaagttctggtagtggatattacaagggagaagacgcagaaattaaagaaggccatgaatacatagaactaatttacttaaatgtttttcactataaaacaatgtggggttgaaagctaggtagtaaaattttctcagattctgcaaattgctcgaaaatgatttaagccctagaaagaactcctaccaggggcatcataattccaaatgttgaccacgttagaggacacatcgccactcacatgcctctcctcccaatttctcacttcgtatctattactgtttagaggttatagaatttatcacaggcaaacctggtgcgttactcaaatgtaatctataacaaattattctgaagcttacctacatctattctaaaaagctagggataatacttttcatgcctgtttgatttgagataaagtttcttttctcctcttctagatcctctttaaaccctcaggctatgcaatatccaatttttttaagatttacatcagtttaaagatatttcataagttatttttcatttcagtctttctttaaatagtttgtttaggtttatagatcccaaatatgaatttagacaatttggtttcattgaagttttttcccaaattattctctcgcacaatagtttataaataaaaaataaatacagaaatatactaaatgatacccttctcagaaatgataaaatagtaacattggaaaaataagttaagaaaatatttataccaattttattttattcataaatacaatgtttccagttagttttgagaagaaggtgacaaacatttggaagaataatacaaaatacaactgggtgactttcctatttgtttcacttttttgttgttgttgttgttgtttatcacgtgccaaaccctgcactaatcttctagccagaatttttgtttatttattcatttacttattgagacagagtctcgctctgtcaccaagctggagcgcagtggcgtgatcgtggctcactgcaacctccacctcccgggttcaagcgattctcttgcctcagcctcccaagtagttgggattacaagcaagtgccaccatgcccagctaagttttgtatttttagtagagacggcgtttcatcatgttggccaggatgatctcgatctcctgaccttgcgatccaccggccttcgcctcccaatagccagaattattataattaaccctcaccataaccttatgtgggtatttcaggtatagaaaggaggaaactggagcccctgtgccttaactcatttaaaaaaaccacacctccttcagggatagctgcagtttgcctcagatttctctcattctctgatgttaatgactataataatttgaccaacaaggctccggtccttaagagcgctagtgctgtgtaaactatcccgggttacacatacctctgaaagaattcttaacccctgactccaaagattagttcaataagttcatgtctccagatctccagggcaaggacgatgggcccagcttgggagaacagtggaagcaacgttgctgaaggtgattcccaggtctccgtttcatttagccctggcagaatcactgcctcatgctcagagagagtatgactgaaaaaaacaaaaccagcaaaccaagaaacccgggagaaacaggggctcctataataatccttccacagagtctctcccttccttgaccaccaccgtggcctcctacagatcactgggaggtgacggactccccaggccgtccccatcgagctgctcttccacagtcctcctcttttcttgtggaacagtcatgttggtcaactgcatttcccacgtccagcgcctgattgacctgtcgggccgtcattccgactgttcattccccggccactctctgctgagcaagtccaccctgactgctcactcctactgctactgccatcctgggcacagattctaaaagcagaagctttgaataaagtgtgtgatcttcttccagggcagttatttctatttatggttgtattcattcattcattcattcattcatcattcagctactatttagtacagaaatacccagctactctgcccgaggacattcactaagtacctaacttggtctacctaaagtgagtgctgtagagaaaatcacaagtagggagactcaaataaatgaactaaaatacgaaggaaaccaggaggcagacagggaaaggcgtgagaggggatcaaaatttcacaaagaccatgcatttctgaagagaggccagaaaaaggttctataatagtatacacaacaattaaatttatgaattatttaaggtgaataacctaaaatgttaataactagatattaaaaaaacaacttatttattaacctgaaaacaatgtaatatatagcaaaaatgtataaaacaatactatttcttgaaagttgttttatatttaaaaggagtcataacctttaaaaagccttcagaattatccagaagaaacaataaccattattgacttccagagatagattagaaaaagagctattataaataaagagattgataattgaattagggatgctatattttgtacttcgtatgcctactatatcatcattcggccaatttaatttgccttgaaaagagttgcatggcttaattgatttttcaaataagttttccactctcaaagttactctgccaaagctttatttaaatctgtacgccactttcaattacagatacagttatgccaacagaataaggcattttattctgcttaattctttccaagatggaaatgaaaaaaatgaacttttaggaattggtaacattttcacttaccatagccgatgggtaatgagatcctccaggtgcagtctaagttgttggggtaagaacctgggaagccggggctcaggatcacaccacccaaggtgctcagcgtccctccacaggttgctgttaagtggacaagatgtcagtcctgcaggtcctcactttctccctggaatctttgctccaacctgcttcactcaactatgctgagaaagagcaagtcttcggagttaattctgcccctaattacagcacacgatacaatgctgtgtgccttagttatttatgagctgtgctctccctcttgacagtgaactgctttagaataaagaccatttttcaagatccatcttctcctctcacactcaaaggctcccagtaaagatgagtccatgtaatgtttgcgtcacagtcaggcatcaaatggacttcagtatattagctgctactcattgagaggtagtattactccctattgattgattgctaactatgtggtacttactgtgcctagataaatacattgcatagattaactcacatagcaaccctgaaaggattaccattcccctcttacacatgaagaaaccaagcctggaagagatgaagaaatttgcctaaagtgacatgcctggtaaacagtacaaccagaaggtcattccagctgcgtctggttccagtacccaagtttcagccaccacacatgactgtcagatagcttttcaatttcggaaggcagctaactgcaaccactttctccccaggaaatcttatgctgtgagagagggtgaaataagttcatgcatcttgccttatcttggcgactcacatgttttgctactgtatctgaggtttgactacaaagagacacaactgattttacaacaaacatgcccagtgatacaagacgaagcatttgaagttccaatctttgatcatttgtagcctattaaaataatttcttatattccaaaattaatgcaaatgatgccacttcttttcaggaagcccaaaggaaatggctttattctaacaatgctctcattatgcaaaatgttttaaacaaaatattttctggaagccctcttttagaggccccctaggacctgtggtgaagcctttttcttttttaatcatcatcaagactgaaacaacttatttgtaatttgagaaatagctaaaacttaagtctagtgaatatggtgattgctcaagccagggcaccatattctggatttcaaacattgtataagttgaaaaatgtgagctacaaacatttaaaagtatatttttgtggtgtgagtcataattctggaaaagtcttggacaccatcaactgtgttgctatttaaagtataacctctcaaggcgacttctttgtggcagagactaggcatttgcaaggccaggctcccatgtgcactttgtccatgcagctgctgaatgtgcggaagacacaccagcaaatctgagtggcatgcctacatacatttagcagtaacaccctttcccttagggctcgtgggacctgcagtgacagtagatgtgtatatccaactgtcagaggtgttaaaccagaacaactccacctggaataggagctggataaaacaaggctgaaacgtactgggctgcattcccagatggtgaaggctttctaagtcacaggatgagagagaaggtcagtacaaaatacaggtcacaaataccttgctgacaaaacaggctgcagtaaagaaaccggctaaacccaccaaagccaagatggccatgagtgtgacctctggttgtcctcactgctacactcccaccagcaccaagacagtttacaaatgccacggcaacgtcaggaacttaccctctatggtctaaaaaggggaggcatgaataacccaccgcttgtttagcatatcatcaagaaacaaccataaaaatgggcaaccagcagccctcggggctgctctgtctatggagtaaccattcttttgttcctttactttcttaataaacttgctttcactttactctacggattcgtcctgaattctttcttgcacaagatccaagaaccctctcctggggtgtggatcacaacccctttcctgtaacacaactacagggaagacacgaatgaaaaaggccgaatcaatgacaaaaaaaggaaaacaacagaaccagtaaatgtggtattactaaaaagttccttttgattttagcatgattttcacacacacatgcagagggaaattataaaatacaaacactcatacatatcttcagctgaggactgaggcagccctgcaggaggggctggcccaggacctcagcgtagacagcatcatcaacacggatgtctgtgtcccacacagaccaactctctgtgtgatgggaaactgatcatgggcctgaccactgggttcatctcctgtcaaacatgcatcaatcacctaattacttgagagcttagttaaaaccacggtaatcctttgtttttgatgttgcttatctagaaaactacaagtcaatagataagcgtaaaaacagagctcccaaaagacgcatatccatcttttcttcctttgtaacttttttttaagacagagtcttgccctgtcacccaggctggactgcagtggtgcaatctcagctcactgcaacctccgcctccctggttcaagtgattctcctgcctcagcctcccgagtagctgggattacaggcgcccacaactgcgactacgcctggctaatttttgtatttttagtagagatggggtttcaccatgttggtcaggctggtctcgaactcctgacctcaggtgatccacctgcctcggcctcccgaagtgaggggattacaggcctgagccactgtgcccagccctttgtgacattttaaggcgactgggcttgccatgtcttagattggttcagtgtccatctctgtgtggtcatcaagttgcagactgacttcctgcctcctgcctgggaagctccctccatgccagaccctttcttataggtaaatagcatatttagagttattggtaaatgtggtttttgtaaagggaaaggagtttatttttataaaatggctagagaccttatattttactggatttatacatcttattttgtgtgaattcttggttttggcgggagaaagaatatacagaatttttactgaaggacacagacacaccatgctgaagagccctgcggtgcagtgagacagggaggtcctgggccacctgctgtgacatgaacttcacccagctgtagagccctagaaaactgcgagaccattctggggcttgttataaatattcaaaacagtcaatactggttaaattctgagaacactgcttgatatattaacctctagagaagtggttttatatacattctcttcattagtacttttatttttcaaaattaggtcatgggatttccaggagctcttaagtaaaatattatctctctatggacttctcctcttacaattccccagtttggagtaatctaaagctaacagctacaaaaaaccttttaatcactagaatctgtctttgagatttatcatgggtcatgtgtgagtttttaaaacaatgaaaaaacttgtataccctgtaaagaattacagaagttgacataacttaaacatgtgctaatatttacgatgttaagtaaaagagaaaagcctattatattttgcaaatataagttaattctttgaataaaacatcccattatgtaatacaaagtgacagcaaaggcatattatttgagtctatgtctgcttagaattgatttcattgtgaagtttaaaaaatttcaattcctgacttttagggaaggctcttcatttaaaaataaataggcagattgatgttctgtatgaatcaaaggcagttttaattgtttcgttttttaaattttttaattttttccttccaaatcaaggctgggattttttttttttttttttttttttttgagacagaatctcgctctgtcacccaggatggagtgcagtggcgcgatcttggctcactgcaagctccgcctcccaggttcacgccattctcctgcctcagcctcccgagtagctgagactacagatggtcgccaccacgcccagctaattttttgtatttttagtagagacgggattttaccgtgttagccaggatggtctcgatctcctgacttcgtgatccactcgcctcagcctcccaaagtgctgggattacaggcgtgagccaccgcgcccggtcaaggctgggattttaaacgtctgtaaaagtagctcaatgtttttagctgacatgttaatctagacatttatttttaccaagacatagcttttaaaaataagatactgtcctctaaggtatatttttcacttgtaagcaactatgatgtagtgaacataacataaacagacgttctctcctggatgagcctatcataaaggctgaagttttttgttttacaggtttcgtgcagttttattttcctctgtacacaatttcacctgcatcccatgcaaggcagttaaattgtgtattactaaaaaccattgaatacctaaatttatttgagatgtggggaaattaggctgtcagaagaatgtgtaacagacagtaattacctcgctttacttgtgggtgcccacaccacactacgccgaaatgaattctaaacagaatgtgaatagctcccaggacaattttaaggctattctgtggcctttaaaatagctaatgttcatccatatagagttgaccactttctcctaaaacaccatttggcagtatggcatgtttgaggctgactgtctggacataaatgggttctgagcacacccccagcaatacttgagtgttcgaagactgtggggaacaataaagacagcaccccagaagtgtgactgttataatgatccaggctctctgatactcattcattccctagccattctttaattgaaattcttgagtgtctaccatgtgctgaagatacagaggtgagtattgcaagtctctgtcaccaaagcctttggggattgtagaagggcaaattaaagagcaatatcattacaactctgcaggaagtaaagtcaggcacatggtggtggtagcccagggtagagatgactcactgcacctgcaggtgggagctcagagagcattgaggaggggacactctctccagtgcaaaattcaagagggtgcctaaaccctccaataaatattttaatgcaatatttggaaaaaataaaaagaaaggcagaaaatctatgatgaacaaaatatgaaaattttaaataaagacaagatcagtactgccgatgtttccttttgcctctttcctgtgataaagttggagtatggctgaatatgggagctgtaggttaggattccatggagacgataatttaggaggggactgtgccatcttaaagatggggcattggagctaagaatcacaggggaggatacgctcaggtggaaggggtgacaggagtgagaagtcacttggatttagggagtgagggagaaatttaaggtaatacccagatttgttgtttagacaaaaaaaaaaaaaaaaaaaaaagcaggatactgctaatagcattcgcagaggaagtagatccaggagaacaacaataggtttggagaagccgatcactttgtgggttgcgggtaaggagtgtcaagtaactgaccatgatcctactgagacagtacctgcaaggttgaatggttgcctgagctacaggtaaaggtttctgagttgggctacaacaaataggtgatgggtgaagctgggggcctgaatgatggggagcaaagggcaccctgacatcaccaacctttgtactgagggacttgtgaccaccaccttcaatgcccctggaatcattaaactcccatcacattacctatgctaacagtttagggagtctcaagccattaaatacagctctggaaagctttttcctaaagaagccggctgattgtgcccccaggagcgcatccacaagatagtcaccaggctgtttccaacatgaaatactccatcactccatcagtaatctgtcattctgaattttcttcctgggaacttgttttttctgaggctaaaggtctatacagaaaactccccagactttcagaccagctgcattccttctttgccacaaattaacaaactggccttctgacacacatgtcgttttggtgcagggccgtgagcgggcagtcttgcctctggtctgtgcgggctgacccagacacactgagaagacggagttgctgcatccagtggggaaggtgcaggttaaacgcatcattctgctctactgcattatgtgctattagtatataacacgtgttttgaaattaagaaatttagaagtgcattctttgaccccaagagtagagcaggcatgttcttcccagtgtgtgcgcagcagcagagttacagaaggtgcatccttaccaatgcacaggggagacggatagttccaacggcgaacggtccctggcatacaggaaatgtgggaacggccctgtttaaaagaaaacaaaagaaaatacatataactaaaaacagagtatttaaggattaaatgtttgagaatatctgcattttttcctttcttgttttaattataaatatttgaaaattcaaaaattgtgaaatctgtttttagtaatgattattagtgagtcacattttgaaccaacatagaaaagtatccattttcaccgtgtttctttctactaaaaacaaaatcttgcaatgtccttttgaccagaccataattcgactcagctcctttcttgatacttaagagtactgaattgggcaaaatatgcattttttttttcattcaccagaatttacagcttttggcctaagaagctgaaaacaattagaaagtactaggtggtgattaaaaggccaaaatgtcagcaatacaaagtctgcttatggagaggtagcttcggtggttgtctgtgcttccgcgtcacatgactaccagggttcagcaaagcactgggtcgtttctttatcacagaacggagacttcacattcattttctcactagacatcctcacacatcacaacaacctgcctgcaatgaaattaaccctcatcactcagggtctctttaccctgtaaatacatgaattttccactttctactttaaaaaatctgttccagtctttctcaatgaaaaaaaaaacaaacagtagagggttaaattcaaagatgttttgtgctaacatctctttctcagtaaaagagaggtgatccatgagacctctgtgtgcggcctatttttatatttttcctgatcgtgactcggtggccttatcagccaggtttgcttatctcataaatttccatttgccacccacaattggcatagaggcaattgaaaaacaatatctaatgtatgttaaataattccagccacactgggaacgcatcaaacaagcgtttgcactaatgcagttatcaatggcaaaccgattccctaagctctcaaacatttcatactcaatccacctgccacaaaactaactttctcatacctcttgatatttttaaaagtagttacagtaaagaagaccatatttaattttaaagaagatactccaggtaattttgtgctgccggcattgacactctctgtatccccattcttcgacgcattaaattatccttacaaatttccttctgaaatagggaaaaacatagagttcaaaagtctcaaaaaattttcatcagagactaccaataaaatggtcatttattaccaatctaggtaatattctgctattgattttgttataaacgtttccgatgagcgattctagctacaagttttctaataaatcaaaacaagataggaccctgtgcatttatttactagtttttacaccaatgggaattttcttttttatgtttaaaaagaccattaaaacaagttgagagaagatggaagtcatacatcattccaatattcaggatttactttcagcgtgtgatgtcatggcagcccctgaatcacactaggcatatgtatttatagacactcacgtgtgaactatgcaaggaacaatgcttttcatgactaatatgtaattgatgcatctgttgttccaaatatattaaagtgttagtaaaattgtcagttgttagcaattcaaaaaaaatccagaatccttttttgctcatgtgaatgacaaacagcagcttgcaaactcaaagcttggcattgtttgtaacgaagaaaagaaacacagcttagtttgcatttgaaaaacagagctaataaacggtctgctgggactgtgcagaagtgcatccacaggcctgtgtccctaagcagcatattcaataatccattataagaaatttctttggtaaagaattatttctattttcttctctgagagctgtcataatatcatttataaaagaacggcaacagaatctgcaaagtctcaccatcaggtagaaagaagaggaacatcgatgagcaagagcaaatattacagtttgggaatttgagggagaatggaggaaacatgatatttacctgatttcaggcaattataaagcaagccccgaaaaaggcacaaaaacagcatgtcagtacagattgaggtgtccctctaaatgagatccttgagatatgaaagacaattcttttctttttttctttttttaagatagggtcttgctctgtcacctaggctggagtgcagtggtgcaatctcggctcactgcaacctccgcctcctgtttcaagcgatccacccacctcagcctcccaggtaactgggactaaaggaatgcgccgccatgcccagctcatttttgtattttttgtagagatggtgtctcactgtgttgcccaggctggtctcaaactcctcgattcaagcaatcctctgactttggaatcccaaagtgctgggattacaggtgtgagccactgcaaccggcctaggataattctttctgacatatcaggtggatcaggaacgttgtgtcctaaagattcagcctgaatagcttgagtgtgtttggttacaaacttactgaggtatcccaactttcaggagtccttactcaccagtttccactacagagactctcgctctgcctccaatctttttgcagagttacaattattgtggtacccaccaagatggtgttataatgtaagtggtaggtttgttcttacgaaggtggctttatacattgatactggtttctaataacagctacaatagttttcctatactaaagtgtgccagttatttcacagatattttctctaagctgaaagcatacatcacatggtacccatgtcccacggttgatcaggagaagtgagattttgtatataaagcacttggtaatgcacccctttagcattcagcgtttgccagcccctgttcttgctcttaacttgattcactgctacacaatatttaccccaatgtacatgcagaaactgaattccacacagtgctgttatttcacggctgtagtgttgcaactctgcatataagaacatagctaaacaattttcctttaaaacctatcagtgtcagtgtcattataaacatacagctaaaatattctattacctgaattaactgaagagctggaatgtcaatcgacctatatatttctcctgactttagaatatacatgttttgattatcaatttttattgctggcagagagaattatataataattatgctaagtgatagacactattctgagagtaggcttactcatggttaaactagaaaatattaataataaataataagagaaaaatgactactcttgccatacattagattataaatcattcatcaaaacttttatataaaaaactcttggctggacacagtagctcacacctgtaatcccagcactttgggaggccaaggcaggtggatcacctgaggtcaggagttcgagaccagcttggccaacatggtgaaaccccatctctactaaaaatacaaaaagtagccgggtgtggtggcaggtgcctgtaataccagctacttgggaggctgaggcaggagaattgtttgaatctgggaggcggagcttgcagtgagccaagatcaagatcatgccgctgcactccagcctgggtgacagagcgagactccctctcagaaaaaaaaaaaaaaaaaaaaaccctctttatatagaagatagtaaaagttcattgaaaaacttctacttaatagtttttaaaacttacttaaatgttttattttggtgccttatctacctagcccaaagagggcattaatgatgacttatactgaatgatgagaacagtttgcagggtagcaggtgcacatacagaagcagattcaattactggctgccaggagaggactttcaaagagacagtgttgatattttgcccctagaatgctctgtgcatagttattgggaacgcatatattttgaaataaaacaattgtgaaaaatacaatgcttagctttgaaagagtacattatcacttaaaagctgtttccaaatggtgacgaagatgaccaacatgcatgatttaatatgaatagtatgattcacaaactgagtgaggaaaacatgggtacaaagtgagggctttggctttaagagagctgcacaaagatgaccatgtgtatgttattcctgagcactgagaagaaggatacctgcagggtgtacccgggctcgcactggaaggagagcacgtcgttcaccatgtaccgatctccgattttgatgctgttgctggggagggctggttcttggcatgcagcaagacctacagctagaaatgcaaagacaaatgctagaaattatatgatgtaaacaatattcttatcatttgaataaccaaagtttatttctattgctctccttctgtagaaatgaacaaagacttcaactctttctcttgttattctaccaagaagactttgagtacctttaaatcagagctatgagttaattgttaaaaattaaattatcttattttcattacacaatgaatcaaggctttgatttcaataacaaaatttgttacttccacattgagtatagaagatcccaacttcaatatatacatattgtaaaaagtctcttcaaaaattgtgtttttatgatatgtaaaactccaggatattgccctcttacttttgtttttcaagcatacttagcagtctttatataaaaaaattatgtgtgaatcttggaattctgttcttctacaaaaaaaaaaaagagaaaaaatattttacattcaatctctctctctctttctcttaaagacaacaaaaaaggatctcatgaacagtctgttcttcattaaacagaaacaatatttacagaacctaaagctgtaatcctgcactttcctagatgaattgcattcagttaagacactcacagatttttttaaaggcatcatataatactggaactcagcctaaggtatcagataaacgaattctaaaacactgaaacctctctgtataaatccttatcataagaataaacaagatatgcagctaccatattttgtagaatcaaaaattgattttggtttatcaaaaggtacaaactttccattatgagatgagcaagttctgaggatctaaagtgtacagcattggatgttgatggatatattaatttcatttaattaaaaaatgcatttgaaatggtgctaagggcttgttgaatacaaataatttattccattattctaacatgtcatgaagaaatagtggagaaaggcttctcttggtaggccagcttcacattctttatggggccttggattcgcactttagttcttgtacttcacaacaacaggagagaacttatcagattacttaattgactgggactctcagaaaggaagctggggtggaggaggtgagtaggactttagttaatcagaaggaaaaaaaaaaaaacagcaggagaacaggtccactcaggggcagtcccatgctagtggtccccaggcacagagaggacgcagctgcctgcactgcccatgggccggtccccacgcggggctctgccctgaagccagtcagctttccctgcttcatctgcttcatgcctgctccacgtctcaccagacttcactttccgaaaaagaaaaaaaaaaaaaagcacaagtgcaaagataaaatgattaagaacttcaaaaccagcggccaccaagcacgagacccagtgtgactcacgcagtgcccactcaggaagcagctgtgggtcgaagctacagagtcagcagcaaggtcaagggaaaccctgggtcatccctgcatggctgtcactgtgccagacgcattatactaactccagtccccaccagaccctcatagccaggctccttgtgtctgatattaaacaaaaggcaaagtgaagtcagcctggctgcagagttgcacaggtcggtgtgtccatgtatatgagcctgatctctcatgcgtgttgagctaacagtacacttcctccactgcctggatgatggagcctgtaagagatgtgttcaccagtgccgaccccagatctgctgagtcggaggcaacaccatcccaaatccttcaccagcttgccgagtgtttccccaaatctgagagggcgaaatggagagagagaagtgtcttcatcttacagtaccgtgattgttcatttgagaatcccatgctacggaatccaggtcagaatggaaagcagtggtacataaactagttgagtaatgtcaggccacagaacccattgattctgtatagaatgagtaggtaggaggagtgccacgaactttttctaagttgaaatagatttttccttaaatggctgcatttttagaagtatgaagtaccataagcattaagcagcaatatactttattcctaccacagattttcaagccattggggctttacatagaagataaaactgctaaatatgaaaaaatatatacaatcacttaggcctttaacttcttttactaatgtaagtctaaaatcttttgttttaactttagaacatagattactacatttaaatcccatcttttctttcctaccacatattagcaaggtcatctaccatacatctctgagttttttatttccccctgaaaaaaatgtatacttaaaatactaggtaaattttaactacagtcgggaatactaaaaatctactttagggtgatactaagtcatcgtcattctgagatacttcaaggacacaccaggtgacacagaacgaagaatatcgattacaaaaacaggttccaaatatcaagacaaaatattttgaaatgaaaagtgaaacattacaattcatattaaaggccagttactaaacttgcatgttttacccataagatatgatgtgtttttattatatattgatttatatgcagttattacatattgatttattgtcattttctcctttcttgaattctattcaattgatcctctggggaaaaaaaaattgcatttatatctggcctttaaggaattataattaatttataattaattataaataaatgaataaaataaaaacacacaaaaataccattttgaccggtgtttaacatggccagactcaggaagcagttctatgcagagcacaatatttgaaatgtaaaaagaaccatcttttcttctcccttcgccagtgtcactacacacccagtatatgttagaagctaagaatgcaaagagattaatacctggtatgtgtaagaatattttttatcaatattatttaaacctgctactatattaaaaggagtgacaaagtgcataagcgattgatatgatcagagcccaagtattttccatactttgcatttctctcataaagatgcactaattcgcttgcaacactaggagtaattcaagtcatcatgagaacagtggtttttaatttttattttttatttatttatttttttatttatttttgagacagagtctcactctgtcgcccaggctggagtgcagtggtgtgatctcagctcacttcaagctccacctcccgggttcatgccattctcctgcctcagcctcctgagtagctgggactacaggtgcccgccaccacgcccggctaatttttttatatttttagaaaagacggggtttcaccatgttagccagggtggtcttgaactcctgacctcgtgatccacctgcctcagcctccccaaagtgctgggagaacggtggttttttgttggtaaaggtgtgtcagatgcaggggcagaagacagctaggcttgacatacaggacagtgatggggatgttaaaatagggcaagagtggagcacaggagaactctgagctttttgggaatgcggtgaaaccttctgagagagaaatcaaccatctacagaatggctccgaaacagaaaagccagaaaggaggtgggggaatgtagacaataacatagaagacaaggcagtgaaccttctgacctttaggggacagaaggtcgtctattgatgaatttttggtacagaaaaaattagactatttatatttattcactgtattagtcaaaatgtgaaacaaatatgatatgataggaagtaggcagggtggtgtttggtaataaatatgaactgtgtagaaggtaagcttgagtctatacatgtatacataattctctttttagacttttaaaaagaatcatgtactttaaaaaaaaagaattttaaaaagaattatgtatgataattcttatcacatcatgtctgttaggctgggcatggtgactcatgcctgtaatccaggcactttgggaggccgaggcaggcagatcacctgaggtcaggtgttcaagaccagcctggccaacatggccctgaaaccccgtctcgaccacaaatgcaaaaagtacccgggcgtggtggtgtgcacctgtagtcccacctactcgggaggctgaggcaggagaatcgcttgaacctgggaagcagaggttgcagtgagccaaggtcacaccactgcactccagcctgggcaacagagcgagactccatctcaaaaaaataaaataaaaaataaaaagagaatgctaatcaacaagtctgcctttcctgaagtgttttagaagaacgatgtttgcattgattgaaagtgatctctcatattgtcaagccaggggtagcagtatcatataaataatgggcaaacctatagaaatagacatttataagtatttatatagacacaaaacataggtatctaggaagacatatacaaataaaaagaattatttattcttaaggcagactaaaaagaactcacaaaacgtaactatgataggaaaattctagattaattttccagaagcagagatatctgggaaaaagtaagctgtcttattgtttaggaaaattttcaagagaaataatttgtacttctttcaaatcacagcatacatatgcttcataccataaatgataatatatcatatggggtgaagcaatgcttctttaaaaggtggttcacagggcggggcacagtggctcacgcctgtcatcccagcactttgggaggccaaggcaggtggatcacaaggtcaagagttccagagcagcctggtcaacatggtgaaaccccgtctctactaagaatacaaaaattagccaggcgtggtggcatgtgcctgtaatcgcaggtacttgggaggctgaggcaggagaagtgcttgaacccaggaggcggaggttgcagtgagccgagatcgcacactgcactccagcctgagtgacagagcaagactccaacttggaaaaagaaaaaaaaaaaaaaaaaaggtggttcacaaactattaggttggctatcacttttaatggcaaaaaccacaattatttttgtgccaacctaatacatgactctgaatgcccaggtgccctgattaaatgtgaagacaacataaaggtaattcttgtgcaatctacacatttaaaaacacttaaacaagaaagaacaaaacgcaggcattgggaaaggaggtgggtcttatgtactgtagtgttttatacaatattatccactgatacattttgtgttcaattccaatgttaaaatttggacatttacaaagatgcttctatgtaaaattgcaattagatgtagaatgtagcaagagaagtttttaaaccccatgaatccagcctatgaaagcaaagaatctaaaacacagccattaagaagatgagtgtcctaatttgaccaaaaacactttaatggcttcacctaccactgatcataaaacgtgagcattaagaatcagaatataacaatcagcctcatcaggtccctggaatttattgtagccatttttctaaatccatcaggcaaaattctgagaatagtttgcttaaatcttccagataaaaatgattttagaacacatgataaacatgcaattttaatcaaatacttaaaacaggacaaatgggacttttgtagatattatgaactgaaatgaccttgggcaattttcctcaactgtgcatgactggcagagtgtaaggttttcaaacatcacaattagaaaaaaaaaaaaaagatatttcaaactagagagctcaaaacaaaaaagttgataagcagagagtgagggaagcagacccatgtgaagagattaatagaggagtagcatgaaacagggtcaagaaatcaaaatacaggcgcatacagacacctgagtattcaacgcccaggtagaccatgaacactatgtggaacgtaagtggttattctctaattttgaaaagacaacaacttgttggctgtagtgtttattgtaattgactacataattattctctggcacacgacacacagatgaaaattcctctttttctagatgcgcacaggtatggcacaccctaacacagaggtgctgctcgttatttttgttaactcttaattcgaaaaatcgcattaaagttgagataatgtgctggaacataggggaagaaagaaatcaagtcacccaaggagacatcatgtgagcctgacaatggaggaagtaaatgtcaaatgccatgattatagacagctataaatgtggacctctgcacccagacttctatgtcacagtgtgtaaggagtcagtaagtcttcatcacacacacacacacacacacaaatatatatatatatggaaaacgccattaataacatagtaccttatgaaaagaaaagaaactgttttatttatcatctgggaaatttagattgtagaggtaaaaagattttgtctcatctgtaaactgttggcaggtttgacacatatcttaaatgctatttctattatttccacttgttacatcctgcagtctcttcaaagcataaaggagtgcatgtctggtgacaagggaagtgacaaaatacctttaggggaagtaaaatgttctctctctctctctctcaggggctcacaaattatattagcattttactggtgcagagaaactctgcagtgatgaactctcatcaagtttatttaatacatggtttccaaaatttctctggtcacaggactattttggtctacgtaccacccaccaacaacctggaccagtatcctcattcatgggcagatggtaagtaatgtattcaaggtcataagccaggaaatgacatagcctctgcattacacatgtgcaggaatcatgcatctcagtgaattacagactccaccccaaacagtacagccctgtttacatcctaggagaaaccagaggagacaagtttcaggactttggatttggcattgattttttgataggagaccacagtcacaggtaacaaaagcaaaaatatacaaatgtgactacatcaaacatgaaaaagaaaacaatggagtgaaaagtctacattctgctgctaagtgaaataagccagtatcaaaaaaaagacaaatattgtatgattccactcatataaactatctctagtagtcgaaatcatagaaaaaaaaaaggaaatgtggttgcctagggctaggagtagcaaacagacagaattagtgtttaatgagtgcagagttttgcaagatgtgaacattgtagagattggctacaaaacaatgtgcatatacttaataccactgaactgtacgcttaacaatagttaacatgatgtcatgttatttatatttttatcacaatagaaaggactgaggagcccgctgagtctagagctagaaatatagcacaagttgaacaaggcacctgtgagatatagcacggtttcttttcaaatagcatgctcagcttcttattctctaattccaagtaccccccactttcttctttctggtgtcactacatgcccagacatgccacagccccagctcacattcctttcctgatgtgagaatgggctggctctctagtcctctgtggatgaccccttcctcctctcccctctctcccatcacacgcccacctcatctaagaaagtttaaatgtttagccaactgagtctaaattgtgcggcctgaccccagccaatggggaaaggacacaagtgcaggagtcgcgttaggcataaaagcttctactctcctttgcggcgctgctgtggcagccagccctgctagaagcacccttctgcgcaaaagtaaatttgctttgctgagaaatcctgtttgagtgctcatttttctttacaactccgagttttatttctttttattgtattttatttttttttgagacggagtctcgctctgtggcccaggctggagtgcagtggtgtgatcttggctcactgcaagctccgcctcccgggttcacaccattctcccgcctcagcctcccgagtagctgggactacaggcgcctaccaccatacctggctaattgttttgtatttttagtagagacggggtttcactgtgttagccaggatggtctcgatctcctgaccttgtcatccgcccgcctcggcctcccaaagtgctgggattacaggcgtgagccaccgtgcccggcccgagctttatttctaacagcacctctaatgtgtgctttaccctcccatagcacagaatatactgcattttaagtcttttgtttacagctctctcattctgtagcatgagctcctaaagattgatcttgaatggccattgtgaatttaatttttaattaatccatggatcatgcacaactgtaggaaatacaaagcagttcataaatatgtgaagatcaaaaattgttcacactttaaaatagtgaactgtgtaagtttgtatttaaaatggactattgaaaacaagatatggtcacagaatctacccctgatttctttaaagcattttcccactgattggacattattacctaataattacatcacatgaaaagaaacgagtcaacacacttgggtgatgaactagttgccacatgatttagaaatgccataataaagcgggcacacaatgttgaaccactgaaggatttttagccggatataattaatgatctgctcaaagtgacattttggaataaatctgagcatggtgttgtgttgaaaaaagtcaaggacagaaagatcacttgaaatttatgattatagttcatgagaatgacaagatttggggaaacagatattttaaaatgagaaataaacaagtgccccaatcagatagtgttaaaaaggcttgaatgccaattatagatcctttataaagtatcgcatgacttcctggtgaactgtgatagaagcactgggaaagaaagcttctacttcatttttacttattcaacaggaagtaaagaatagacaacctggtgacagaaagtggggggactccaagcagcccagcctgatttccacttcaaatactatttccctttttaacactcaaaactttactcaccacccatctcaatcccactgacatgtctaaagtccactcccctgtgtctagagccttgatcaaaagtatgacaggactgaggttttcataaatgatgagttggtggttggctaagtcacagagccactagtcattacttattccatgtctagactctttattccctagttacttaccatgaaacatttgcaagacctactgtagaacagagaattctttcaagttttaacatccaagacataaatttggtagaaaaacatcatgaattctaaagtgagtaagaatatcctgaaaccaaaggaattatttaaaaaaatagaataatcataattttcaagtgagcacaacttgtcaatgagacaatatacttctatatctagctctctattgaaatacatgctttgtagtatcatcctttagatttatccattatttgggaatagaggatataagtgtgctcagatagtgccagtttaatacttgttaaatagtttgcatcctgtgtctctatatttgggttcagaaacccactgtgactcaacagttttccctttctgtagcatgcttctgtttccaaaggctagacttacctaaatgatattatatttaatgaaagtaaactcactcaaaaactaaaggatctacaaaatcctgagaattcccttatgcagtaaatcgagctccttgcctgtctcagaaccatgtaaaatcaatgacttccaattattcttagaataaatcctgggctacaacgtactgcgcactgtggctcttgccccctttttcaaccttctttccttttcttctttgtcttccttttctgactgctcacagcccttccttgttctacatttttgtttgttttgtttcacaaatgtgctgggttcttttccacctggggtctctgtattgatattttgctttggctacagcgtttttttcctaagtgtttttatggctgactaatgctcattttttttctagggatacttttaatctgaggcattgctgtcatctgcatctcagaaccccgccaatttgcttcaaggtgcttatcataacctataaccagatttaggtgttttctttctaattgtgcccccacctcaagaatttaaatttgaaattagcagagaccacattgatcttgttgtctggttgtgactctacttacagagtcaagagggcagggcgagacatgtgagtggagtgtgtataattggtggtgcacgtagggaacctacaggacacttaaggggggcagagaaggggaatggagaaagaatcaccctcaggggaggtgggaggaaggcccacatgcactctgtgaaggtcattcctaaagaaaaacaaaccaaacatcgtctcccatgaggcacaagggcagttgaacccaatggcaattgtcagtttccattgaaaccctttcccacatgggcaacattctaaaacaacagtggagtgagaagcggcaatatttatctcatgattgatgattttctgaagcaataagcaggaggtcagcttggaagtacgtgacgttactgataggacctaccactgaaataactgaggtaatcctaagtggctgtcccaagaagtgattgtaggataagtccacccctacccctgccttgtcaaatacattagaacttgaaactccaaagacttgtggaggacaacttgatttcaatcactttatttaggaaggaagtcaactgaagcaccatgtgattacgtaatttatttggcacctgtcccttacactgagtaattgttaaaacgccaaaatatcaccagtaggagtaaaattttaatctgttattagttttttgtgttacactcaacacacaaataaatattgaatgcctaaagtaatattgtagaagtgacttcacattcccagacgaggctctggaattctctgtgatgtaagacagaagccagaatttacattgttttagatatttccatggtccttggtgcacttagaacagtagggatgagagagacatgaataatctttgattgatattaatgaaagcaattttaataggacgcaggaatgcattgtttgtggccaaactgtgaagttgaaggtgggtcttaggaaaattttttgaaatgaatatgtggaaaaagatcttatggagtaattaatgtagaaataaatgcagtaagtgtcttaacatgaggcaatgaagattagttattacactattggatgaatgctggtttatatggtccttcctctgttggaggtagtaagctctcgtctcagtgcacagaatgaaatctctgtaaacacactcgctatattggagttctgctttctctatttatcatgtttcctgtgatgttactcatgttcaccaaaattccaattaagaactctcctcagtagtgttaatgtaatattaaagtgccattaaagcatgtattaataatttgaatgtgcttataaggattattgtaattataggggctaatccaagttatctgtattcaattatggcaacgtcctgccaaaaatgttgagtatgtttcatttcaaaggacataaggcattttccagaattttaatcctcatttagatacttccttctaagtacctgttttgagatgaggaaatgaaatggagctcatacatcagtgaaaacaagaattaaggaagtattttaatggcacattcataagaaacgtgacttcacagtaatattctattgaccagtgtaatcatcagcacagcgaactgcagaaattaattcagttagttatattatgttcccaaaattatatcagaaattgagacagagtccaggcacagtggctcaagcctgtaatcccagcactttgggaggctgaggtgcaaagatggcttaagctcaggagttggagactagcctgggcaacatggtgaaagcctgtatctattaagaatacaaaaaattagctgggtgtggtggcatttgccttcagtcccagctactccaaaggctgaggtgggaggattgcttgaacccaagaggttgagactgaagtgagctgagatcatgccactgcactccagcctgggccagagtgagattctgtctcaaaaaacaaacaataaacaaactataaaaattgagacataaagatcacttctatattttctagaaaaatttttaaaagactatattctcacaaaccttttagaatatagaactaagagcttatctctcttaattactgttttcttttcaaaaagataattacgtaagtaaataccatttccttttatgattttattgtcagaacatttaaagctaaatgtaaagcctaataatagctatcttaaaaatctaggtggctgatatatttatagctttctctttggttgggctgcctttaaaattttttccattaaatttttttttattgtacacactttttttatgttgcatcaaacacttaaagagaaggcagtttatcactttaaaaaatctagatattcttattttttacatgtttgactatgtattttttgagtgagatcttatttgttcatgacatattttttcactatatagctaactaccaattatataaatacatgcaagaatgacttaatcaggtataagttttgaactcagtgcctttaaaatagtagtactatatcacaaaattatctacatatgttaataattgcaaaatataaaagtgtgaatcaaatcaggtaaaacagtaaaatatttatgtttagtttataacgataaaatcatttgactaaagaaaagtaatactttgaacattcaactatactaaaaatgtagaaacaatgtctccattttactcccacctggtaaagaaatagcgtcaattcaaataatgaaagagttgttatatttgttttcttccaattacctcttttttcctcataaccacaaatcactgattcaacctcctacgttattcagaatatattgtaaatgtgatactgcaatttttctatcaggattttctacttccacttccttctttcctttctttcatccctcccttccctccctcccttccttctttccttccttcttttcccttccttcctgcctgcctgcctgcctgcctgccttttttccttccttccttccttccttcttccctccctccctctctccctccctgccttccttccttccttcctttttgtcctccctccctccctcccttcctgaggttgcctttgccatgggtttcatgtttgaggccccgttccctctgcataggcttctgtatctacgagcagagcttcagacgtgggaacatggcttccacactggaccatgtctactgctgggctactatgtaagaaagagtaacttaaatttgctttgcagaatatattagtattatatcttatggattctaaatatattttgttaacttcactgggtttcctagtagtgaatgtgaattaggagaaaaagtaaccttttaagaaaggcagtgaaataaaaaccttacatagaattactttggagctattttgactcagtggcatacattaacactaaagaagctaggataactgcaacagtcttttgcttgagttcaaacataccaattaggtttaggatattaattttggatagatgtcattagatgaggtattgaatgtttcactgtcttgttagaagtaagctaaattagaaataacttggaaagacagaaatacgtataagctgaatcgtaataatagtcaaatttagtgaagaaggcctgaaagtgaaaaatatgattattaaacaagtattattatatattaaaatcaaaatactttctattgtaagccatctctaaatggaaagcaattcttaattagagggaaccattctgctaataattaatctttaatgagaatatacattaaatttaattctgtaatttatctgtgaacatctctgaatgttttcacagttatgatgaaatccatcactatattaaagttatgtgggggacagatagatagatctcattaaaaagtgtgcattcaaaaaaaacttctccacagttaacctaaaaaatattttagtattggtataactatctttgaactagggcaattttcaaacccctaagacccttaaaatctctagagtaattttaaaacctactagagaaattttcagatccttacattgtaaaaccccgtgaactagaacaatgcaaaaatcccatccacttgggatgtagagatctgcaaaaaagaacatccctcccactttaacaacgtaaaaatactgaagtataaaatgatagcttttcttgaacccatcagggagctgcgtggcaggtaccctggtgacctcatttccttttctttctttctttttctttttctttctttttttttttcttgagacagggtcttgctctgtctcccaggctaaagtgcagtggtgcaatcatggctgtctgtagcctcggcctcctgggctcaacggatcatcccacctcagcctcctgtgtaggtgggactacaggtgaggccaccatgcctggctaatttttgcagtttttatagagatgaggttttgccatgttgcccaggctggtcttgagcttctgggctcaagcgatccactcaccacagcctcccaaagtgcttggattataagcatgagcaaccatgcccagcttggtgacctcatttctaaaggacaaactcccccagaagagacgagagccgcatgctacgtgtgaagcaaaacaatggggaaaggcgaccagaaaagaatcatcagcttaataaacaccaactgtcgcaagtggagcctgggcctcgtgtgactctggatgcagacgcatggggagtgtgcccttccacccacaggcctctatcagggggctataagaaagcctaggggcacagctggaggccagaaagagctctcccagcccccagtgcagaggctctgtgacgagaagggcgtgaaacaccatgcatgtccctgaagctttgctcttaggaaacacaaatcttaaaccactgcaggggtgcagcaaaacctgtcatttcaggatctcatattatacataaagtgacataagattatttgaaggtaagctctgctctataaaaggtgtgtttcaatctctaggagaccattacaatattaaaaattcttccctaataagcccatagtagggataactggggcaatagaaatacttaattacaccaaaatctgtcagagaatgtgggaagaaataataaaaaaacagatggggtaaatagaaacactccagtctcggggcccgtgtgttcaatcttgttgttcctcccaccagcttccaccagatcaatactgagttcaataacagtcactgccaccttgttggccagcagtaagatccatcctgtacaccttgaggtcaggctttgtaatttccaggataaatcaatattatcaccgttcacacagttgcactctaagatatctggatatgtattttgtcttggtttcattggttttctttagaaaagaacgcagaacaagagtgacacttgtgttaattctcacatgtccagttaagttaaataacgtgaacgaagactaaatggctatagaatatattaataattcaaagatgctaatctttttgagcttttacttggattctgtaagattacaaagaatctaggtcatatacattaaaccagaggattctgtaagatccctgagactgtagatcatatacattaaaccagactttcttggaactgcttttgctaccattactattttacagcccatctttcaaatataagtgtttggtttttgtttgagaaatttccaccagtgtccatttggatgtactatggttaagggggccttgttttcatttctatatgagaaaagaactcctgagatagaagtagatgtagataagccttaatggcccaggttttagaaccaggcatacttgatcctcagtatggactcacaagctccttgattctccagacatttttcagagagcactgacctttggtgtcattgtttgtaaaacagccatctatacgtcaccttcctggtagggtagtctggatacctcgcaaggtgctcagtaaatggtattcgtaataaaatgcacttttcatgcctgcctctgcatgccatctgttattaacagtgtggctaggacccaggaaggctaaaaatgctctatgctctgtttcttcagttggaagaaatgagcagacttcaaaaatatagggctgttttaaggacaaataagtaacaagcggtaacaagtttagagcaagacctggcatagagtaagcgtctactttttttttccatttttatttcatggacataaaataaaaatctgaatttagagatttgtagattggcagtccatatcttaaaataaatgcaaaaatatgtcaacaaatttaagatatcagaaaatcttttggcgatttacatcaacagtcctgataccatttgacgctaattgtagtaaggttaattctacaaatactttctataatctatatttctttttttttttttttttgagacggagtctcactctgtcacccaggctggagtgcagtggcgcgatcttggctcactgcaagctctgcctcccgggttcacgccattctcctgcctcagcctcctgagcagctgggactacaggcccgccaccacgcctggctaattctttgtatttttagtagatacggggtttcaacgtgttagccaggactgtctcgatctcctgacctcgtgatctgcccgccttggcctcccaaagtgctgggattacaggcgtgagccaccgcgcccagcctataatctatatttcaaattctggcatgaagaataggaacagagaaatgagttcctcttaataactgaatggcataaactatcagaatggtgttagtataaaaaacaaccacttaaaaaagaaaataacaaacaaaaatgtggcattatgtttagcccaattaaaaaatacattaaataattaaacaaaagcttggattctcaaagttcatctgaatgagaaatatgttagtctctcttttttaatgaatgatattgtctaggaataaagagaaatgtagataattatattgatggggctgaagcccaggtaagtgcatatctcactgtatataataataagcatagatgaattatttcactagcccctctttccaagacaaaggaataaaaacccagatgctacaggataactttgagaatgataagagcattcatcaatactaactcccccaaaactattagtgaatttttaaatactatcataaacaaggcttatgtttttctatctacagagagtcacaaagtatatcaaagtagcagattttccagacacatcctacataagtaacatccacagtatcattttatactgtcactgaagtagtcctcttcatataaattgaaataaacttgcagacaaatgcccataataagcaggaaaatttaaccagaatgtgaaacagccctgtggtttgtgcctggcttagaatatttatcatcagctggcaatctggcctttcaaaaatatgcatgcatttacatcgtagcaaactgtttatctcaattcaaaagatcacttattaaagcttatccatgtatttgcttatttgcaactgcttattaaaggagatgaatatcaacgttaaacatttttagtgcttgaaaacaggtcctaaaataaaccttactctcattggaaattcttatttcgcttttacaaggtttacctgcataatcaaacgccaaaaaagatctgtgaatctgacctttgtcattccatttatcagactattaactctgtctcacatccatctttaaaaggttagagtcgactgtgcgatgccttcctccaattaaaatgaataacacacaaatgcaggctccggagcaacagctctctactcgttcttattttaactgcctttgagactagaaacagaaaaggcttatgaccataatctaggcagaagtcaggattgtccaccttctggggaatgctaatatgagtattttttaattactcataaaaaactagtaatattacaagtggttcatttttgtgctttttaatacaaacaacctgaaattatagcagttatatctaattacttgagatttgaacttatacatttacccattaatttgtctctcataatgtatatttcttttgtttgtttgtttgtttttgaaacggcatctcgctctgtcacccgggctggtgtgcagtggtgcaatcttggctcatggcaacctctgcctcccaggtgattctcctgcctcagcctcttaggtagctgagattacaggcgcccgtcaccatgcccagctaatttttttttgtattattattattttttagtagagacggggtttctccgtgttggacagcctggtcttgaacacctgatgtctggtgatccgcccacctcttcctcccaacgtgctgggattataggcatgagtcaccgcaactggcttatgtatttcgtagagccagatttcataacactaaatttcatgcaagtctttcacagttttagaaaaataatatttcactgtttaataagagcatgatttattttttctttaaaaaaatgactcagtataacagtggaagctgtatacagaaagagttgaccttacttttgtattccaggtggaaaccagcagctgccacactaatgtcagactggaaatgcaggtagagttggttggaagtactgttcagcagtgccggtactgtggtgcctgtaagaaacaatgcagatagaattgtaacactacaaatacattcacttttctaaatataaaacatatgagaatacttattaggcttacaaatccctacagtttgtctgattaccagatatttaatctgagtgttggttttattatgtattcagccattctatttttctaggtacaataaaaagttacccattgtctgctctgacctgctcaagtcgatgtgacacctttctcttgtacaaaaactcctattgtagcatgaggtttttttgcattgttttatccatgtaatcttctgcttcttaaatttatttttttacttgacatgaacagagaggaaagaaaagttcaacagccaagagtaatgagggttgagggagcagtcggaccctgtggatagtgatctgacatatccttcagaagacgttgcttttgaccctgtatatatgctcttcctgatccctatgtgactcatgcttagtaatgttccccctggatctgttgatgatttcaactaaagatgcatgaaaaggaatatatagggctattttgacatagtgatttctttacttaaaatgttctagcctacatcacagtaactaaccgattggaaagggcaatacagataccgaggaccagggtaagaaagaagtaatgatgctggcaggtgctgaggaaaagaaaatcgttcatcactcagaagtttgagacattttggtggaatgaatcataatatggaaaaataatagacaagtttaagtcacttttttcctgatgtatgttcaatactctagtaaaaacattctctaaattggaagtgtagacatactcgatgtcaaagaactatccattgtgtaaaaataaccacagtgtagataaattattcaagtactgctgtataaagggagaaatgataatttaaataacaaagcaaagaaataagttgataattattccaaacagatgaacattattgaaaagataagattgtctatcatccttagctcaccacttaaactatccaatatcccccaacagattttatttttttagatggagtctcgctctgtcacccaggctggagtgcagtggcacaatcttgggattctcctgcctcagcttcccaagtagctgagattacaggcatgctccaccatgtcctgctaagttttgtatttttagtagagacgggatttcaccatgttggccaggctggtctcgaactcctgacctcaagtgatctgcttgcctcggcctcccaaagtcctgggattacaggtgtgagccactgcacccggcccccaagagatttgatcagaccaataaccccaggcaaggactctggctgtctttttataagaagctgtgtgtgtgtgtgtgtgtgtgtgtgtgtgtgtgtgtgtgtgtgtgtgtgtgtgtattgttagtagagaagggggactctggctgtctataagaagctgtgtgtgtgtgtgtgtgtatgtgtgtgtattgttagtagagaaggactctggctgtctctttataagaagctctgtgtgtgtgtgtgtgtgtattgttagagaagtggtttcaccgtgttagccaggatggtctcgggggactctggctgtctctttataagaaggtgtgtgtgtgtgtgtgtgtgtgtgtgtgtgtgtgtgtgtgtgtgtgtgtgtgtgtattgttagtagagaaggggttgttagtagagaaggggttgttagtagagaaggggtttcaccgtgttagttaggatggtctcgatcaactgacctcgtgatccgcccgcctcagcctcccaaagtgctggctttacaggcatgagccaccgcacccggcctagaagaggctttttaaacatgaagtgtgtcgaactaaacgcctaatctatctatccctgaaacatcgagtaggtctctaacgcctaatctatctatccctgaaacatcgagtaggtctctaacgcctaatctatctatccctgaaatatcgagtaggtctctaacgtttcttaacgataccatcggcatccatccacgtcacaaactgaacgcctaatctatctatccctgaaacatcgagtaggtctctaacgcctaatctatctatccctgaaatatcgagtaggtctctaatgtttcttaacgataccatcggcacccaccgacgtcacgaactgaacgcctaatctatctatccctgaaacatcgagtaggtctctaacgcctaatctatctatccctgaaatatcgagtaggtctctaacgtttcttaaagataccatcggcatccatccacgtcacaaactgaacgcctaatctatctatccctgaaacatcgagtaggtctctaacgcctaatctatctatccctgaaatatcgagtaggtctctaatgtttcttaacgataccatcggcatccaccgacgtcacgaactgaacgcctaatctatccatccctgaaacatcgagtaggtctctactgtttcttaataccattggcatccatccacatcatcacattcaaagcttcctctttctccatgaccccagactgccctccaatcagtcatcacgccttaactggcgtgcattctaaatattttcccaaattatttcacttaattcatattattttcacaacaatcaccccagtgcaggcagccttatgttaaccagaattagtgcaataatcttccaacttgtttttttgagcctgatcttttcctaattcaatgcattctccattcagcagtcagaaaacactttacaaatgtatatatgatgagacatgttaaaattctcatagattcctgatcatcttaggaccaaatttcacactccttgatttggcccaaagaccctgcatgatctgactgctgcttgcttttctagcttcttatcattacttgtttttcagaatcattttttcttgcttcaagaggctctgtatcataggcctgggatgttcgttccttctcctttgattcactttgactttcctatttctattcattcaaatataaccacttatttcccaaactaagccactcactcaattcaataaacatgagtttatcagccagataaactactaactcattttccaaacatactagttattctctgacttcgtgcaaagcagaaccttccctgattaggacacagcctcaaaaacttgaacctcatcaaatccttaaaggcaatgagcagaccaacggtgccatgcaaaatatgactgtgacagctttaatctgtcttcagttctgctcttatcacattcatctcctgcctgggctaatgaaatagccatcaactgagcttcagaatggatatttgccttcttcttacgcatttgttctgcacacaaaataacctgcttacaattaaataatgcttgcacattttatttctatacatgggcatacgacgtgtcttttaataaaattttaggtcaacttcctgatctatactgtgctttcaggactcatcctatggagatggggaaatttaatctttaccatggctgggaattcctttcctgcctcaggatagccaatagtctcagacttttgagtccttgactccttacttcacataagctcattctccaaccttatccggacccttaaattttagcagtttcatgtttttgtgcacacctttgatagaatgctctttgacaagtccctgctccaaaatctagcctaagtgcatcaggctaccactttgttttcaaggtcctgtcacatccctgttttgtcctggtttgtctcctttataatatagtcttaatcatatgtataagtccattgctttctcaagttccgtgaggtactctagggaactatcaagaactgaagggaccatggaccccctaaatttatagccagttggtcagagtgcaggtggcctgggaggccccgagggcttgcagctgacgtcagaggggagtcctgtggagaagcatgaagtgcacgaactccgtgctaactccaggaaattagcgtcagaattgcattgcagtggtatttatgtcaaacatattttttcaaattttctcctggctaactccaaaaactgaaattaataaaaaggagattgttgttatttttcatgcatacagaggcaatgtggtcacttctttttttcactattattagtaaggcatttccctgctaactttggctaatccatcatgcagctgtcttaattttgccgtctcctgctttctgctggtaatgcctgcatttgtgtgtaaaatgtgttctgtcacagatttatgactgagaacattaggttaaaaacaattcaatatttaatactctcttttgaaaaattaacctatttctaatattaggatatatgaaattattacacatctgaagctaagttcacttgtgatagttactcgagggaaggcttaatatgaggttgctgtacagcagttgataaatccaaatatatgtgaatgataagatttgatcctcagacaaaacgtggcaagacacatactttctaagcaggttttaccaactgaattcataaactgtgaggtaggtgctaggaattgtgcatgacactcagagattaatatagattctgaagaaacttaaatctctacaaactaaaagaacactttacttaaaaatgagcaacacaattcaatatctgagtgtagagaaacagacacagactgcatggctcccgtgacttgaaggatttcctgtctctctctgatttgtctagctatattttactaatctgttaagatattttaatttatttttcccaggtagcttttttttctcttacatcttaaaaaaaaaaaaagtgtgacttttttccctcctgtaacacccatcacctacctgtaatgctgtctatttaccaaatattatttatataattacattaagtgttggcatctgtgtagattttaacttgtgttgttgttgttgatgatgtttttaatgagagaggccttatcttgtattcctaacaacaaacacagtgtctgatatctagcaggtactttaagaaatcacatgctaaactaaactattggaagagctatgtggtcaggggaagaaagagggatttcctggtggagatgggccttgagttctagcttttaaggacagtaatgggctatttgaaataaaagttcctaaaagtataaatagtacacaggcagacaaacatggattgtgaatgacagataacaataagatgatagattggcactttattcccaacaccttaaatggccatgcccaaataaaaatatggttttatttgctgagaaccagagataagatctttgaaccatttgaagtgataaaatggaagttgtatcagacactgtgaatggcctgtgcgctatctattttctttatgttttttaacctattgagtaaaagtagaacggaaatatttagggaaaaaatatccacagttaagaaaaaatatatattccagcctccctttgcagtagagataaacaactgacagaattcagacaaatgggatagaaggagtcagctactgcaagcaagaagggactcatggaaaacagtactttttctgtcatcttggacaattctctagtagctaatctttgttcttcattggtaaaacagagatagcaataatcccttagaacttagttggtgctgtcatattggctacttttggtaattttagtagagacagggtttcgccatgttggccaggctggtctcgaactactgacctcaggtgatccgcccacctcagcctcccaatgtaatgccgggcttacaggcatgagccactgcacctggccatactcaagataaaattaagcattcatgttaacagaagttcataactggcaaagtaaaggctcaggaaatgtgggcaactgtgaggacagtgatgaccagggagataatcgcaatactgatcatcatcactgctcatgaagtttgagtcctaatgctattacagtgtaatgctattacaaagcaaagtgaaagaaagcggtgtcatgcatctggaggcaggatatcctgttaaacaaaagcaaaattgagattgaatgacgctcgagggcaatgggaagggaagacttgcagggcatttggagagcagactcgtcaaggcgggtgcattcgtgagagtcggaggtgcaaggaagactaagagagggtggacttgcagtggactacaatttcgtgcctggctacatatgagtagggtagaatctcaggactagctgagcccacatgctcagtgtaattttcccagattgcttaatgtcaggctgtgcattttaagagttgagaaccgtttcctaacctctgcctctttgctacctcacattactattcctggcttctgctgccagcctgagacctgccgcatgtcaaagctctgctatctgacacttttagattggtctcctcctcgtggagaacacagctttgtttttactcacctgtttcttgatggtcttactctaagactttcagcactagagcaaccattatggagatagaagaattgtgtaggaaaatttctatgtggagtgtttgctgttatttatgttgttttcttggtgtttgcagattttgagtcacacaggtgaggaaattgactccatcttacctgagaagcttcccagtctgggtgcggtcacatccccaccatcgtggatctcaagggagtcccagttctgctccgtggcaaaactgatcacttggatctaccaaaccatgacattaagttaatatttatttttggcttaacacaattagtctaattagatggggttttggggtttttcatgattaaggtgtatatgtatatatatatacatatgtatatgtatatatatatacatatacaccttaataatgcctccaatgccatatatatatacatatacaccttaataatgcctccaatgccataatattatatatatataccttaatcatgaaaatcatctacatgtctatctatctatatatacatggcaaaatttaaaaaaaacaaaacaaaccatgaaagaacaatttatttttctttttcttttcctttcttttttttttttttttttttgagatggagtcttcctctgtcacccaggcttgagtgcaatggtgcaatcttggctcactgcaacctccgcctcccaggttcaagcaattcccctgcctcagcctccctagcagctaggattacaggcgtatactaccatgcctggctagtttttatatttttagtagagacagggtttcaccatgttggccaggctagtcttgaactcctgacatcaagtgatcttcctgtcttggcttcccaaagtgctgggactacatgcatgagccaatgcacacggctgaaagaacaatttctacaaatggtacttttgatagtttttattttaaaaaattgattatatttattcaaaatatagaaaaatggttagaaatattttgttgaaatactaagaaaagggaaacagagtatagtctatgtatttaaaataaccagtataaaaggaaaaaagagagagggagagagagagagatggaaagaaacatagaacaaaagaatgaaagaaagaagcccatggaccccagctgagccctgttgtagactgtggacttcaaggactcacctgaattcccgagccctccgtaactatgatcttccatatacagttcaagttgtttccgtatggctcagggtagccgggggacaggattgtacctcttcgttgagtgaaattgccactgcagggtactaaaagacacaaccatatgtcatgaaataaagtgctgtgggacagtgttgatttggcatgcagttttctttcactgtgtgaccacacagtaagagaaaatgtacatgaacaatgatacgttaaacggcacttttagccaaggtaaaattcagtgtattctcttttaaattagcaaaataattattacctattatgctactcagttatagatcttgagtctataaataaatctatccaagttctctaagaagggatgatgtccaatgatggcatctccaaagtgaattctgtttagaataatttacctactataatttaaggaccttggcagagttttctcttctccatgcagacatgcatctccaaatgatattaatgggatttatgagcaaattcaagagaagaggcgcttaaaatgtacaaatgattcaagtgctaatcatgattgcgctggagctttccacacaaaatgaagcaggtaaactataactaacaaggtcactgttattcagcctgcatttacctattaattttcaaagattcatcagcaccaatttattaaaaggacgttacacaagtaatatagcaaatcaacatgataatggttttttcccaaaatgagattatgttccacacccataactttagagttgatggcctacttcataaatatggagaagggaaacatgctttatccttgttaagatgatgagttgttttatgaaacacaataatttttagggtttggctactaactcaattacttcccatgaaacaaactgccctttaaatgggtcatgagccagatggatttacgtagcctggatagaaacatgagaagtaactctttggcaccaccacagagttctggcgggcagccgcttagggacactgctcacccacacagctggggatcgtgtcgttccactgtgccaaggcgttgggcacggactggcagtggagcgccgtggaaccctgaagcaggtatcccgggttgcactcgaatcggacgatggagccggcagaaaactcagaaccaattctccttccgtatctgggctcggggacagagctgcattgggtgtcactggtacgaggaacagctagaagcaaagtacagaacacagccgtctgtatctccatcagcaagccaggacgttgcgtggaacgtgggtttaagatgggaccaaggagagctgatgcagacagagaatttaataacgactccaacaatcgctatagagaatgatttgaggcgctgggaccacgcagagctggtgcagatagagaagttaataaagcctccaacaatcgctatagagaatgatttgaggagcacgttcccaactgtacttcgccctcaggaccatctcagtgtcctcacttcagatgaggaaaacggcataaaaagactcagtgccttatgaggacggattgatattcaggcgattacatttaatcatcctgctagtgataatgagatgactaaccatgcgtacttgtcctcacaggcctctgagtctaatgagaaaagctaccatatgaaggatttgttataatatggccatcgtgatgtaataaaaatcttaaactaccatcagatccagcaatcccactcgtgtatacttatctaaaggaatttaaattgggatcccagagaaaaatcggtactctcacattcattgtagcattcttcaaaatagtctagatgtgcaaacaacctaaatgtccatcatcagatgaacagataaagaaaacgtggagtagataaaagaagaaattctgctatttgtaataacacggatgaaccttgaggacatcgtgctaagtgaaataagcaaataagcagccacagaagaacgaataccttatgattctacttctatggggagatctaaagtagtggcactcatagaaccagagagatttacaatggtagttactgggggctggggaacaggaaaatgggaagcaactgttgagtggctataaagtttcacttacataaaatgagtatgccctggagacctgctctacagcactgtgtttatagttaagagggtagatttttctaatgagaacacctgctccacgtgccatcatgttgcatttagtcctctctaaagtcacctaggatgagctcaaatcctaacaagccccagccgggtgcagtggcgcaagcctgtaatcccagcactttgggaggcagaggagggtggatcacttgaggtcgagagttcgtttatcagcctggccaacaggtgaaacccccgtctctactaaaaatacaaaaattagccgggcatggtggcacatgtctgtaatcccagctgctcgggagtctgaggcaggataatcgcttcaccctgggaggcataagttgcagtgagccaagatcacaccactgcactccagcctgggtgaaagattgagaaaaaaataaataaagtaaaaaatgaaaaaatagcaagcccctccagttctctcttgatgagactttcctaggttctgtaaaatgggaggccttcattgttgcagcaagcaaaaacccagggatatggaatgacgtgtgtgtatctcatgggctttggatagtgggtactgacaggtaagtatcagtgcaacgtgtgggtgagataactattcaggttgtatggcagaaattaccatctacaggagatattcctgtttatcaaaaggaatgtgggataaagattaaaaaatacttcaattggcaaagaggtccatcacactaggcaaactctgaaaatagttatgccctttgaaatttgcttattttgtttttgtcctctgcagtgaaaaagacagtatttaggtactgtctctgggattctatcctcctcagtccttgtgtttcttcatcctaaatgcacagtcctttagcagaatgttctcgtatatgaattttcccttaaaataacccttctatcttcccacggctttttctgacacactggaatctgttttatttatttattttctgttgaatcagaccaacgacagacattatttgggtaactgctgctggggaagcagttccatgaaaacggaaattggcagattattttgattaaacgatgtttcaatttggtgttgagatattttctatcagaaggcaaaattaataaaagtgtctacctttctaacagcactgatgtggaaaataattaatgatttatcagaatcattcttctccaagctaaaaatgaaatacagaataacgataatattctattataggtcaaggatctcttatctgaaacgtttggtgtttcaggtttggaattcttgtaggtgttggaatatttgcataaacataatgagatatcttagggatgggacccaagtctaaacatgaaattcaatgatgtctaatacatgctttatacacatagtctgatacaccttctacacgtgctttatccttgttaagatgatgacttagtttatgaaacacagtaattgtcatggtttggctactactcaattgtttcccataaaacaagttgccctttaaataggtcacgagccagatggatttatgtagcctggagagaggcacgagaagcagcactttggcacaacggagaagtcctggtgggcagccattttatacaatattttatattttgaaatacaaatacaatattttaaataattttgtgcatgacacaaagtgttgactgcattttctattgtgatttgtccatcacaggaggtcaggtgtgaaatttttcctttgtggagtcatgttggtgctcaaaacaaagcagatttggagcattttgaattttggatattcagattagggatgctcaatccatataacataatatttcttgaaattatttgtgtcatgtttgcatgcttgagtattttattagagttgaataatggcatgaagaaaaaaaaaaagatatcccatagaggcttccacagtcatctcaaggatcttccacaaaatgaagcgctattgccagtttttctacttacactggattgcttacaaaatacctgctatcgtggcaaaggttgcacttatctaagaggcttcaggtattgcatctgtcacttgtatatctgggagctatacaaatatatttgagagctatgcaaacatatttgtacctttgagagatacagggtatcactatctttccaagttcccaaaatgaggagaaatatagcaccaagggtcatttgtacacaagtcactattaactttcttcatgaatttcagagtggtctattttcaaggaaaatgacaataaatgaataacacctgcatctggataacaagacgaaaaatgttttttagaggaagaagtttggaaagtgaggacaccaattgtaaggacttgagacagtaggatagggaggcagggagaagctgtggaattgagacatcacagctccacggaacgtctgggaagcgggtgggtggaaatcagacagtgctgtgtaacttcatcctccccgcccgtcctctgggtctggcccttcacctggacatttcagacggcatccgagagaaaaattctattgtctgtcgtcatcattctctatcctttagtaaatatttcacactgctgtgaagccaaattgaaatcgggccagtggaaaagtgagcaggaatgaggtcagcctggaatagagggtgatcaacaaaatgattgacttctcaggccagacaaccgtgtttcttcagaggcagaacgctctcctctggggctttgaggtgctgaaagtgggaagcagcgcaaatgtgtgctcatctgtcgggaaaagccggaagcatgttgtgacaggttcgatgatcacccttcaacaccacaaatgctctaagctacagatacatgctgctcctttactgcacctctgttacagttgatgtgaaaaccacaacaacaatcataaaataaatctgagtgcatgtaggactcacttgcaatacctaagtgaagcagttttctttttgatgtagtgactgagggacattttctctctcaaaatcattcctctctcatcgttggaaaatcaggttggacaagccattactagtcaatgaattaaaacatacatcactgaattgcaagcaaaattttacatttattcttctttgcaaagaatatgctttttataggctcttgacacaaatgtgagtttttagatgtggaaaaccaactaagccatataattcatgccctctaaaaagaagaagaaaccaagggaaaatcaatcaaaacatgtatttgcctgcccagaaataacctcaagtaaagaaattcttaatgtacatctttcctacccaaactgagaaaaaaatatttctgtgtttttaggtctgtttattttcaggagaccatctgattaactattttattttattttattttattttattttattttattttattttattttatttcatttcatttttgaggtggaaactcattctgtcacccaggctggagtacagtggtgtgatctaggctcactacaatctccacgtcccaggttcaagcaattctcctgcctcagcctctcaagaagctgagactacaggcacatgccaccacacttggctaataattttttttttttttgtacttttagtagagatgggatttcgccatgttagccacgctggtctcaaactcctgagctcagataatctgcctgccttggcctcccaaagtgctaggattataggcatgagccaccatgactggcctaattaactatatttccatgaatgctaaagagactgagtctttccagcagaagaccctggaagaagaagccttgagctcctgagcctgggatgcaggtgctgcttcaggtgaggagcctgggagaggagaacccaggttagagatggtgacccggaaaacatgacttgaaaaagtcctggccaatagacatttacaagctgggcactgcggaaggggttcaatatagaaatatggtttccttttccctttaaaatgtacagtaaatccttgcagtttactcattttggtgtgactgtgtgatctggaaggaactgaaagcagcattgaattctatgttgaaacaaattacagaaataggccttttatgaaaacagccaggcataaatataagacaattgaaaaaagtagcatggatgaggtactctccaacatgaaggtttactgagacacagtcaatcatgcacatcagagggatgcgggagaagacagggcagggtgggcagctgtgaccaccctgtcttaaatccacaggagcctcggagcaggcaggaaagagaaggatgtgggctctgcctctcttggcctctgttttcaggcggattgattctaatgttgaaagacgtgaattacaggccaaagcaaagtctctaaatgcaatgtaattacttaatggcatagaatcaatggcctcttctaatcctggaagaagcagactgtgctggagttactaagaaacagtttgtgtgatgttcggcttttgcattgcgtctaagaatatgttgattttcggtgtaatatattttctgtgaaatgacaaagatccctaaacctgtataaccacggccagtaatgcaggtcctgccagtccctgcttgatggtacaagaccagggaatttagggagaagaggggaagctacaggagtctcctccactgtgaacactcgaggaattcccgggagctaagaaactggtataaaacactttctgcttgatgccaaaaagcaaatgtacaaggctgaacatattcaacatttaaaagcaagaattgtgtatctcccacgtcttcaagaaagcttgctaatgcagggaaaaaatgtagtcatggttcagacttggaatatttaaactgtcagaggtgtttgatccagagtgactccatcttcaataggggctgtataaaatgaggctgagacctactaggctaaattcataggaggtcaggtgttctaagtcacaggatgaggtaggaggtcggcacaaggtatagatcacaaagaccttcctgacaaaaagacgccgtaaagaagccggcccaaatccaccaaaaccaagatggcgactaaagtgacctgtggtcattcccactgctcattatatactaattataatgtattagcatgctaaaagacactcccaccagcacgatgacagtttacaaatgccatggcaatgccaggaagttaccctaaagggtctaaaaaggagagaaatcctagttaaaggaattgtctacccctttcccagaaaactcactaataatccatccctcatttagcatataatcaagaaataatagcaagtagaagcagctgagtggcccatgctgctgctctatggattagccattctttattccttaactttcctaataaacttgtttttactttactctatggactcgccccaaattctttcttgcgcgagatccaagaacctctcttggggtctggatccgcacccctttctggtaacaaaaccattacagatactcttatacttcaggaggggaataattagatttcttttcatgccagcttctcaccatagctttagcttctcaattctatttgattatatcacagctgatgaagtggttgctgattcagaggggggtgaaaggttgggcaggcaggactcatgcctgagccacagctgcaaacagtgctccataatcactgaaacttgttggtaatgcaggtcactcatctcagtctccatactgctccttccatcactggagaccagtgagttgtgagagtttcattcctgggagagtggataatgaccatgcccgttcattcaacggcacgaaactaaagataagagaagctcctggcaagtgctggctcaccatggatacatccatgctgaagggttatccctttctgaagggtcactggccacagccttctctggggcaccccatgatgtcactcacaccttcttctctcatgctttccaaatgtacccttctgctctcaagaagtgtggaaaacacacaaaaacccagcaattgcatagagtaactagaatactgcattaaagagcctctagacttacattgcttcagaagttcagaaagatggtaacatcatcattaattctgtcttcacattactaaccaggatgacatggagggtgggaagcagaaggctagagaccatgatctgtgcatgtctggagtcacacgtttttttgcacactgatgctgttgcaaacatttttcactgtagaccccagcagctctttataacagaactgtgtctgttaacaagggttagctatcctacaaccacggaagacataaagtctgtgtgcaatttgaagctgaatttgtttatgaatgaatgaagctgtaatggtgtatgaaagcactgtttagaatatttttctataatatagctcaaataatttttttttttttttttttttgagacggagtctcgctctgtcacccaggctggagtgcagtggcgcgatctccactcactgcaagctccgcctcccgggttcacgccattctcctgcctcagcctcccgagtagctgggactacaggtgcccgccaccacgcccggctaatttttgtatttttagtagagacggggtttcaccatgttagccaggatggtctcgatctcctgacctcgtgatccgcccgcctcggcctcccaaagtgctgggattacaggcttgagccaccgtgcccggcttcaaatactttttaggcttcaatggaactactgtctttcaagaagcaatgttccatttaacttttcatgtgtatgcaaaacttttaccattgctgttgagtaatttataagttgcatttatgattctagttcttccaaaaaaacttagttttgacaaaaagacatcaattttctgcataaacacactagtaggagcaaagcaagagaaggaggtatattagaaatttataaaatattgaggatgttagagtcgtcatatactcttgaggacaagaaaaataaatttcctctataaatgatgttcttttctttctacttttccgtatctttgacattttgatgaaaacgtattactttaaataagcataatttttaaaatacatgcctaccaaggacaacatttgcatataagacaccaggatatttgcatgcaatatattgtctgatgatgggatagattttataatctttatcaaaaaccaaggaaagccccttataaaggcagacaaggtcagtcactttagtgtttccaggagaaaaaatgttgaggcagcccagtttctttacacatctcacatactttggtctaaacgtgattctgcttttgcaaagtcagatagaatttatttgaaaaaattagaagtagtaagagacgggttgtttcaacaggccactctctaataaagtccatttttaaaaactactgggtaattatttacattttaataaaaggtgtaacttataacaatgtaacaccttttaatgcattagcatctccattcattcaatggctacttacacaggatcagagagatctttgtctcctgattaactgttaagcatcatcctcattctcttcccattactctttaaatgatctaattgctgaaaactgaagggtttttacactgaactgttttgaagtcatgaatttcccaatttgagatgattagaaacgattgatacataatataacactgttatactccacctttttaaaaaatacgtaatagtatcaataatgttttctggaggaatctttattaaaggaaagaaaccattgctaagaaaaaatttttctccagatctgaagaaaatacttaacagtggccattagtatctgtagcctccagcaaaattgagacctagaaaaactaaaatattgctttttatttttgaacacacagtttatctctgaacaagatcatttcttccagatctcaacctttacagtcatgacaagctccacgcaaagacttaatccaagcttctgaaagtgtatgaacagtttatgtggtcattttttcaatgcaaaacaaaagtgaaacaaattaggagaaaattctttactttgcagaatctttgagcaatctcaaatattttttaaaaggtttaaattaaaagataagtataaaggtgtaaaagtacccaaagttaataaaacacaaacaaaataaaataggtatttagttaggataagagatgcatgcgtgatattttgttttttgttttgttttgttaaatttccatttaagcttagtttttataataaaatgtgaaattgtataatgcattttaaacatatttcctatattgttactaagatctcaactatttcaaaatacgtaattagataaaatactgtatttgaagtcatcttacgagatgtgaagagctacagaaaggtaatatgatcaatatttattcccttctagtgcctgataaattagatattattgtgtttttgtagtagaaatatgagtttcaactgtcaaaaaattgtaatatttttattaaataattttattataaacatatgaacaccttcagctccttaaatattacaaaaatgcagctgagatgttttgagtgctttgtctgagactagccgtgggtgcagcatcaggaaagaccacagtgacatgtggagacatgtggagtgacgcttaccttgatacacgaagtggaagccgcgggcagaggcaccgctctttgcactgaatcggagcagaatttgatttgacgtagccaagggcaatgtttcccctagaaacgaaaacagagacagattcagaaaacacacagcaccgtgggggacggtagtattttggaaaatggtgataaagttgaaatttcacatttattttttgaacttttaaaacattttcactttatggtttaaaactcaaatatgttgtttttataaagattaaaaactctgtcctaggcaagaataggcagtgcatttgattaaaatatactgtaatcattatttcgcttatgatttcttttgaagaaagcaccaatggtaggcctatataatagagtagacagaagtaaagggtgaatcatttgctcagaatcaccttactctgattttagttaaaattaaaataattttacttaaaaaatttttaaaagtaactgaatccaaagatgattttttttaaattaaaagattcagaaaaggccttctgaagtatatttttaacctttaaaagcacatataggccaggtgaggtggctcacacctgtaatcccagcattttgggaggctgaagctggtggatcacttgaggccaggagtttgagaccagcctggccaacatggggaaaccacgtctctactaaaaatacaaaaattagccaggcgtggtggtgcatgcctgtaatcccagccactcaggaggctgaggcaggagaatcgcttgaacctgggagatggaggttgcagtgagccgagatggtgccactgcactctagcctgggcaagagagtgagtgagactttgtctcaaaaaaaaataataataataataataaaataaaaataaaaaatatataaaagtgcatataaaatgtggaagagtctgtgtcaagcagtggtgggaggtgtgtgaattggcataaggttttcagaggacaatgtgttactaataatcaacatatttaatgtgtatcctctgatgcattcttagatacatcattgaaccttggtagaaaataacaaaacataggtcttaagacttttagttaataataaaatagagaaaacctggaaatataatcaaatctgaacattaattggtcaaagcttgtgacgcatatcgtttactaggcaaattagtaaatgtacccagtaccaaactgatttagtaaatgatgaaaatgtatcagtacaaataaggggtaggtcatcaattaaaagtggggttaaattgtgctatattaaaccgactgaataccattcagaactcagagtaagggcattgggtgcataccgtgtttgttagagacagacttctgtatgtgattttaagggtaagaatgggataaaaataagttgtgaaataacattccatgttttatgggggctcatgtgtatttgcatgtgtggataaatgtatgcatgtatacatgtgaacacgtgtacatgtgtggctattaatgggtctctctatgtaggacttacaggcttagaatgctttagaccgaaatgttaatcgtttttatctccagaaggaaggttaagacacatgggatacaaaattaaacacagatgatagttgattatcccaccctctttttcggatctttgcaccttttactgagataaatattatattttctgcaatcttagtaagatgataaaagcacgtgattttatgtgtgagataaaaacacttttgagatcttatatctaaaataagatttttctaagcacacacgcaaattcaaaaatgattacatttctcattcatcaaaacaaagcaaaagaaacagacaagttaaaaattaatccccctagctgtctgaactaaattaagggcaaaattctttaagacttacctgagtgagaccccgagagtgagctgagaagtctggcctgtgcatgggttccatcaaataattctgccaaatcattcagggctgtctggaaataggcaaactgtccaaagaccactaaaaaataagaggtgggatgttggcacaagatgctctaagaaaacaaaatggagatttttgatttcactgaatatctattaattgccccaatggatcattatcctaagaatttggtaaaaaaataaatattaacttattttctctgctttctaagttttcagttgacaaaactattttactttgcttcttgacttttggcatttaataaaagaaaaaatactgttttatttccaatttgaacattaaatgaggaatgtttttgttttaataaacacaacattaagaatatatgggctggatgtggtggctcacgcctgtaatcccagtactttgggaggctgaggcaggagaatggcttgaacctggaaggcgaaggttgcaatgagctgagattgtaccactgcactccagcctgggcgacagagtgagactctgtctcaagaaaaaaaagaatatctgtaaagacttccctatattttcaaatatttagcaacactttattcaatgaaaaataagcaaaggatcaaaccccatgatgatttgatgaggaatttaaaattcctcacaaaagattattataatgccaaattcacattaatacgttgccgtattcatacacactgacttatacacgtgattctctggcatataataggaatcccttgctgttttccactctacaatttcatgtatcctacaggttatgaaaggtgtgtgaacacacctcctccaagtgaaacataactacatgctttgtgacttcaaatttaactgatgctgtgtattcagattgacgatacagagggcctttatatttgcaggaaaacctgtgatttggtatatacttacaagcaatgaacaactaattcttttcttatttattgtaagatttgcactacaatcattctaagccattataaacaagaaatggaggtgtgtgcactagttgtgtgtgtcagaattccaacggaaacaattactgttaatatttgttagtatgacggaagtaatctaactgtaacagtgtgtgtgcccatgtgtgtatagacacacatacatatatttatgtaaccaactccatacacacatatctaatataacttgtcttttaagattttataatttcccagagaaaaacacaaagaaggcatgtaggctaggtgaattttcccaatagatgaaatgctctaaaaacttttttcaggaattagagagggagaggacttaataatttctctacagatcttgctcataccatcctcacccacccaccacctccccaagttcattagatttttatcatactggaggcccaaaacttgggtcacaaaagtgaatcatccacagataatttctactctttttcaagaaatatttagctgacatccacctcatactagaaactaagaaaaaaggagggaaggggatagtaacatggtcttaggactatcatgctctaacgtgtttggtaatttccaagacaaacatggattttgagtacaagatgtcaggagccagaatgcccagctcattctggacatggccccaacgtcttccttgaggaacctccttcacctgggttctaacccgtcacacacactgagtcccagtgagcaaactcaattgccaagagagaaaagctgttcactgctatctacgctgctgccggaaatcatgagaatgtgatgagaagaacaaacaaagggttatggggcttcagccgcgggaactgtcaatgcttcatggtgaggggatggcactatcagcaagaaggattagtggaagaatggaatataagaaattatatcagcgaacggaatacaaaaagcaaaatggtggcggggacaaatgcagcaaatagtcaacttcagctaacactccgtggataaaaaacaaacagggggattggaatgcaaaggcctgtggcaaggatctcaaaggccaccctgaaaacaaacactttgctccataaataacaggagtgactaaggatgtttatcacgatactaacatgcttagatttgtgttttagaaagaattcttggctatgcttttggatgagaatagaggaaactgggttatctgaagacctgtcttattaataatatcgcttcgcattttcagcctgtgttgacagacagggagcagcctcttcctacctggtaaggatcacatcaccccgtagtgtctggattgcacatctgcctcacccctcaccataagcctgccagggacatggaccagattcctttcatctttgcatccctgtacttacaaatactgtgagattaattgtttagttaattagtttatttatcaggaaagagtaacgaatgggggaagaaagtaaaagatgagacagaatgcattttcattaaagattcgctgtaactacgttattccacgctgaagctttctgccagataggatgtgatcgtttgtgtgattaaacttttcaaattgggaaattataaacgatatttaggatatgagtatgacttctttagctgaaaatttttaattgtgtaatgatgacaataatattttgtatttaactaaaatcatagaatatggctgctaaattccattgtaataaatatattttgtcatgtttccatgaacagaagacttttttgtgataatcaggggaatactgctgagcatttaggtaaaaaaaaaaaaaattatttcattcaaattcagaattaaggctaaagttaaatgagggactttaaagaatttggtccaacttaaaatttggaatccagaacccattttaagtattactgcccatttatcataacaaagggaacagcaaggtttggggagggtgtgcattacattcgtaagaggcccgggaatcatgacacaatagaagtttacaaaaacactggctcccacacacaagtttcttacacatcaaatatctttcttgtcacatgttaaaaatgctttatctcaaatacgtctaacattagaatttttacctgctttatatgcagagtgagtgctgtctcagacataaataaaaaccttgactatgtagcgttttcaattttcctattggaaagagggacatagtctttaagatgatgacagctactatctggtttactccagaaaagaatctgatccaagataaattgtcctggtcaagagtgagagtgagcattgcataaatgaagtgcagagcgaccagggaaggcccttctggaaatgaagtcattttggaaaattagctggaattggaagcaatgtttaggagggaaacaggaagtcagggttcagcaggtgaaacagtcaagactctgcctgcttctccgtccctcagcacttacaggttgactcaaggatgcagtgatttcgatcatgatctggttactgagttcactgaatgtatgtgccattcatgcacagacatatacacagagttctgacccacccactactttatgagaaatcctccgttgctcataaaaacaaccaactgaaagaactatgtttgggaaacctaagaagaaagccaaattaattctctctgattatttcggatcataaccctagaggggactgtgagcattaatatcacattggtaaaaggactgtaatggacattgtgcaggatatgtttggaaggcctgctacttaaatgcaactcatttgcttttatatgaaatatttcactaagctctagcatacttgtttatcaaatgacagaaaaattaacactgaaaggaaatatgacaatgaattaaaaatacaaggacatccttaccgaattcctttggtaccgtgatggaatagaggcatatttgaccagctgtgtaattatgggggtagtttggtgataaaactaccccttctgatcccgtgtactggcctccacagggagctgaaaataaaatcaaccgagaattagtcgctgtgcaataatagcgcaggtgataggtgagccaaagctgaaacacatcaaacacgtgagcacgtttattgaaaacttgacaaaataagaagttaaaatcttgttttgcattgctatcaaagtcatagaaagacaaagatttaccagggaagaagtaatccaacttaggagaaaaacctaatattattttcaagacatttgtctcagatgtattaaaataataagggaaacatctataataataataaaataggttctataaagacaaatgattaaattattttagaaagtctcgcggagttgtctgttcgaagtcaatcctcatattaacttaagagatacaaagattatttcagttttctatcacttttatattaatatgggaatcaaaggaaaaatgttttgttttttaggggattttctttgttttaacgtttcatcttatagtttcagtaaaagcaacatgcataattactaatgcttttggggtctcttcctatgagttcaatttaaaactaaaagaatccatcattagaaagttagggcttacaaaatatagagaggtgtgtgtgtctgtgtgtgtgtgtatgtgtgtggggggtatgtatgtgtgggggggtatgtctctgtgtgtatgtgtgtgtgtggggtgtgtgtgtatctgtgtgtgtggtatgtgtgtatgtgtgtttggggtgtgtgtgtatgtgtgtattgggggtatgtctgtgtgtgtgtatgtgtgtgtggggggttatgtctgtgtgtgtatgtgtgtgtgtgggtgtatgtgtgtgtgtatgtgtgtgtgggggggttatgtctgtgcgtgtatgtgtgtgtgggtgtatgtgtgtgtggtgtatgtctgcgtgtgtatgtatgtgtgtgtgggaggttatgtctgtgtgtgtatgtgtgtgtgtgtgtatgtgtggggggcgtatgtctgtatgtgtgtgtatgtgtgtgtggggttatgtctgtgtgtgtgtgggtgtatgtgtgtgggggtatgtctgtgtgtgtgtgtatatgtgtgtgtggggggttatgtctgtgtgaatgtgtgggtatgtcttaattttcccccagttatcttatttactttggcttcacttttgctgagaaaatgaaaaacactgtacacagatgttcaatgcactttttaaagcatcatggaagagacctccaattaaatcccagccatttgatatccagtctttagattgccagtactctatttcattatatttctacatgagaaggggccaagtcagctcccctcatctgtttaacatagggcaatgaccagcgtgggagccactcaggacagcctgttgcacccttaccatgctggctgtggcctgactgcacttcctatcttggatataccgccactgatttgaattcagaattagcttcagtatttcagaaagattatatttctacagctcatttcttcttgatatggccattttcttttttttttttcattttctttttttttttttgagatggtgtcttgccctgtcacccaggctggagtacaatggcatgatctcagctcactgcaacctccgccacccgggttcaaacgattctcttgcctcagcctcccgagtagctgcaattactcggcgcccgccaacacacctggctgatttttttttttttcatctttaataaatatgatgttggtcaggctggtctcgaactcctgacctcatgatccgcatggctcagcctcccaaagtgctgggattacaaacgtgagccactgagtccggccacaatggcaattttcaagcctcaaagaataaagaagttagagataacatgtttaattctttgaatgttaattagcattatgttaaatattaattgatggacagaacattttccatgatgaattaagctccttagaatatggtaatgctaaggataaggcaacttgttaatgattagtcaagaaatttcctgaatccctgcattacaatcgcttgaaaaacttaagttgtattctaaaagtcaaaggaaaacagctcagacatctgtcagctttgatctgttcatcaaagctgacagaaatttaagcagagattttacttaaataagctcagccttcatgctagtgtcttaattcaaaatcatgttatcactctaaaacacttctctaaaacacttctatttaggtttttatgattttaaatagaaacattttattttcacttttagatggaggatatttctataagctcaacttcaaaactgaaggtttccaatagaatgctggcatcactcactctaccaacgcagatatatccctcagatatttctctccaccttaaccatgtgaagtcaaccaggttatgtcagacctatctttccttttcctcaaaagcttcaagttcaagtttttaaaaaacttagcacaaataaagattgaaaatatattttatttgcgctcagtcacatacaattcaaacatatcattttgcaaatgatctttttccataaaacaattagttttaaattttagacaagaagtataaataaaaagtggaaacgtcatcactgggccaaaattttgattcccaaattattagcgatggtaaagtaattcttttcaagaacatcttctgatcgctctgtcaccaggctggagtgcagtggtgtgatgtcagctcactgcaacctctgccccccaggttcaagtgattctcctgcctcaacctcccgagcagcagggactacaggtgcacaccaccacacacagctaatttttgtatttttagtagagatgggatttcaccatgttggctaggatggtctggatctgttgacctcgtgatccacctacctcggcctcccaaggtgctgggattacagggctgagccaccacgcccggccatatgttttgtgattgttaatactgaatgtcatcttgattggattgaaggatagaaagtattgatcctgggtatgtctgtgagggtgttgcccaaggagattaatatttgagtcagtgggctggggaaggcagacccacccttaatttgggtgggcaccatctaataaactgcagcatggctagaatataagcaggcagaaaaatgtgaaatgagagactggcctagtctcccagcctacatctttctcctgtgctggatgcttcttgcccctgaacgtcaaactccaagttcttcagttttgggactcggaatggctcttcttgttcctcagcctgcagacagcatattgtgggaatttgtgatcatgtgagttaatgcttaataaactcccctttatatatgtaactattccattagttctgtccctctagagaactctaatacatgtttcaaagtataactacaaagaaacactttgtgcaagcatagaataaaagagcattgccttatgatagtagaggacatttttgaaaagtcaaagatgaaattcaggaaaactgactcagaacttttgtcttttactaccttgataaatagtgcttgtgcctgtccgttcttcctcagatcaaaatgctaagcaccagaactacaatgatacgtttcatacatgaacaacatttgtgttagaaaaatatggatagaatttttatttatttgtttgtttgtttatttatttatttatttatttatttatatttatttatttttgagacagagtcttgctctgtggcccaggctggagtacagtggcgtgatctcggctcactgcaagttccatctcccgggttcatgccattctcctgcctcagcctcccgagtagctgggactacaggcacctgccaccatgcccggctaatttttttgtaattttttagtggaaacggggtttcaccatgttagccaggatgttattgatctcctgaccttgtgatccgcctgcctcggcctcccaaagtgctggaattacaggtgtgagccactgcactcggctatttaattcttaataattgttatgtctgcattactgtgctaatctaagaaacaggcctggtgcttctcaccttagaagttattttattttaatgcaacaacaaaagaaaaataaataaatgtttgttatttggtaattaacatattaaacagattatttcctaaatgaataaagacatacaaaagcattcattgctaatggtaacaagaagcttgcttatccatttggctaattagaatatatacatctcgtacataaaagcaaccacatagaaccaaattgagtaaacaaaactagcaaacagaagtcattgtgacccatgaaaggggctcaactttgcttcaatttcagttacaattctacaaaaaacttcaataagcaaaatttgtaggtaatagacgaataaccaggaaaaacattaccccacgcatctaaaacaaactgccccaaaatgcaccaactgcatcccatgatgcaggaactatcaaaagatttacagtggagcaaaaggccccgaggttaactgttgatctgaataaatcacaggcgctggttcatgcacaaatgtgctgctctccatgagggatccaagatgcactacaggagagaccatctctgctttccagatttataacataaagctttatttgcatgtaaatggaatcctccatttggggaaatcagtgtttcatgcgctgtgctctttgatgactagtaaaataaattgtgcctcactccacagatcttcagacatggaaactgaaacagtctctaattaaaaatttggttttatatatatgacctatatatatataggaatatacatatatatgacctatatatatataggaatatacatatataggaatatgtatatatgtatatatcctatatataggaatatatgtgaatatatatacatatatacgtgtgtatatatgtataattcctatacatatgtgtataaattaatatataggtgtgtgtataaatatatagacaggaatatatatataaagtgtatatacactttatatataattatacatatatatacacacctatatatgtatatacactatatatatataaagtgtatacatatatactttttctttagccacagaaaaggtatttttcctatggctaatactttacccatgctttttctatggctaaagttttatcactccccacaaattcaactgtaattgaatttaatataaattaaatgccttttgtattattagttaacaaaagtacagaattcatgacctttcctcaattttgctacctacttttatctccctcacactagactctatataattgctaaagatatctgaagtgggggaaaaatacaccaggggatgcaaaaatcattttctgggatacaagaaagaaaattagaatttttacccaaaattacatcttttgttttcttgagataaggtattgccctgttgcccaggctggagtgcagtgatccagtcacggctcactgcagcctcaaccttcagagctcaagtgatactcccactacagcctcccgagtagctgggaccccaggtgtgcaccaccccacacagctaattttaattttttttgtagaggtggggtcttgctatgttgtccagactagtcttgaattctggtcctcaagcgatcctcctgccttagtctctcaaagtgctgagattacaggcatgagcagctttgtctggtctaaaattccatctttgtaaatgtctgtgttcatgtagtaattgtgtggtctataacagctgctgagatggtcagtacctgtaatgcgtggcagagatcgaggttgcatgctcaatagttatattgattggatgtcagatcaaaagggtttgaggtcattgccctttgttacatcaaaatggttttggaaaccagttacatacagaattaagatttactagttttggggagccttatgcctgtggaatttatcctcctaacacttgtgacctagagactgtcatcgctctcagccctgcgagtcttgtctggagtgacacagacgggaggaggtgaggcgagatctggtcactctgcagggcgcacctttcagtgctgccgttggctcacaagcccggccctgcccgcactggccatgcctcgtccagaagggaggatcctcaagaccttggacagcagctcacaggcagctcctggccaacctcaagagcacagggcaagcacccagaaccactggcatgcactgcccaggccgctcaggatatgaggggcacccaggctggtggcaagacaagagggggtggaggtgtggcccaccctgggccaggacagggaagggtgggtgctgggcagagacttccagctgcctcgtgcccacctcaccaagtgacacccacttcttcgtttgtctccgtcctgttttgggggctgtgcaggcaccagggagaccttggtcttgacctgtaatgctagatcaaaggctctctttacctcaaagccactctggctcactgcctccctcacccatgagcacgctgagttctatttgaagctcccatatgcttcttattttagtttttaataaacttaaaaaagaaacactctataacttcccattcacaaaagtctcccaaagcaagtaacacaatgactacactatcagaatttttaattaaacatgactagaaaggactgatgcataacctggcctatgatcacgattttaaaacacaaaaaataacgttcttcctctgtcgatctgttgcccaggctatagtgcagtggagcaatctcggctcactgaaaccttcacctaccaggctccagcgatcctcctacctcatcctcccaagcagctgggactacaggcatgagccaccacatccagctaagttttgtattgtgtttttggtagagatggggttttgtcatgttgctcaggctggtctcaaactcctgagctcaagggatccactagccttggcctcccatagtgttgggattacaggtgtgagccactacacctggcctaagttcttactctgtgccagtctctactgctgggtccagacagctacacttctttaacttaaaaggtttcaggatcataagagaatggacttagaaacatagaaatagcagaacacgccagggaagtaggttttgttttattttgttttgcttgtttgattttagtttcttatatactttttttttttttttgagagagagtttcactcttgttgcccaagctggagtgtaatggcacaatctcagcttccacaacctctgcctcccgggttcaagcgattctcctgcctcagcctcccaagtagctgggattacaggtgtgcaccaccacgcccagctaattttttgtatttttagtagaaagggggtttctccatgttagccatggtctcgaactcctgacctcaggtgatccacccacgtcagcctcccaaattgctgggattacaggtgtgagccacgcgcccagtctcttatacagtaatatttaaaatgtttatttggcctgaagctgccagtagcattgttaggctgtcttaagaaaaacacatttgtttcataatttatcaaacgaaactggtctttgagctcatcttaaaataaccctagaaatgaatgtctctgcaacaagccatgaagttctacctcattcttcttcttttttaaatatataccatgaaaatgtaaaaggtacaagtcaagggtccacagcctgaggagtgtttgcctatagagacccccatgaaaccaccacctaggtgaagatatgcaccctggccagcagccaggaagtctaccctcccactcttcccagttcacacccacagggcagctgctgtctgacttcatcactgtaggttagttttgtctgtccttgaaagctgattcaacgattttactaatttcattcctaaggaattacaaactattgctgttttggggggaaatgacatatccatttaaatatatacatattagttttttctctctatatatatacagataaataggtgtaaatatatatgtgtgtgtgtatgtatatatataaaaatatatgtacattaaaatatatatgtatatatgtaaaaatatatgtgtgtgtatgtatatatatgtgtgtgtgtatgtatatatatgtatgagactccatctcatatatatatatgtgtgtctgtgtatgtgtgtgtgtgtatatacatacacatatatatatatatatatgagatggagtcttgctctgtcacccaggctggagtgcagtggcacaatctcagctcactgcccaggttcaagcgattctcctgcctcaccctactgagtagctgggatcacaggcacgcaccaccacacccagttaatttttgtatttttagcggagacagggtttcaccatcttggccaggctggtctcgaactcctaacctcgcgatccactcgcctcagcctcttgaagtgctgggattacaggcatgagctaccacgcccggctagaagtaagtattttatatatggagagagagagagagagaagtaactagagaaggctaattagcacctcttataaagaacagatctagaacacacaaaaacagaagtgaaaaatgtaaaactgtacgagcgaaggaaaaatattgctcctcccagaaacctatgagaatggctaacacactagctgcattaaatgatcaatgaatgactgatattcgttccacactagctctctaagcaatcctcaccaccgatgagaggaatacgtgttgaaatgtgaaaccatttcttcaatgagatgctgcattttaaaggaaagttgtatttctagaaaatacccaagcgtgcactcaccattgcaggagggcagcacttggtcccaggagggtttcccatcagccccaatcacacaggtgatggatgaggggtcaagaatcttatagccagagtcacactggtaggtgatggtggagccaagcttgaagtctgttccaactcttgtcccattcattatatttcctgggtcaaaacaagcttcccgtggtttctctgtggaagaaatgaatgtaaactgcatgagagcagggatcttattcttgtttgtgtttttgtttgttgggttggttctttaattgtgttatttagggcctagaacaatgtcctaaataagtaagaaatgctcaaagaatatttattgattggctattgaccaagtgaaactattaattaaaataagaaaattcctttttaataaaattatatttccattttaaaaaccacattttgctacagaattgatataaaattaccttcatctacataaaaaatacagtactacgtttttatatatttatccatttttggctacagattttaggactgaatcaaagaaaaattgactctggaaaaattgaggttcattttctaacttttgtacatcaaacatattaacataaaatcattccacacctttcagaaaagactggagaatttggcttctcaaaatgaaacagtttaattcctgaaagttaagagcactttcttatacgaataacaacagacagacttagaagatgaagatggatgcttgttctcattcttttactaccgtatttctgttgttagtcttaatagagtaaacgtcaaacttagaagaaaaaaatacattgactgatagatgatggtcaaacattgtgcactggatgtactaacagccaatagttctaccttagttaaaataattgctgaaatttattgagggctcattatgtaccagacatggaactaggtgcatttcttgtttaattctaatctccaggacacctctgccaggaaaggatcataagaatgtaaaactcaaggaaagttaagtcacttccacaaagaccccctgcagagacctgcccacttctggggcccctcaattaggcattcacttttggctgcattaagtatttcttcttcccaagtaaaaatacaaaaccttttttcttcagtcatgttgttctgcagtcaatttcagttatcttctggtagccttaatatttttaattttctgtttcaatagaccatctaaaatatctctaaatgaaaaagtgtataaccctgcagtctaccaccctgctagaaatagataaatataatgggagaggaaaaagcaaaaacaaaaatgctaaactttgggaagctctggaggaagaaaaagagacctgattaactgtatttattcaatattttcaattatatttttaataatccatgtgtaatcatcaaccaaacagagatgtctttggtgatcattgacttaatcatcgtatacattatataaagaatctattataataatgtattatatttaataaactatatttcctatataatttacatactttgattaaatctatattaatatatattatatatataagttttctcatttaagaatttgagattaaatgatacatatatattttatatacatttcttgttttgtgccttcaaaccagtgctctctaattgctttgttgaaaagctgtttggatgtttaaaatggtagctgacatgttgataattctttgtaactgcattaaatcccatatagaatatagaacattattttaagcaaatacagatcaaataagtaaacctgtaagtactatgaaagttgctcagtttttctgatattttatttaatcattcaacacaatgtactgaggatctagtgaatagaagcatggacttgttcacaatattttcccctattgaaaataaaaaatttcccagtacacatctattaatgtatgtctgttgctcttgtgtcctttttgatcatttttttgttataaatctcttttagtctagtttcctgtttgattaaatatcacctacacaactttcttctttatgccactaattttgatttctgatggcaggattttttcccaatggactgcatctaatcttttagttccattactgacttgtcacttcaggatgttccgtgataaatcactggcacattttttgcttacaatttgccaggcttctaactagatgacttcataacagggtgtattttgtgttgtccgtgtccgttccacttatgcatacctttgagctttcctgcatcagaggccaggtggattgcctcagccaggatttgtgaattgttgcacagcacgactgcctggtgttccttctatttcccatcatgcctaagaactggatctgtcacctgctttgctatccacaccagcacttgctctgggctgcatgcaatacaatgacatcactgcaccaggcttagatgcaatcactgccctaggctggatgcaatggcatcactgcttgaggctggatgcaatggcatcatttctccaggctagatgcaatgacatcactgccctaggctgcatgcaatgacatcactgctccaggctggatacaatagcatcactgccctaggctggatgcaatggcatcactgctccaggctggaagaaatggcatcatttttccaggctacatgcaatgacatcactgtcgtgggctgcatgcaatggcatcactgctccaggctgcatgcaatggcatcattcctattctctttcctgtgatttttatttttcacagactccactggagagcttttaaaacctcaggaactacagcctccagttagatggccataccggttacccaaacaaaaattaaggaagttctttcttcatgcaacctgtaaggcccttcatacttcattcattcgttggcccatttattcatgtgccttaggatgccggggagaacaggagttgtcagagtgggcaatgatcagtgtacattctcacaattatatgaggaattgttttgtttacttgcctgcatgattttgttgggggcgtggggggctatcatagaataagtactgtcatggtaaaatgcattttagtgaattcttgttaagaaactaaattatgatgtggcaaaggctcaaaagtactgttttcaactattcctaaacgtgacggatcccatctcaaaggcataggatactctgattgctaaattgtataatttttaaaattgtacattttagtaaatacccctaagtgtgcagattctgatgtttgggagcaaagaaaccaattttctacttaaaactatataaacagttctggtaatgaggtaagagacataaaatatgttctttttaaaaagatttttcacacaaattgaactcaaaagtgtaaataaatataaatattttcattttttaaagaaaaccctcctaactgtgaattgatattttgttaagtcctcttccctaattctttgtaatacaccttgtattttattttgttcacatgagaaataaatttgaaaaaacatatatttattctgatggacccaatagcaaaatgttgagttgaaggtggtttttcaggtcagtctgttttccttggatgttagtggcagggaatggtttatagcaaatcaagggtaaatcactgatctgatgataaaagaaaagagctctgagcagcgtcagaaaccttgctaaaccagccatagctgactgaggcagggaagggtacagatatgttgacatggaaaatgttgagataaaatgaagttattggccgggcgcggtggctcacgcctgtaatcgcagcactttgggaggccgaggtgggaggatcatgaggtcaggagatcgagatcatcctggctaacactgtgaaaccccgtctctactaaaaatacaaaaaatcagccgggcgtggtggcagctgcctgtagtcccagctactcgggaggctgaggaaggagaatcgcttgaaccctggaggcagaggttgcagtgagctgagatcacactgcagcactccagcctgcatgatagagcaagactccatctcaaaaataaaaaaaaaaagaaattatttttggctgggcacggtgactcacgtctataatcacagcactttgggaggccgaggcaggtggatcacctgaggtcaggagatcgagaccagcctgaccaatatgatgaaacccagtctctactaaaaatacaaaaattagccgtgtatggtggcatgctcctgtaattccagctactcggggggctgagacaggagaatcatttgaacccgggaggcggaggttgcagcgagctgacatcgtgccattgccctccagcctgggcaacaagagcaaaactctgtctcaagaaaaaagaaaaaaaaaagttattttcatgtacttacatttaatcatcttgaagaaacaaattataaggtgttaaaacccgtcttaaaataattattaaatgtcatcaaattctttattttacaaaccacaatttatttttatatggccatgaactgggacagtttttttcccctctctttcttcctccagttaaagtagaaatgcacctcaggaatatcttcactggagagggaggagacatgtatcttcccagacagaggagacacatatcagcatttatgtattaaacagacaagcaagatgttacaaagcaatgcctacaataaaaacagtcctgatacaaattaattcccactcaaattcaggcaatcgcaatacctttaaattcaatggcgaaccctgaaaggcccacggaggcatcactccgaaatgccagaaacaggctgtttccgctactctctattctttctggggcctgagagccctggtaactcccaatgagggggctgttggaatcttccccttcatagatgtgtaggaagtcatagctgggctccatgttgaaactaaagaaaagaatagtaattatgtcatacggctaacagatattttatctcccagagtggtaagcctttgagctcagaaagtgattttatttgcttttgtataatgatttttcagttagggcaatcaaaaagttaaatgtagtatgaatcaaaatattaataaaatagcaatagtataaaatacatcaattgtgacaaatactatttgcctaattaccatcatgttcaatacaatattattctgaccacagccaaaaggaaataagtcataatagcagaggtatgctatcctttccgtgtactcattaatttgctaaatgagatgtaatttaaaagaaccaagctcaaaagagacacatttccactgaccttttatctttatctgaatatttttagttttgaaaatactggaattttgaaaatattgcaatttcaaaatattggaatagtcagtagaattactgactattcttacttttatttttacttaaaaaatgcagttctcccagcctaggtaacataatgagatcctgtctgtacaaaaatacaaaagttagtagagtgtggtggtgcacacttgtagtcctagctactcaggaagctaaggctggatgatcacttgaggccaggagtctgaggctgcaatgagctatgaccacaccactgcacccatgcactccaccctgagagacagaacaagaccctgtcaaaaaaaaaaaaagactccacttgcgtggataaatcagcgaatattaatagcccctacaatgcccagagtgtaacctttctcacatcatgtttcaccatcactgaatatcccagttttttttctctgtccctctctttctttctctcactttctccatttttctgtttctctctgctctaatattaacatacagtcagtccccaaagagtgtaacaatttaaattcaaaggtgtcaagggctgggctgtgtttgccattggtgatgtgtaggctgatagagtctctgagctttaaaactacgcacactctaagagaaaggctgagcttggttaagatgtctaagatcttgatatgaccagaataaactgataaagtagaagtattaaaaccatccattgcagcagagcacagtggctctagcctgtaatcccagcactttgggaggctgaggcaggcagatcacgaggtcaggagttcgagaacagcctggccaatatggtgaaaccctctctctactaaaaatacaaaaattagcagagcatggtgtcgtgcacctgtagtcccagctgctcgggaggctgaggcagaagaatcgcttgaacccgggaagcggaggttgcagtgagtcaagatcacgccactgcactccagcctgggtgacagacagagcaaaactcatctcaaaaaccaatcaaccaaccaaccaagcaaccaaccaatccatccattgcagctgccccttccctcttcttctctatagcaggtttttcatatgtgtctttaaaaagcactcaatttacaaagctcctactccctttcctttccaactgcagaaatttgggacaactgagacagagaaggtcagggtttttgcttgttggtttgtttgtttgttttgtaatcactaaaatgttctaggtggctccacttgatctggagattcggatgataaaatagcaacagaagttccctcctggaaaggtccactgcaccatgaaggggaacagagaacgtggtaccgccagcatcggtgcaacgcccagcctgcattatgccaacctgttttgggtcaaggataccctcactccacatcctgaatatacttattaaaggaaatttaggaaggtgtcttagtctgtttatttgacaagttcactgacgtcaggaatgaagaaggaataaaaggttggagttactaggtataggcgctagcaggaatggtgtgggttacgtagaattttattggaataataattgtatttagagtattggcaaggatgttattaaaatctggtcatgtcatatccccaatatttggcttagttaattatcattattggtaatttatgcaatactgcaaatactgccagacacaggaaaacaaacaaacaaacaaacaaacaaacaaacactatatatcccatctgctctcttttttttttgcctgtaccaaaattcatgcgtagaagtctggagtgaaatttataactaattttggctcctttggagaactccttatttctacctctgccagctgcacgtatctctaagctcttacagcatgccaaagcctgactcaaattgaaccaaattcaatttgagccccaatgtgtgagccccacaatccacagggacgtgtaatggaacatcctctctcatccacagccctgaacgagcctgggagcccatatgtccttcaggtcatatgattctttgcctttaccattagtaatgccagactcccaccctcccataaaaaaaacacacctgaatttgccatcatcctgacactgcatcttggccagccctcatcagcgccagcctcctgcttgggaagctggacatcctcatcccctaacaggattctggtctctccctcctcactacttcccaggtagatgtctgcttgagcacatgcaaactccagatcagagaagtcactggttttcactgatttctgaagtttctgagacattgggtcggctaataagtcataatctatgggttgggagaggcttagagattatctgtttcaaacttccagaggggtgtataaaacgcagtgaaaaaacccttgcacaaaactgccttaaatatgcatatcatcaaatgagttgcactttatgggagggaggaaactcctactaacaaggttttgtgttcaatttcatttttttttttaaagccaaggtcttgctctgttgctcagctcagactagacactcatagctcattgcagcctccacctcctgggctccaacagtcctcctgcctcagcctctcgagtagctagaaccagaggaatacacaagcacaccaagccaatttttaaaattttttgtagtgatggagtcttgctgtgttgcccaggctggtttcaaacttctgaactcaagtgctccccatcttggcctcctgaaatgctgggattacagtcatgaaccaccatgcctggcttcaactgttaacccatttataatatcttgaaaccagaggtgcctcctaattttaaggaagacgctactagaatttaacattaacaaaacccacatagatatctaaaaaatatagccagtgagtgttcactggttttctgtaatagctgagtaacatttggtaaatttgtggcagtttagtaaattcaggaaaagatgactatcaaccaacttaagattcagaatcatagaaacgtaaaattctactgactcagatctcatcaggaggagaaagtgagggtatgtaaacacattcaggccttgaatactgacataaagatctgcagaaaaggaaagtcgttccattgacagattaaaaaatgtaatcccagatacttgtccttggatagctgaaaggtcaataggaaagtctacagaatgactcaccttcataaacaacacattcatttagttcaaaagtcaaagtctaaagttagaaaacatctttggattcaataaattgtaattatcatataccatatactaataatataattatttaaagagtttattttcataaaatgactacagtattagaccttccatcgtctagtttagcaagtacaagttagcatatttttaggactgatatgtagtaactcagactttacagcaaccacatttggggaaactttcattttccaggctctattaagtcttaattttataatgatattagcagtgctaccctcaggaacgtcaggatgtgctgtggaaaggaattcactatcaggcatttagagtgataggagacattgatgagaaattacaccaaatgtctccataccatatttttattatttttaacgaacattctgtttaagccttctcatatgggacacattgtgtgcaagacaaacagtatttaaaaataattcaagtgcatcttaagtagaatgccccaaagcaaaatactgtatttccatttatgtcattttgcagcctggtgtagtctccattagacacaaaatctagcacttacctagatataacattagagactatgaggtcataaaagaagtaatttttaggtatggaattaaaaatcctactaaaaagaggtattctgcaagagacggtaccttttgaatatcaaggcgatgacaaagtccgggttcacttttactctccagtcacattccttcccaggaggatacggctgtgggtagttgggtgacaaaataacacctgctgggcccgtcagattccctccacaagcagctgtcacagaacaaaagttacagagaaaaagtaaggacagcgaagaacgcctgccagtcagtgtggaaggagacaccacagaattctttaagaaaaagacatcagcatttttaccagtccaagagattgtgtgttggttatcaattatcctgataaaattgtaagacccaggaactctgtacatttttcatgtaactgttaatgaattttacataatattccaccccattttcaaagagaattttcaaacttctgacacaaaaaatttctttcctataatttaaaattttctcaattaaatgaaagatgacttaatccccatacctgccaacgtgcacacatgtgcacaaacagaaaaacacttgaataaaaaaaatcccatggacatgattttatggccatgttaattattttgctatttctcacagtttataaaatcattgcctatttcttcttgagtgcatgcttcatgtggtacagggatcatctagctcctgttcattgttttatcccaaacgtctaggcggtttctggatctgaacaagtgttcaggaaatggttattgggtacatgaaaacatggcatttcacattctcccagtcccctggtgtatggaaggcttgaattactttccccatatttcaaagtggcaaaacaaaccccaaaagtttaagtgagctctaagtatacatatcagtgaggagctgagctggagcattactctctgaaaatatcatttgatcacaatgcttggtatattattagaaagaaccactttatatgataataacaaatttagtttgtgtttgaagtcatcaattttgaattaaatgtgtttacatttatattagcaaggcagtaattatgtagctcaatgtggttaataggcaagccagtttttgttcttgaattggaaagtatttaggattgttttatttgtgagataaggtttctcctaaacctctcatctcacggaaggtgtgaaaacactgccgaatttataagtatacacattttagatacatacaagactatgctgagtttaaaagttgtttatatcaaatactgtggtttgtcaccaagttgttttaaagcgtgactacaattaaatcatagtattccacttaaattatatgtcttatttcattcccattattggtcacacatgcactaaaaaatatgtagaaaagaaaatgtcttaattgctgatttttcccctatacaaaaagagactttgttttgtaaataagatgaaggaagatgaaggaacatgcttcacaattttcaataaggagtgcctctttaaatacttatttaacatttctgaaaacttagctttttataggaagaaataacaactaactccagtagttcttgttatactctcacagtctaactgaatgcaaactctgaatgctattgtagaaaacatttataataataaattccacagatatacgttcaagagtaatatgatataatttttacagaaaaagattaaaacttgattttccccagtatgactttttttttttttaatgaatttgaattgtgcagaagcaattgtcccaacagctctcacagggcagtgcctcctcagaatcacgccggggctgctgacagcatcgagcagtacaagcgtggaccgatcagggagcgggagctgatgcagagaaagaaggtacctgaaggtctagaagattctactgcacacaggttttgtaagatgaaaaatgacagattcagggcactggctacagggtgctaccagcaggaagagttcagggatatgattcaaatattgatttaaaagaaacaaaggggaaaccctgtcttattcacactgatcccaggaggcactttcaaatgaggtgatttaaaagctgaaaaagtggaattaaggagtgctgcctggccctgtttgttctctcttttggtctggtattcttcaagttagtttgcttaggttttaattagcttgcaaaatattttagataggattagaatagtaaaaaatgcaactcagagatgctagcaaattctccagaaggaatagacaaagagataaaatccacctattcttttcgacccaccaacccttttacaaaacctttatccactatgctcaacagcacacatacatacgtagcagctccttcaccaccagggtttgaagctggtctttaacgagacccatctacgtttctgcattaaaacatttgaatgttcacaccgttgggggcgataaatattttctaaatagacacctttatgtcaggatgctctgttgtccctaaatgaatttctgcaaacctaggatacattttggcttttcagagtgttttgcaatttggacttggggaaaagcaattgcaggctatataagataatgaagactttttagggacactttactcggaataaggaagttgaagccgaacgtggtggctcacgcttgtaatcccagcactttgggaggccaaggtgggcggatcatctgagggcaggagttcgagaccagtctggctaacatagcaaaacctagtctctactaaaaatacaaaaaatagccgggcgtggtggcacgcacctataatcctagctactcaggaggctgaggcaggagaatcgcttgaacctgggagcggaggctgcagtgagctgagatcacaccactgcactccagcttatgtgacagagcaagactctgtctcaaaaaaaaaaaaaaaaaaaagtcgttaatgtcctttggtctacagaattctccttctagactaagtcaaaaagctaaacagaggaggcttcatggtagaagtcatttcggatgtaacaataacaacaacaaaaaagtgaggtatccaagcaacactcaagaaaaagcaacagcaatggcaggtgttgaaaataagtgttgtcacacacaacaggtgagaggttaagagattttataaaagggaaagaaagagagagagccagtaatgagtaaatatactctaataataaaaagtaaaaaagtaaattagctgatcaatcaggaaagaacaaattcaaacagccaataagcatatgaaaaaaaaaagttcgaccttattattaatttaaaatgccaattaaaacaagacatcatcactttgtgccttaaaatctataaagtgtggtgttttctgtgagtcagagaaaacattaataaatatatatggctgatggcaggttaaatcggtgtgactgctctgaaagagattttaaaaatgggctggacacgatggctcacacctgcaatcccagcactttgggagtctgaggcaggcagatcatgaagtcaggaattcgagaccagcctggccaacatagtgaaaacccatctctactaaaaatacaaaaaaattagccgggcttggtggtgggcgcctgtaatcccagctacttgggaggctgaggcaggagaatcactggaacacggaaggaggttgcagtgagtcgaaatcatgcccctgcactccagcctcggcaactgagtgagactctacctcaaaaacaaaacaaaacaaacacgttttaaaagtccgagaaatatgcgagtttgtagaaatatgtcacttattaataatcctgatttattttgcaacatgagtgctcattgaagctatcttcagaatagggaaaaggttaaaacaacttaattatacaataataagggactagaaagatcaatattggtagattcaaacaaatagatactagagagtggcatcagtggtgtagttgtgccttctaaaaagatttagtcactaaaaacgagtagaaaatacatagtaacacaaaatatacacaccatgtactggtaagtaaaaagtgcaatttacgaaacagtcaagcaggatgttgtcattttaaaacttttttcttttttttttttttgagacagagtctcactctgttgcacaggctggagtgcagtggtgcgatcttggctcactgcaacttctagctcctgggttcaagtgattctcgtgcctcagcctcccaagtagctgggatcacaggcatgcaccaccacccctggccaatgtttgtatttttagtagagatagggtttcaccatgttgcccaggctggtctcaaactcctgatgtcaagtgatctgcccgccttggcctcctaaagtgctgggattacaggtgtgagccaccacacccagactaaaacattttaaaatggattacatatacataattatgaaatcatttataaatgtctatattaattgtaattgtctccaggtaaaaagatgacaacttttttctcctctttgatttaattatagtttataaaatgtcttcagtaaaatgtattaccctttaatatgaaaaaaggtaaaaaaattaaaaagtgttttgaatctttgaaacagaatttacatgagtgctaattataattaactcatgccctaatgggcaagcttcttacagaggacataaacctcattcctaaaaaacagaaaattacaaagtaataaaaatataatgttaacttatttccaattatatattttccatttttctgttacataacacctacgcatgtaggcgggtctggttgccaaaataattgattattcatctgcctgcaagtgatttcagcttgtccttgaagctgacattcaaggtagagacaggggtatttatttaccttttggtgcgtattggactacctagtggctggtcaaaataaagtaactaagagatgatctaacagaagatcgatttgtttatagattcattaggagatggccaacttttataattacatgttcaaattaatataaattaataaattacttttaagggattaactcgtagttatattgctttttaatgtattcctccacgagcctaaaaacatgcaaaatggaaggaaaaaaaaaaaccctttcctactgtaaaagtaggccattggtttaaaatgatcgccacattgataggcaatcactccactttaaaaaagaaacacgccgaaatctctgcagtctcccggtgactcagcttgagtaaaacgcgtgactgtgctcacagacgctatgaaaagtaaacgcagcaccagacattaaacacacatacattgctccccgacaaggctgagaaggctgataaggacagctatccaacctcatctgtcttcagacaactgggataagtggtttgtcataagtaggagcgccgtatcacagctccccaagaccactgagaatttcaccaccgctgtgtacacgacaataaaaaccagttcaaaccacaaaccccctcaaggtcatcctatgcaaaatggcctatccatttcatgatcactttctctcttcacacatcaattaaattttacatttttcagacagattataaagaagtactaattaaactgtgacagttacttaaaataataaagttcagtagtttctttttaagacttagatgatatactctaagtacgaattttattagtagaatattttattgaatgaagagacaatctacctgcaattactattttacataaaatatatattagcctacaaacatatttgtgataaattgtctcaggtggctattcaagccaaagtctgcaaaatcatttgttatccttttaataaggtcaaactataaaatgtcaataaatttcagaaacaaacctccttttatcttcattttaacacaaacagtataatttctagttttcagaattctattttaaatgtactaatatcatagggggaaaaacatctaaaaagagaaagtacttttagtgagtaggttttgcttaagggcatgtttctatattaaaaatcagaatagcaatggtaggtttataaattttgaggcaactagaattttaaattacagacatttgattgatccatgtttatgtaacatttgttaagggtaggaaatatacggtaaatgtcaattactgtaccttaaggggatgacttcctttattctacctcataaaataaagtttaaaggtttacaataaaatttcaggagtctcagagagccagagaacatgaaagaaactcttgagaaatatttctgaagaaataatacatttacggagcgcttttaacgacaacatgcatccattcctgaatataaaatttctaagttctgttgtctgatacctatgcatgtaggagggtctggttgccaaaagaaccggttattcagctgcacacaggtgattttggcttgtccttggagctgatagccagggtcacactggaatgtgacggtgtctccagcctctctgctgtctccatagcgggtgccattttggggcatacctggatcgttacaggtggctgcaattgaggctgcaaacaaaagagaaggcaaggtcacaggctggaaaacatggtttccacattcttgtcggtgtggttgttcttgtgggttgaagcactcttcattggcctaataagtcatttgtctacacatgaacatacgaaaatagtttcttttcccaggggtacattcaataacatacatcttcattgtgcttgcattgcataaactctagcaagattctgttgaaaatgcaaccaatgatgaaatatatcaagggtttttttaaaacaaaaattacattatccttagaataaatacatacatacacacagactgattttctcttcagcaatattttaatgaaaccccatactgcaaattacataaactagttaaagtacaccaacctcaaggaaaacaaaataggaagaatttccttaaggtctgtgccttcaaaggtgatccaataacctttgttgagatgccaagggtggaaggtctagaggagatgaccagtgagttatacccaggatcccataggtgacattgccacggcaaaattattaataaccccctttcactcacccaaaaaattccaagttggacaatatattatatggccaccctaatattaacaaaagctctgaaaataatatcctgcctttctgcatatatataaagaatctcaaatctgctgagtagaggccagactctgcaaagccggctggtgcctgtgctttcaggggccactggagccttatcatatcagtttctggtaatcatgtgtaaagtgcattgcaaacggcgagcctaaaatcacctcccatatgcagccatcgactctgcctgcgcctaatcacagaaggctaccgcaagcccagagttttcaccagagtatcccccatcactctaaaatacagcagcctcaagaaatagcagttgttttctccagtttctataactgctgtgtattatgtgtcgcactgaaaattagaaagataggtactcctgaaaaatccaaagcttagattttttctcatttttactttcagttagaataacgagctctttcttccactccactgcataagagatgacaattaaaagctgactttttctctgcaaagtacttcactgttttcaacaccaagttttatgaaagagcaaaaaaaaagagattagtgtattgttctatatacataccatcacactgtccattttaatatttgaagccttaaagtaatgagtaggctttgcgttttgttttgtaaattctgaagcatttgtgtgtgtgcgtgtgtgtgcatatacatatgtctacatatggatagataaatggaataataaaatccatttaaataaaaagttagaagatatataaaaaagaataagacctgctctgtgttattcagacatttttaacctaataggggtggcaatgaacaaataattcaggacaagagaaaatgttaaactgtgcagattaaaagaccaaagctctatccaatagtgtcatatgatacagacatcaaggatcctatagttggtcagacctgcttcaaatcccatcaggacttaattagtacctaattagtacttaatgatcacttaagcacacttatcatcagctaacaaatcagtaaaaattagactaatatctaagtcattaagtctgctatgaagatgaagtgtgaaaatttgctaacttgtctttctccttgctattctctaagctaattgaggcaagaagctgtcttcaccactctctttctctcaaattgattgttattacattgaaatatatacatgtgtgtatctataacacaatgagaacaatgaaatgaacatctgtgctaccaactctaagcaatagagtatttaccaatacatcagtatgatcaatgcgtagaacatacccttccccatatcaccttcttcctccacttcaggggaagtcactttctgaattttatgtttatcattcccttgcttttcttcacagtgactataaatgtatgcattccacttttagccacatatatcagtttcctgaaatcaaatgcttaactggaattatatgttgcaagttctgtgactctctctgtcttaaatgcttaactggaatacatattgcaagttctgtgactctctgtctctctcccccttgcttgtattatgtttttgggagtcatctacatttaggcatgatgctctggtctactcatttttattgctgtatagttttccattgcaggaatgcaccatgatttttccatcctcttcttgatggatctttgggtcatttttctttttacccttatataaaatgctgctgcgaaaactcttgtacatgctgctggtacacatttgctctttcaaatgacatgggctgctatgttttggattttcacttccaaacagcatgcagttagattgtcctttaaattcaatcccagaattgtcttttaattggatagtttagtctccttatgtgccctgaagttcctgctctatttggatttctctcgaccatcttagcttgtgttttctatgtgcacccccatatgctctacctttttgcttgctttcatactaattaattttttctcgtgcttttattttagtagactttctagaaatttcagtatgtatttagttgtaatagtcttaccttcttctttaatatttattattctcttcctaattacatgcattgctaggtatttcagttatttaaaaaaaaaatcttaaattagacattgtcattgtccatttgtttttataaacctcatacattaaatattattgtttgacatagttgactgatgattgtttaaattttcatacatacttatcaatttgtttgcttattatgttttcttttcattttttttttctgagtttttatttggcctaatttttctacttcataaatactatggcttgactatttgtctcctcaaaaacttacgttgaaatgtaatcaatatggtcatattgggaggtgaggcctttaagaggtgattgtattaatcatttgtaaattagtggattaacggatttatgggctatcacaggaggggaattggtgactttataggaagagtgacctgagctggcatgctcagcccctcgccaggcgatgcctgcacacgttaggactccagaatccccaccagcaagagggccagatgtggtccctcgaccttggacttctcagccagcatatttgtgagaagtatatttattttctttataaattacccagtttcagatattctgttataagcagtagaaaacagactaatacactaaaatggtttgttcgttttgttttgtttggttggtttttgcaagttatgtttagtaaggacatgtgatggcttggattagtttcacatttacttggccgttcatatagtatttggtttcctattcatatttttattctcttttttttcatgattacagtctgaatccgataagaattccaatttctcatgtaaactaagttgtttgtaagttttcacatttgtacttctgttctggggaacttgacttatggtaattctttgcattctgctttgaaggtacacccatccagaggagagtcacattagattacaggatctgcctggaacaacagaaaacctccttttttcaaaaataaattaacagcttgaggcattttggatcccagggatggtagaaattcacctacagactagtgtgaatcccgccggcggttgtgagttgcatgcatctatgtctctgtcaacatcgatgtctgtgtattctccccactctgtgagtagaacaccctttggtgttccagctatacatgagggtctcctatgatattttcaacctcagaaagaccttagatttgctttctattccctgagccaagggactctgagagtggaagctccacatcacagaggatcagcagaggcaatcagggcagggctggcttcctagcttcacaatctctctccatttctgcatttcatatcaaccgggattccttattttgttgcaggttcaatgacacaatttgaaaatccaaaaccaattttatccagcacttttactgtattttcagcatataaattttcagagtcctcactgtaatactgcaaacggaagccactcaatcacacttatttcttaaacactggccatgatttctgagacatcattcttctcgtcattatcagtattattatcattactcgtgttttgaacaggggaatctcacttgaaaacagcactctcagtggagatctagaagagagtgcttgggtttcggagtaggtttttcaatggaaagagagcgggaatgacaataggagttaccggaaggccattgctgtactttcccactttcctcccatcagctgcaaagactggaacacagggaaatccaagcatattactccaagagaagcctgggagagcagaggaaggcaggatagatgtgaagatgcaacacttacagttagaaagtcacgaaggtctcacccataagccacacatttttctaacgtagaacactaatcatagaatacaatcaccagaatcacaaggcaattggccatcatcttggtaccaaaggggtacccttcctgaaccagcattttacacaaattcttgaatttactctttgagtgatattcctatagaatctatgatcaactgttgttgagatttctctggttttcagaaaataatcaaaagcaaatcctactgtacatgcacaatcttgttcatctgaatgaacttcccatcttcaaaggaaaattcttcctttcctcaagcaagtggtgacatgtataattaagcactcatttgcaagtgataatttctgtcacagtttatataggttaaaaaattaacaataagtgtataatattaaaataattgtcatacagtgatagtcactgtaaatatcgcaacatttatacaatgaaatgaatgttatataatagtacaagaatttaaaaacaaaagtttaggaggtgagccaaggacatcagggataacagtttcattataatttttaaaaccaagatgttttcatttctcattcccatatttttatttaatgtttatcaaaagaaaagatatataatactcactactaggaaagttttacacaaaggtgcacagattttatacatgaataagaattttaacggatatatcagccttgcaaaaaataagtgctctgttgaacacttttctgggagttaataggatctggtcaaatgagattggcaaatactgcacaccccagtttccccttagacattcccattgcacattaaggattaaaggctcagagctgtaccacagtaaaaaacttctaaaaatcattgtttaatccagcgtatcccacattgtcatcatagagcacagttttcctagaaaatctcttaagatccttccaaatagaagtccacagaatatcagtagaaacagtgccttgcactagtggttacatgtcctttcatggtataatattctattcatttttgaaagtaccttttgtagttctcaacccaatttttatttggaatacgtataacaataataatgcagcatgcaattaaaagttttaaacttgtgaagttcatgttgtctaataaacagaaatactgcatctacataattagctcgagtttatgccagttatatgaagatgtaagtttttttttttttttttttgagacagagtcttgatctgtcgcccaggctggagtgcagtggcacaatctcggctcactgcaagctccgccttccgggttcacgccattctccttcctcagtctccggagtagctgggactacaggcgcctaccaccacaccaggctaatttttttgtatttttagtagagacagggtttcaccatgttagccaggagagtctcgatctcttaaccttgtgatctgcctgcctcggactccgaaagtgctgggaatacaggtgtgagccaccgcgcctcgccgaaaatgtgagtttcaataaaataattatatatacatttagagctaatgtatatatctgcttgtatattttcaaaggttatttaaaattgccataaactactaaggcttacttaagtttaaacaaacccccaaacactttgtatttagaattatgaaataaagatgaaaagttcctagagttagccagattggactaaaaaaccaataagaaggcttgaggaaggagaaagagaacaattttaaacaatgtagtgcagaatacatcggttgggtctttgaaacaaatttcattttattttcctctagttatgaatgatgcaaagatgttttctgttaaaggcaagaaagcttattctagactaatacaaacccccacccaggggcactccattaggggcagaaactgcttttccacttcaggctcttcacaaagtgattggcagagcacgctgtcattcctcttccagggctgtattcttttatgtgccacatcatacacttcactcatttttctcttaaatatgttttctgcaaattggattttttgctgactctgaaggtttctagtttcttgccataaaaaagaaaacattttcagttgcatccatcttatccctcaacgaccctagaaaaaggcagcgctgttcctgagattatgagtgccctgttttccagtttcccacaggcgttccctggaaaatctcaagtcacagaggcactttccacaggcccattggcctctgaggggacatctctgccacctgtcaggctgcatccagagccatgccagtcagcttgagcaacaaagaacctgcgctgcccttcacaaaacagcagtgggtctgactgtttccaacagcaggattgacaacgtgcggctactgcactgcagaactggacgctgcaataacgccaatctttttgcaactagataagagagatatatatatagtctcacaactttgcaggccgggtgcggtagctcacacctgcaatcctagcactttgggaggccgaggcgagtggatcaaaaggtcagcagttcgagaccagtctgaccaacatggtgaaaccctgtctgtactaaagatacaaaatattagctggtcatggtggtgtgtgtctgtaatctcagctactcgggaggctgaggcaggagactcaggaggtggaggttacagtgagctgagatggcaccattgtactccagcatgggcaacagggcgagactccatctcaaaacaaaaaaccaaaaaaccacaactttgcatataaataaaagtatataatatttttatattaaatattatatatttatatattatataaataacacaactttgcatataaatataatttttatacttatactataaatataattttatacttatactataaatatattttttatacttatactataattttttaaattatactataaatataatttttataattatacttatactacaaatataatttttataattatacttatactacaaatataatttttataattatacttatactacaaatataatttttataattatacttatactacaagtataatttttataattatacttatactacaagtataatttttataattatacttatactataaatataatttttataattatactataaatataatttttataattatacttatatatttttgtatatttattttatgatatgctatatattatatatttattttataatatataatacagatttaaataataaatttcactcgcgtccgtgtgaagagaccaccaaacaggctttgtgtgagcaataaagctgtttatttcacctgggtgcagacgggctgagtccgaaaagagagtcaccgaagggagatacgggtggggccgttttataagatttgggtacgtaaaggaaaattacagtcaaaggggggttgttctctggtgggcaggtgtgggggtgtcacaaggtgctcagcaggggagcttttgagccaggatgagccaggagaaggaatttcacaagataatgtcatcagttaaggcaggaacaggccattttcacttcttttgtggtggaatgtcatcagttaaggcaggaactggccatctggatgtgtacatgcaggtcacaggggatatgatggcttagtttgggttcagaggcctgaaagtcctgttttcttatattaataagaaaaataaaatgaaatagttgtaaagtgctgggacggcaaaaatttttgggggtggtatggagacataatgggcgatgtttctcagggctgcttggagcgagactacgggcagcatgggaacttagagtgggagagatgaagctgaaggaagattttgtggtaaggggtgatattgtggggttgttagaagaaacatttgtcatttagaattattgatgatggcctggatacagttttgtatgaattgaaaaactaaacggaataagaggagaaaaacaggtattaagggactaagaattgggaccacccaggacatctaattagagagtgcctgacgaggttcagcatagccttgccagcaaagattatttatttactttaagtgttaagagtggcaggttggggatggcaccaagagatatcagctgtaatggcttggagaaatagtgtaaaccagcagtgtaatcaagagcagggcatgtataagtagttgagaatggtgaataggagtatgactagacagaagatagtagggatgacaagttttttggggcacagtcaaagttggtgtggtgtctggaatgagactggggcctaagaaaaaggaacatctatacaggagtttaaatgggctataccctgtagcattctgaggacagacctgaattctgagaagggaaagtggtaaaagcactttctattcctttttaagtggtggctgagcttggtaaggttttaaaagaccattagtccgttttacctttcctaaatactgaggagcgtaagggatataaaggtttcactgaataccaagagcctgaaaaaatgcttggctgatttgactaataaaggccggtctgctattggactgtatagaggtgggaaggccaaaccgagaaattatgtctgacagaaggaaagaaatgacaaggctaaactgaagaattatgtctgacagaagggaagaaatgactatggtggccttcttagaccctgtgggaaaggcctctacttatccagtgaaagtgtctacctagaccaagaggtattttagtttgctgactcggggcatgttgagtaaagctaatttgccagtcttgggcaggggcaaatcctggagcttgatgtgtagggaagggtgggggcctgaataatctctgagaagtagtagaatagcagatggaatactgagaagttatttccttgaggatagatttctatgatggaaaggaaatgagaggttctaagaggcgggctagtggctagtactatagcatagcctgcctttgctggcgtggggcgattaggcctggtggaactgccctcaataaaccaagcgtgatgagggcgaggaacaggaaagaaggaaacatggggaaatggggtgaatgtcagatggatcagagagttatagtcataggggtcaggtgtggtatccagaataatgtgggaggctggattgaagtccgggccaggaacaatggtaattgtgggagactcaacaaagagtgaatacagctgaaggagccggggagcagaaagtatatgtgtcaagtgtgaggaagaaaatagattttggaagttatgagaactgtagagagtgagttgagcatagtttgtgattttaagggcctctaaaaggattagggtggtggcggctgccacaagaagacttgagggctaggcaaaacagtaaggtcaagtaatttgggtaaaaaggctactcggtgcggtcccggttcttgtgtaagaattctgactgcgcagcccacacttcagctgtgggtaatgaaaaaggttgggatgagacagggagagctaggatgggggcagtctctaaagctgtcttcaaggaacggaaagaggagtggggaaaggacttaggatctatggggtcagcaaggtttccttttgtgagtttatataatggttttgttaggatggcaaaaccaggtatctaaagtcgaaagtatccaaccatgcctaggaaggaaaggagttgttgttttataggtgttggggtttgagagatcagctgaacacgattggcagggagagcacgtgtgtttttatgagaattacgccgagataggtaacagatgaggaagaaatttgggcttgactgaaataatgggggctgtctgtgaagctttgcggcagtacagcccgggtaatctgctgagcctgatgggtgtcagggtcagtccaagagaaagtgaagagaggctggaatgaaaggcgcaaaggaatagtaaagaaagcaggtttgagatctagaacagaataatgggttgtggagggaggtatcgaggttaggagagtatatgggtttggcaccactgggtggataggcaaaacaatctggttgataaggcgcagatcctgaactaacctgtaaggcttgtctggttctagaacaggtaaaacgggggaattgtaaggagagtttataggctttaagaggtcatgctgtagcaggcaagtgataacaggctttaatccttttaaagcatgctgtgggatgggatattggcattgagcagggtaagggtgattagtttttaatgagatgataaggggtgcatgatcggtcaccaaggagggagtagaggtatctcatacttgtgggttaaggtgaggggatacaagaggaggacgcaacggaggctttggattgggaagaagggcggcaatgagatgtagctgtagtccaggaatagttagggaagcagataatttagttaaagtgtctcggcctaataagggaactgggcaggtggggataactaaaaaggagtgcttaaaagagtattgtctaagctggcaccagagttggggagttttaagaggtttagaagcctggccgtcaatacccacaacagttatggaggcaagggaaacaggtccttgaaaagaaggtaatgtggagtgggtagcctccatattgattaagaaggggacggtcttaccctccactgtgagagttacctaaagctcggcatctgtgttggtctacagggcttccgaggtgatctggcagtgtcagtcttcagccactaagccgagaagatctgggaaggagtgagtcagagagtcttgggccagagttccaggggctctgggagtggctgccaggtgagttgaacagtctgattttcagtggggtcctgcacagacgggacacggtttaggaggaatcctgggctgcaggcattccttggcctggtggccagatttctggcacttgtagcaagctcctgggggaggtgtttctggaggaacgcctggccgctgcggttcaggcatttggaagttcttgtgtgctggagatgtggctggggtttgtctcacagtggaggcaaggaactgcaacttagaaatatgttgcttcttggctgcctctattctattattgtacaccttgaaggcgacgttaattaagtcctgttgtggggtttgagggctggaatttaatttttggagttttatttaatgccgggagcagattgggtaataaaatgtatattgagaataagacggccttttgaccttttagggtctagggctgtaaagcgtctcaggtttgctgccaaacgagccatgaactgggctggatttttatatttgatgaaaaagagcctaaacactatctgatttgggataaagaaaaaggagcattaaccttgactatgcctttagctccagccaccttttaagagtaaattgctgggcaggtgggggagggctagtcccagaatgaaacagtaagctggaccaggtgtgaggaggggaggtgataaaaggattatagagtggaggaacggaggctgaggaagatttgggacctagctcggcctggggaggaagggagaggtcagatggggctgtagaaaaggaagactagaaagactcagcgacgcttggggttgggactgaggggacaggtaggagggaaagaaggaagatttgggatgagttgcatgggaacagagactaggtagggactgatgtgtaaaagaatgcctggacgtcaggcacctcagaccatttgcccattctatgccaagaattatttagatcttgcagggtggaaaaattgaaagtgccattttctgactatttggaaccactgtcgagtttgtactggggtcaagcggcattgcagaggaatataaggcatttaggttttaggtcaggtgacagttgaagaggttttaggtttttaagaacacaggctaagggagaagagaggggaatggagggcggaaggttgcccatagtgaaggaagcaagcccagagaaaagagagagtagagacatggagggaaggggttcggggtttcttaccctccagacaagcgggaaaggggttggggcgcagaaataaggggttggggcgcagatataagaggtcagggcgcagaaataagggatcggggtacagagataagaggttggggcgtggaaataaggcaggcgtccctgagtggtcagacacctctgaaacgtgggtgaacaatcagagagatgtccctgcaatggggaggctgccttccgtagtccgtgaccagcgccggagttttgagtccacggataaaacgtgtctcctttgtctctaccagaaaatgaaaggaattgaaattaacagaagggagagattgaagggtggcgacaagattgaaaggagaaagtggttgagggatagtgagggaggttggagaagagagtaagaggccgcttacccgatttaaaattggtgagatgttccttggggtggtgggtctgaggacccgtggtggtaggtggatctttttcacggagcaaagagcaggagaacaggggattgatctcccaagggaggtcccccgatccgagtcacagcaccacatttcactcgcgtccatgtgaagacaccaccaaacaggctttgtgtgagcaataaagctgtttatttcacctgggtgcaggtgggctgagtccgaaaagagagtcactgaagggagactttgagtaggtaaaggaaaattacagtcaaagggggttgttttctggggggcaggtgtggagggggtcacaagatgctcagcaggggagtttttgagccaggatgagccaggagaaggaattgcacaagataatgtcatcagttaaggcaggaacaggccattttcacttcttttgtggtggaatgtcatcagttaaggcaggaactggccatctggatgtgtacatgcaggtcacaggggatatgatggcttagcttgggctcacaggcctgacaataaatataattatttatgaaaattacaaatattatttatgtatttatataaacaatatcatttatatataatattgtcatttatatataattatatgatgaatattatatttatatgtatatgcaaagttttgttattttccttttttgctaaaacaaagttggggccacagtctattaaatgcatgaactacatacatgttttttaaacgttatgtaaaattttatttgttgaccgaggtattagttcatagaagtacgtttgcttagcatacgcatcatttaaaacatccctgcgtacctcgatagataaaatgcttctcacatctgtagaaaaatacataaagcaataccaatatacagaagcagtcgcatctagtacacagatcacaacgtgcgcattacatagaccctctgtcgttcaacacgtgaaggaaagctgttgggttcgaaatcaggtttataaagtagaattggctcctggctaggcagagatgctattgcgaggctggtggaacactttttattctttcttttcctgtattttggagggtcagtagcctgcgaagctccttgtttctgttcactggagtcaggctgcggcaatttaggaatcaggcagtcactccggaggtcctcttagttatgcaaacctaggacgtgtcctcccccattaccctggagagcaatctgcttttgtttaacagagaccatccctttttaatggccaggtggagcagggttagtttgcataagcagtctttccaggaagaaaggaataaggtcccagccaagtacaccagcttttacactgtacatacatctgggtcgcctctaacctaggtcgctgcagacatcagctcttcaaagggggaaatcatagacacacgttgaacccaaggcaggacagccagggtgaaacattttgggggcagctttgattcagccttgaatgtggctgacaatctgagccctttatcaccctggacggtgaatggaaaagtgaatgctatttgggaaacaagggttgaatgggagggatataaagtaataagcggaaatccagtatctgcacaccctccaagcatcatagtcacagatgggtgcgggatccgtcttcagcagggacactgcttggcagcaagcagcctcagatttttaggacctgactctcagcccagtcctccaccccaagggcgctgagaagtaaaactgactcccttcgggaacatgtgatcctgaagttattttttggctatttccaagaagaactgtgattcctcaagagggagattctgaatttggtgctcaaaaggacaggagggtattttagaaggtcaactgtggaggaaaggggacgtgttagcattgtgaatttgtaaagcagatcatgaatttcgttaatttctgcattaatgcattaattgagtttgtatttactattttgccctctctgtaaatggcactcctgtcttctgagttgctcaaatcaaaaccttagtagttgtccttgagtcctccctgtccacagcaaacattcattccagggcacatcctgccaccctgagaagcacctccagttccttccggtacctgggtcccagtcactaggagcctgtgtaagggcatttgcaaaacaaaagtgagaggctgaattctccctgcaggagataaaggaccagacttttccccctctctttcttagagcattttgtttagaaaacctacaactggaagtactttctcagttcctttgaaatgtatgtggatgtttacaaaagctaaataagcctcctgtcagctttaagacctaggaatgtctttccttaggatctgaggccatctctttgaaatgcatcatcaaggaaggtagcgcccatgcctaccccttccaggaaaggacaggagcctaaatcttccgcaggcacctgactccaagttgcaaaacggcctcctttcataaggatgtacaaagtttattttttcttcatataaaaccacagctaccacagatgatcaccccaatttctgggtggatctagaacggactatgtgttgaccaagggttgtgttaagccctcttgctaggggactagttactgtttatcttgagaacaagtctgtaatgacttttatctgcttgataatgaaagagatttctttgcaatttcttagcagattgccagtgacatgaatcgcattctacttgaaagcctattcaacaataatagtgtttttatttttttctctattacttttgtggagaggtttttctgggtaggcagaagttttggttttaattatttatttcccccaacgcacttgcccgaacttccttcttgtctacccccagtgcaatccattctctgcactgcatctaggaagatctgctaagaaggcacatcggttcatgtcacttctttatttaaaaacccttgagtggattcccatcactctagctccacacctggatctgctggtcccgtgggatcagggccctgcctgccacacatccactgtgcctcacccacaccagcccctcattcttccttggaatccatgatctcattcctcacatgggacttctcactggctacacggttccctgaaatgctcctttatctggtctttgcaaaaatccttatttgggtcaccctgaaatgccagtttctcctccaggaagccagttcctcagtcacgctctcacatattaaactcttctattctctgttcacccccattctctttattttatttttttaaatttgtattttttttgtgacagagtctcactctgtcacccaggctggtgtgcagtgactcagtctgggctcactgcaaccgccacctcccgtgttcaagggattctcctgcctcagcctcctgagtagctgggattacaggcatgtgctgccctacccagctaatttttgaatttttgaaagagacggggttttgccatgttggccatgctggcctcgaactcctgacctcaggtgatcttgcccgccttggcatcccaaagtgctgcgattacaggtgtgaaccaccgggcctggactttttattttcttaatcatcaatatttacatggatttctcattcccctgacacactgagagctctgtctttcatggtgccattttagcggttgattaaaaatttttggaattagagttccaattctttctctctttttttgctgtagaaaaaagtgttttagaaagcttacaatttattgcttatagaacttttgtaagtgaattatgttaaggcaagagttattacctttgtggatgcaagtgaaccatgtattcatttttgtattggtgtaagtgaagatctaagggcagaagtgacttcaaaacagcacaaatatggtgagaagctgcctgggtgaggtgtcaggtgtgatgtctcatttgcccctaaatgtttgtgggatgcagggcaagggcagaaagaggctcacagaccatgtgatttgatatgtaaaagtcctcatgccttccttgacaaatgtacattcacagcgatgtgggtggtagctgtggtttgtagtcctcaggctccctggagagcatagctgaaattctgctacctggacgcagactcctcctgctcctggccccctccccgcctgcttgctcgtgaaccgctagcagtgaacccatgacattgtgacccctctgctgacttctcttatttccatgctccttgtatctctgacaaaccatttcagatacaagccaagctgtctaccctcaggaggagaggcccaaagaaaaggcccatccaaccctacgaggcaagctcaggtccatctgggccaggatgccagggtcttgaatacgcagaggatggcccaggacattctcccttccctgtggggagaacatcagccagaggtggcctctgagcctgggtcagcaggcaaggcccccgcccccagttctaaaatagaactgtggcaaacagttaaaccacatctcccaacagttgagattaacatgtgcaggcacagaatgaaatgttacactaaaaaaacaaaaccaacaacaaaaaaccaaattacacatagattcactaagaatcacaatgaaacctccaatctactgtacaaaattaggcaatgtcaataattcacaaggggggagcaggatctccatggaatccatgcattttcatagttccagaagggaagcatgtgctgatgacttaggaattctcaaccccattacaaccacctcccgaaatctgcaggtcgccaattgtttactttctacatcaacatcatcaaaccacacagacaacactcaagcatgaacaacaccggctgtgcaaagtggctcatgtctgtaatcccattgctttgggagcccgaggcaggaggatgacttgaggccaggagtttgagaccagcctgggcaaaatagtgagatgtagcggtgtgacaaacagaaattaaagaatgaagtatgaaaacaggagaagattttcattaaaacctttactgtaataggaagaatgaaattttaacttgcaattagggtgatgacacgttcagccttatccaggacagtactggcttgcacctgttgtctcagatagtgatgaacagcacccatgtttactcttaaaatatcccaatttgaataaaaattacataatcttcccacctatgaagtcctttaaaactggagtttcagaagaataagggaaatggctggaagtgtgagacagacaacagggaaaatccagtgacatcagtgaagcccctctgccaggtacgcctgtaatcaattccctcccttttttttttttttttttttttttgagacgtagtctcgctctgtcgcccagcctggagtacagtggcgcgatctcagctcactgcaagttccacctcctgggttcacgctccctcactctttttactcatgtcagcaatacttgatttgtttttatttcttaagataattttggtaaatttctattatttactgccaaacagctttgactaacacgttctctcccatctctgggccttttgcaaacgtgtccatagctagggacaattttaccctattctcttgttcacttggctaaattctacttactctgttaatcttaggttaaataccacattttcaagactgaggtccttgattcccgcagctctatgataaatgctgtttagaggctccctgaccttttctagtcagaaaaattgttccccgcactccacctcggtctgcttttaccttctctagaaggtgcacttgctgagctcagatgctgtaattgtcctgctcgttgataaaccaagtagcttcacagtgtgcagcgtacagtgggttctcaaaaaatgtttgtcgaatgaagtgtttaaagcacttagcccgagaattggcccctagcaggtattaaatagtaactattataagctgtatcatgatgtaacaaacgatatgaagaatcaagatgcactgtgagttctttttgttgctgctgctgctgttgttattgagatagagactcactctgttgcccagtctggagtgcagcggcgtgatctcagttcactgcaacctctgcctcctgggttcatgtgattctcaatgcctcagccacccgaggagctgcgactacaggcgcccaccaccacgctcggctatttttttgtatttttagtagtgatggcgtttcaccatgttggccaggctggccttgaactcctgaccttgggtgatccgcccaccttggcctcccaaaatgctgggattacagacatgagccatggcacccggcctgtgagatttaagaaaataaaagcaagtaactcaaatgatcaagtctcaaaaaaataagtttacaatcgtataaatacacacacacacatatatacatataggagataatgtaaacatgtaattaaaacattgatgtattaacttcaaacatgtaatgtaaattttgagtgaaaaagaaataatagacatttataataagctccaagaagcaagagaatgtgtttatttccgttttttttaaatctaatcaatttccatgtctaaacttcattagggaaaactttgtttgcaatttagtgatgtttattttgcaaatggctaatggcactgtgtttctatgaaatgtttagaaatggatcgaaaatgctattgcaaagccaactaaattatagacatgaaataaatgtcaaggacaaaattattatattttgcatgtcaggttaaaaactagtgaacagtatttcaaaaatgtaggttattataaaaggtagcatggtataaagcagactccatgtgaccaagtacatatttttgtttatttatttttaattatactttgttttagggtacatgtgcacaacgtgcaggtttgttacatatatatacatgtgccgtgttggtgtggtacacccattaagtcgtcatttaacattaggtatgtctccaaatactatccctccctgatccccccaccccacaacaggccccagtgtgtgatgtttcccttcctgtgtccatgtgtactcattgttcaattcccacctatgagtgagaacatgtggtgtttggttttttatccttgtgatagtttgctgagaatgatggtttccagcttcatccctgtccctacaaaggacatgaactcattattttttatggctggatagtattccatggtatatatgtgccacattttcttaatccagtctgtcattgttgggcatttgggttggttccaagtctttgctattgtgaatagtgccgcaataaacatacgtatgaatgggtctttatagcagcatgatttatagtcctttgtgtatatacccagtaatgggatggctgggtcaaatggtatttctagttctaggtccctgaggaatcgccacactgtcttccacaatcattgaactagtttatggtcccaccaacagtgtaaaagtgttcctatttctccacatcctctccagcacctgttgtttcctgactttttaatggttgattgccattctaactggtgtgagacgatatctcattgtggttttgatttgcatttctctgatggccagtgatgatgagcattttttcatgtgtctgttggctgcataaatgtcttcttttgagaagtgtctgttcatacccctcacccacttgttgatggggttatttgtttttttcttgtaaatttgtttgagttcattgtagattctggatattagccctttgtcagatgagtagattgtgaaaattttctcccattttgtaggttgcctgttcactctgatggtagtttcttttgctgtgcagaagctctttagtttaattagatcccgtttgtcaattttgggttttgttgccattgcttttggtgttttagacatgaagtccttgcccgtgcctatgtcctgaatggtattgcctaggttttcttctagggtttttatggttttaggtctaacatttaagtctttaacccatcttgaattaatttttgtataaggtgtaaggaaggaatccagtttcagctttctacatatggctagccagttttcccagcaccatttattaaatagggaatcctttccccattgcttgtttttgtcaggtttgtcaaagatcagatagttgtagatatgtggcattatttctgagggctctgttctgttgcattggtctatatctctgttttggtaccagtatcatgctgttttggttactgtagccttgtagtatagtttgaagtcaggtagcatgatgcctccagctttgttctcttggcttaggattgacttggcgatgcgggctcttttttggttccatatgaactttaaagtagttttttccaattctgtgaagaaagtcattggtagcttgatggggatggctttgaatctatcaattaccttgggcagcatgggcattttcacaatattgattcttcctacccatgagcatggaatgttcttccatttgtttgtctccttttttatttcattgagcagtggattgtagttctccttgaagaggtccttcacatcccttgtcagttggattcatatgtattttattctctttgaagcagttgtgaatggcagttcactcatgatttggctctttctttgtctgttgttggtgtataagaatgcttgtgatttttgcacattgattttgtatcctgagactttgctgaagttgcttatcagcttaaggatattttgggctgagacaatgcggttttctagatatagaatcatgtcatctgcaaacagggacaatttgacttcctcttttcctaattgaataccttttatttccttctgcctgattgccctggccagaacttccaacactatgttgaatagtagtggtgagagagcgcatccctgtcttgtgacagtttgcaaagggaatgcttccagtttttgcccattcagtatgatattggctgtgggtttgtcatagatagctcttattattttgaaatacgtcccatcaatacctgatttattgagagtttttagaatgaagggctgttgaattttgtcaaaggccatttctgcatctattgggattatcacgtggtttttgtctttggttctgtttatatgctggattacatttattgatttgcatatgttgaaccagccttgcatcccagggatgaagctcacttgatcatggtggataagctttttgatatattgttggattcactttgccagtattttattgaggatttttgctttgatgttcatcagggatattggtctaaaattctctttttttgttgtgtgtctgccaggctttggtatcaggatgatgctggcctcataaaatgagttagggaggattccctctttttctattgattgaatagtttcagaaggaatggtagcagttcctccttatacctctggtagaatttggctgtgaatccatctggtcctggactttttttaggttggtaagctattaattattgcctcaatttcagagcctgttattcgtctcttcagagattcaacttcttcctcgtttagtcttgggagggtgtatgtgtccagaaatttatccatttcttctagattttctagtttatttgcatagaggtgtttatagtattctctgatggtagtttgtatttctgtgggatcggtggtgatattacctttatcattttttattgtgtctatttgattattctctcttttcttctttattagttttgctagcagtctatcaattttgttgatcttttcaaaaaaccagctcctggattcattgattttttgaagggtattttagttatttctttccttctgctagcttttgagtatgtttgctcttggttctccagttcttttaattgtgatgctagggtgtcaattttagatctttcctgctttctcttgtgggcatttagtgctataaatttccctctacacactgctttgtatgtgtcccagagattctggtatgttgtgtctttgctctcgttggtttcaaagaacatctttatttctgccttcatttcgttatttacccagtagtcactcaggagcaggtcgttcagtttccatgtagttgagtggttttgagtgagtttcttatttctgagttctggtttgattgcactgtggtctgagagacagtttgttataatttctgttcttttacatttgctgaggagtgctttacttccaactatgtggtcaattttggactaggtgtggtgtggtgctgaaaagaatgtatattctgttgatttggggtggagagttctgtagatgtctattaggtccacttggagcagtgctgagttcaattcctggatatcctttttaacttcctgtctcattgatctgtctaaagttgagagtgggttgttaaagtctgccattattattgtgtgggagtctaagtctctttgtaggtctctaaggacttgctttatgaatctttttttgttttctgtttgcttggtagatcttcctccatccttttattttgagcctatgtgtgtctctgcaggtgagatgggtttcctgaatacagcacactgtagggtcttgactctttatccaatttgccagtctgtgtcttttagttggagcatttagcccatttacatttaaggtttatattgttatgtgtgaatttgatcctgtcattatgatgttagctggttattttgctcattagttgatgctgtttcttcctagccttgatggtctttacaattttgcatgtttttgcagtggctggtactagttgttcctttccatgtttagtgcttccttcaggagctcttgtagggcaggcctggtggtgacagaatctctcagcatttgcttgtctgtaaaggattttatttctccttcacttaggaagcttagtttggccggatatgaaattctgggttgaaagttcttttctttaagaatgtggaatattggcccccactctcttctggcttgtagagtttctgtcgagagatcagctgttagtctgatgggcttccctttgtgggtaacccgacctttctctctggctgcccttaacattttttccttcattttaactttggtgaatctgacaattatgtgtcttagagttactcttctcgaggggtatatttgtggcattctctgtatttcctgaatgtgaatgttggcctgccttgctagattggggaagttctcctggtttatatcctgcagagtgttttccaacttggttccattctccctgtcactttcaggtacaccaatcagacgtagatttggtcttttcacatagtcccatatttcttggaggctttgttccttttcattcttttttctctaaacttctcttctcacttcatttcattcatttgatcttccatcactgataccctttcttctagttgaccgaattggctattgagacttgtgcatttgtcacttagttctcgagccttggttttcagctccgtcaggtcctttaaggacttctgtgcattggttattctagttagccattcatgtaattttttttcaaggtttttaacttctttgccatgggttcaaacttcctcctttagctcggggtcgtttgctagtctgaagccttcttctctcaacttgtcaaagtcattctccatccagctttgttccattgttggtgaggagctgatttcctttggaggaggagaggtgctctgatttttagagtttacagtttttctgctctgttttttccccatctttgtggttttatctacctttggtctttgatgatggtgatgtacagatggggttttggtgtggatgtccttcctgtttgttagttttcattgtaacagtcaggaccctcagctgccggtctcttggagtttgcggaggtccactccagaacctatttgcctgggtatcagtagcagaggctgcagagcagtggatattggtgaacagcgaatgttgctgcctgaccattcctctggaagtttttctcaggggtgtacccagccgtgtgaggtgtcagtctgcccctactgggggatgcatcccagttaggcttctcgggggacagggacccacttgaggaggcagtctgtccattctcagatctcaagctgtgtgctgggagaaccactactctatgtaaagctgtcagacagggacatttcagtctgcacaggtttctgctgccttttgttgtctgtgccctgcccccagaggtggagcctacagaggcaggcaggcctccttgagctgtggtgggctccacccagttcgagcttcccacctgctttgtttacctactcaagcctgtgcaatggtggacgcccctctcccagccttgctgcagccctgcagtttgatctcagactgctgttctagcaatgagcaaggctctgtgggcgtaggaccctctgagccatgcacgggatataatctcctggtgtgccgtttgctaagcccattgggaaagtgcagtattagggtgggagtgaccggattttccaggtgctgtctgtcaacactttctttgactagaaagggaattccctgacctcttgtgcttcccgggtgatgtgatgcctcatcctgctttggctcacacttggtgtgctgcacccactgtcctgcacccactttccgacactcgccagtgagatgaacctggtacctcagttggaaatgcagaaatcacccatcttctgcatcgttcatgctgggagctgtagactggagctgttcctattcggccatcttggctcccatccaagtacacatttttatagaagacaatgactgagccgggtgaggtggctcacacctgtaatcccaggactttggggggctgaggcagaccaatcacctgaggtcaggagttccagaccagcctggccaacatggtgaaacctcctctgtactaaaaatataaaaattagctgggcgtggtggtggcacctgtaatcccaactactcagggggctgaggcaggagaattgcttgaacctgggaggcagaggtttcagtgggctgatattgtttgacagagcaagactaagtctcaagaaaaaaaaaaaaaaaagagaagaaaggaaggaaagaaaggaaggaaacaaaccacaactgttgtaacaatggcagtaggcagacactgtgccccagcagtacatgttgcagccatcccgaaataagttcattgtccccttctcctaactttttattgatgcttcagatctagctactatatctatagatatataaaagacatctcctttaggatttattgcatgcactaaaaaagctataatcttgccccttttgctttatgtctcctgacaaatgaaccaacaacactggctgtttcttacttttgactctgaatcccacttccaacatgtgtgccttgcaagaacacccacacttccagaactggatcctgcagccacccatatgcctgtcaacacccagaaagtccacctttgatgtctgcatgtttaaatcctgactcagaaaagggacatcttgtgtatgttatttaaccaaaggcatcttttcttgtaagaacactctgagtcacaggattcttattttaatttttcctttccaaggtagttatgttaggaggagatttttcaactcttagccaaaaaaattcacaatgcaaaaatagaatgttaactaacaaaattttacattatctaaaactcagtaaattgagaagagaaaataaaatatttgtaagagaattttcattactattcattcatttattccttcattcagaaatacttctgagggccaggtacagtggctcatgcctgtaatcccagcactttgggaggccaaggtgggtggatcacttgaggtcaggagtttgagaccagcctggccaacatggtgaaaccccatctccgctaaaaacacaaaaatttgctgggtttggtggtgcatccatctgtaatcccagctactcaggaggctgaggcaggagaatcgcttcaacctgggaggcagagttcgcagcaagccaaaaccgtgccactgcactccagcccgcgctataagagtgaaactccatctcaaaacaaacagaaaacttctgagtgcctactgcatgtcagttctactcacttgggacacatcaatcaacaaattaggatctctttccttgtggaggttagattctcaagggaggagataacaatacaaaatacaaccaagtaataaatgaaatattatggatatggacagtgacagtgcgttgggataaagaagacaggagtgtcgatggcactgagagtgctggggggcagttggtggtgatttcaggtgggctggtcatggaagttcccctgagatgatgacacatattttaagatagagacagaatcagccttgcgggtacctggggccaaggctactgagaaggagaactgaagtttctatcaaagaccctaaacggtgggcctagagccttgttggagaagcatggacatttctggggctggagctgagaagggggtggatgatgaggcttccaagggaggtgtgagggcgatcggtgggtggggtgaggggagaattgcaggcagctgcaagggacttggggcttgactcagtgatccaggggccattgctgggttctgaaaatgttacaagggcgtgaagcttatattttaaagaattaatgtagccactgtgttcaggacagaccatggagaggccgtgagaccaggtggaaggctattgcaggggcacggcaggagattggaggagactcagccatgggagatggtgtcgagtagacagacagggccccattctcataaattttataggtatgtccaataaggtttctggatgggctgcatgtgggatatgaaagacagaatatgagaatgaacagggtaaacagacaacctaaagaaagggagaaaatttttccaaaatatgcatctgaaaaatgtctaatatccagcatctataaggaacttggacaaatttacacgacaaaaacaaccccattaaaacatggacaaaggacatgaacagacactttttaaaagaagacatacatgttgccaacaatcgtggaaaaaagctcaccatcactgatcgttagagaaatgcaaattaaaaccaaaatgagataccatctcacaccagttacaatggctattactgaaaaaccgagatataaaagatgctggtgaggttgtggagagaaaggaacacttaaatactgtttgtgcaaatgtaaattagttcaaccattatggaagacagtgtggtgattcctcaaagacctaaagacagaaatatcattggacctagcaatccattattgggtatatgcccaagggaataaaatcattctattataaagacacatgcatgcatatgttcagtgcagcactattcaccacagcaaagccatggaagcaacctaaatgcccatcagtgatagactggataaagaaaacatggtacatatacaccatggaatactatgcagctttaaaaaagaatgagatcatgtcctttacaggaacatggatggagctggaggccattattcttagcaaacaaatgcaggaagagaaaaccaaatactgcatgttttcatttataactgggagctaaacgatgagaacacatggacacataaaggggaacaatagacactgcggtctcccggatggtggaaagtgagaaaagggagaggatcaggaaaaataactaatgggtactaggcttaatagctgggtgatgaatctaggttaggcacaaaggtactccagagctctagggaagccaagggcacctgctacttatatataaagcaggtatcttaaccacagcttttatgacaagacaaattattattccaagggctagggccatattgagctgaaaacattcttattagtatggactcatattccaggtattaacaaagacacctaaataatctgaaaggcgttttctaaaattaataacctgattacagaatggaagacgtatgcatttatgagtttctttgaaaactcatggatttctagttagcatgtgagctctgcaaagcaggaatcttgacttcgttcactcagtcctgcttagctctcagcatggaggctgcaggtttacggacactcagtaatcctgatggcctgaatgaatgagtgaatgaatgaatgaatgagaacccaggatgcatatcattcttaagtattcaaaagaattgaaattttcagtctgatattagcttttctttgtctgtaaggggtaggttattttatttaaaatgacattacaactccattacaatgattagttgttaaacatgatgtgtcttttctcatttgacatgacaaattcctcctcgagattttaatatgtatacaagtgaaatactggagtttctaccccatcctgaaatttactaaattggtgagtctaatgcaaatactaaagcactcactgattgattttgtgttaaatggtctaaaacatgagttggcaaactgtatactggaaatcaaatctggcccatcagctagtattgtagcttgaaagctaagaatggttttacattttttaaatggttaaaaaatatcaaaataaaatattaatttatgacacatgaaattcaaacacatctctgaccactcatacatgcgttgtctgtagctgcctttgggctacacagccacagagctgaggacctgccttggagaccacaggacctgcaaagcctaaaatagctactctctgactcttcagggaaaaggtttgctcctccccggtacagaactataattatgaaataatttttttgcatttatatggcatttttctttgcatgtatatggcatttcccttaccttgctctttcccattaattctcatgtctttgagttaagcaaattgaaaaagtgctttattatctgcttcctcaccctgaattgaactctttatgcatataactaggttatcattttctcaaagttgctcttcagggtgagatcctcgcccagaatagaaacgccacctctgtgaggctccctggctttgggtgttgcaggatcaatgggaaccagcagctggagttttgtgtcgggtgcctccgtgtttcagtggccgaacaggtttggaaaacacatagaaggagtatatcctccagccccatcggggtgcatcaactcagcccagactccagaggaaagacagtggcatggatacaagaacgttccacctaattaaggataaacattcctcatttcatttctgaaaatgtcagagtgcttcaataactacagagagggtccaccgagaacaaacccccctcgaagagcagaggctgaggatggctccagtgcttagggagagaaacatttttgacaatccctttctttatattttccaaagtaatacgtggttcttgagtattacacaaaacaaaatgagaacctcgacctacctcaagagttaggcaaggggctcttcgacttgacaacagaagcacaatccataaaagccaaaatgaataaatgagacttcatcaaaacagaaaagcttttgctctaaaaaagaccctgtgaagaggatggaaagacaagctacagactgggagaaaatgcttgaaagccacgtatctgacaacagactagtgtcttaaaaatataaagaatgctcaagactgaagagtaaagaaaaataaaatcccattagaaaatgggaaaaggaacaacaacaacaacaaacaaataccaaaaaaaacctttcactgtagaggaaacacaggtgagaactataaaacatgaaaagatgctctaaattagtagccattaagcaaataaatgcagagatatcactgcatccttataagcacacttaaatttaaaatttctactatatatgttttctaaatgatgtaaataccatagacaattttatatcgtctgtaaaatatcaaatgttgcataggaggcagaaaaacagaatcacgtacgcgttgctggtgagaatgtaaaatggtacagccattctggaaaattatttggcagttaaaagcaaaacattcaattctgcaattgcattcttgggcatttatctcagagaaatagaaacttacgttcccatgataaagataacaaatatggtgcagtatatacggcttgggtgatgggtgcgccaaaatcctacaaatcaccactgaagaacttactcgtgtaaccaaataccacctgaaccccaaaaacttacagaaaaataaaataattttgaaaagaaaacctgcgcgtgaatgttcatcacagctgtactcataggagtcccaatctggaaattacccaggtgtccttcggcggtgagtgattaaaccaactgctgcctccattccctggagttctctgcaggaatctaaaggaatatgccctggattcatgcaacaagccggccccatcagcacccacagaaaggtactgaatgaagaggccagtccgagagacgacacactgcctgattccctccacagcacatttgtgaaatgatcaaaagtctggaagtacagaatagatgaatggctgccagggattacgaaggcatgcgggccgaggtcaatgggtacggctatcaaagagcagcctgtgggatcctattcctgggggaaatgtcctacttattgatagtatcaatgtcaacgcgtgggctgtgatagtgaactctagttctacaggatgttactcttgggggaaactgggtaaagtgtgcacagggtctctgttttatttgttgccactctaagtggatctatgattaccccaaagtaaaacaagttcaattaaaaaagtaaaggttatgtatgtctgagttgcagtattcatttgaattatggacagtgaatgcaaaccattttatttctaaaattatgctcatatgaatatatatatatatatatatatatatatatatatatatatatatatacacacacatagttaatttcaaaattccgagaggttaaaacattgccaataagcgtcacagaagtcatgtatttctgaatgtacctttgtgatagaaggcaatatgaatctcatgattgtgaaactcctgacaaatattggtaaatctgaagatgacagtatccattttcagcatcacccattgctggggataatgaccattctcttggaataataataaatactaaaccaaagaaagtgtcctttccagttaacataattactgtttatccaagaggcgctataaatgctattacttcgggccaaatgaaaaaaaaaagaaaaagaaaaaatcaaaggacaaagattccctgttaaaacctctgaaaatgtgaaagattatagtcagtggaagcacaggtattaaagtagaggtatagacagaataagtgacattattcaagcaaacatggaatacctggtgtaatctgcccctcgagagttcattgtaatgtctcatagtggaaaatgtcctttaataagcttagtgtttaacaagtacttaatagttataaaaacatgccataatgtatacctattaaacataagtaaatgaattctacaatctacaaaaatgtatgtaatagaaataagtaaattacttttattttgtacaagagggaatgtgaacttcattgcaagagaaaactcagtaggaatcctatgaaaaagtttgttgttaattaaaagacgtaatattcaagaagtattatggacattacagttattaagctaggcaataaatctccttgacccataaattctcatttttgaattcatatgtcacctactttgtgtaataattgtccttatatgttttctcttgcatcatcaactgttattttttttcagagagtttcactttgttgtccaggctggagtgcagtggcatgatcgcagctcactgcaacccctgcctcctgggttcaagcgattctcctgcctcagcctcccgagtacctgggattacaggtgtgtgccaccacatctggctaatttttgtgtttttagataaaatggggtttcaccatgttggccaggctagtctcgaactcctggcctcaagtgatctgcctgccttgacctgccaaagtgctggaattacaggcatgagccaccgtgccaggccttgcttcatccactgttacagttgtattctaattcccctatgtatatatggatacattgggtctttgtttatctcagatgaattcaaagagccttataatcagttattggaaagagaatattactggtctatagtaaatgttcatttttggtaatacattcaagtaatttttgaaatttcttacaaataaatgttttaatatttttagtatgaaattatatttttgagagattgataacatatagttacccaaattagaaaatgtaaaacataaaaataggataagtgaatactgttcacaatagtatttgaatcacttatcccaattaagttcttaagatggcattgtaaagtcaactaactttctttaataaatgaattgtgacttctctgacacaaagacactaatagttttgctttcatcatgtgaagattagacatctgtgggaaaaccaagtatgtctcttctttgatgtgtaaaaatagtacactgtttaaagttattttaaaaacactttttacctaatggtaacgctaacatttaaactttgaatgcagcataaaattctattttttgcatcctcatgaaactgaaagatccttaatttgtttatttaaagagacttcagtttttttcatagtaacaatgaaacgaaatttgaaaattcaaactttatttcccagagatccttttctaaacatttattcacctcaataatatgattaaactgattcccagctttctagcaggtatgaacaataaaaatctgtatattgacacaaggcagacttgaggtgaggaagtaattattagatttcttaggaaacattctctgcgaattcaccagttctttattaacaataagtacctggtttggaatttcattatgttatggaaacctcaggtggcgtagtaatgtgaagatctggtattataacattagtgtgatacagtgctatttacttgtgttctatcttttcctgtttctaagtcaaaattccactcgctatgtgcctttttgccacacaagtgtcaggagaatcttatttctgtcagtttgaatcgagtgaggtgatcaggaggccaaagagagggaaaaatctaatttgagaactgcacactgaatcatttaccacgtaatgcttccctggagtggatatgcctctagaacagagaataaatattaacaatcatttatatttgcagaaaacgtataaatcgaactgcttttgtgtttctttcttctaagggaagtactcatcaaaactgtggggtcgtaaaaagagtattgtgtcctaatttaacttaattaactaggaaatgattgctaatagagtttaatctacatgattaagggtacatagctagtaaagatgaggctaaacccaggccagaaacagtgcctctgttttgcctactgtaaaaactatactgatactatatgtgtgggtgggctgtgtgtgggtgtgtgtggcctgtgtgtgtatacatttttcttgtactcagtgtcagaattgctaacatcggtatagcttatatattctttaataacgatgaatgctgctaagtatattaccagggtctgcaccccagctgtattttaaccacctctgtgagaatttaaattatatgggaaaagcatctttagggcacttcagaaggcaattcaacacaaatctgttgaatagctgctcttgtagctggcaccatgttaaggattgtcactattagagcagagatattaaaaatatttaaggaatttacactctcactagaaccaataactaaaaaataagaatcagaaaataagcacagacacataacgaagaaataatgaaaaaacaagggaagacaaaatgctactaagtgtcaaatgtgaggcagaggaggaagaaatggtaaacgcagaaatcagtgcgaagtatgtatgacctgtgcacgcacgatattcagcaacagccaagcgtgataaagataatttctatgaatcttgtgaaggggggagtgtaagaatcatattaaatgggtcgttatttactctcagggatcagagacgtttcctaaacagagtggtgtttaaccgcaacctgtcatgagaacagaaggggctggagaagggagtgagtcttagagagagggagtagcacactcctgttacctgggaatttgaaggctcaaaaacagcaaagaaataatctgtcaggaaccaagagtgaaggagaggagtgaaggtggagaagcccagtgctggccaacatgaggtcgtgctaggattttattctaatataagtgagaatctgaagaggtttttttctcaaagcagggccctagcttttacctttccttctgccagcatggcctttcttcagcatgactttgatgcagttgcaccctccacacagtccttcagactagggttttgcttggtggagacctgggtgatgcagtagctcaggtggggaagagaaaagcggactgagatcagcttctccatctccttggaggccacaagcaggaaattcagcacttggccagggaaaggggtccagttttggatgcgttatttttagatgtctgcaagatgttcaaatgaacttatctaattggcatcttacaggttcatgaggtagacatgagctggaaatagagagctttgaagttattaccttatgaatccatgtccatgcctgggggaaaaattaatttgcaaagagagagtatgtgcagaaagcagacctgatgtcctgagaccaaccctccaggacacctgcctctcaagggcaagcagaagacaagaggcaaaatagtggccagggagtcagggggctcccgggatgatcatgaaaacctagacgaaagagggttgtaaggcggaaaggcagtagcaccacagttctgcaaggggccgtttaagagaaccacccggccgggcacagtggctcacacctgtaatcccagcactgtgggaggctgaggcgggtggatcacctgagactaggagattgagaccagcctggctaacatggcaaaaccccatttctatgaaaaatacaaaaattagccgggcatggtggtaggcacctgtaatcccagctacttgggaggctgaggcaggagaatcacttgaacccaggaggcagaggttgcagtgagccgagatcatgccattgcattccagcctggtggcagagtgagactccctctcaaaaaaaaaaaaaaaaaaaaaaaagccaggcatggtggcaagcatctgtaatcccagctactcaggaggctaaggcaggagaaccgcttgaacccaggaggcagagtttgcagtgagctgagattataccactgcactccagcctgggcgaaagagtgagacactgtcttaaaaaaaatcaaaaaaaaaaaaaaaggaccaccctcagatgaattggttgaggtgcatggtatttatgacagtgacaagagcagtaatcacagagtgatgagtgtagaaacacaaaaccagctgggttgtggaataacttagaggtcaagaaatgcagacagccaacatagactaaggtataaaattttgctctaaaaggagaagacaaacaagctgacactcatatgtgaacgatggtagttttaggtattatttttaaatgtcagagacttgagcatatttacatacaagaagcaagaagccagagagagggaagggtgaaaatcaggagagaaagaggcttccacccagaggtcgtcccgcggcagccagcgggaatgtctgctggaggaccaccactgcctgggagaggggtcagaattcccaggtaacaggagtgagaaacagtggctcactgctagcttgcatgaccgttggaaggaagtgaagggaaaccccctgatagctttgcgtctcacaaggcgtgatatcccactgggtcatatcccacaagatcatctatcgcgtacgaaaggggtgttgatgcattggaagatttgaaatacaaaggtgcgttggagcaaggcttcgctgcaacaatagatgatggcagttgagcagttgcgtggttggtggccgtgcatgtacactggtaaacaagctgccaggcgtgaggtttcctcaggagctctccggagtccagaggagagaatccaggcagatgctgggccagggagcttccagcacaagggaatgtaacacactggtaagagactttgaggatggcatcgctgctgataggaaagaaatgtgtcccggcaaaagcaaagagccaacatacagtgaggaagcagggatggaaagagaagcagcagtatagagtaacgggctgacatctgatgttttgggttacccggtgggtggggcacactacatgcctcccacagcagctgatgggagtggagcggggagaccaaggggtgcagaggccggggctgatgtcacccagctgggccaaccattgacgggatgtgcaggaccctggcagggccatagggacctgcatagagtcctaactcactggggtgggagatcaaagggcagcagagggcagagcctcagaaatgaggattatgccagaggggaacaggattccatgaagacagggtcattgccctgtgtgggctcagttgcctctgtctgcccttcctggtagttttatgagggacgggccaatctttgccttccacagcattgatctccaatgcccatggggtactcagggcacaataggaagagacgggatatttgtaggtgaatgtatgaactgatatctgaatgaatgaatgaatgaatgagtgaatatcgaatggtaagtttgttgcttcagaatgattacactagtgccatcatgcacacaatgaggccagggcgactttctcccatcagggtgtggtcagatggttcatttcctatttttttttttttttttttttttttgagacggagttttgctctgtcacccaggctggagcgtgatctcagctcactgcaagctccgcctccgaggttcacaccattctcctgcctcaacctcccgagtaactgggactacaggtgcccgccaccacgcccagctgatttttttgtatttttagtagagacagggtttcaccgtgttagccaggatggtctcaatttcctgacctcatccgcccacctcggcctcctaaagtgctgggattacaggcgtgagccaccgtgccaggcccagatggttcattttaatgtttgtcttggtgactggcattttttgtgttctcattactgaaacaatttatttccgaataacatgtttttaaagacattgtgataatccagtgaattaaatgtggaccatttctttctccatggggtactgttgtctacctctgcctacctactcctgtgttgattgggagtttgagacttatcagaaaattttatgcccagggtcctgggggacagtggggcctgaaatgactgttgcctgaggtatggacaaacacccttccaacatgagctggattcatattagcagaaaggtggccataagtgatattccagctagtattttttatagaaagaagctgatattctattgagtaataagtattaaacctccatcctcaagaataggagaagtgccattttacatgtcttgattctctccttcgatttgtaatcaatctcgctaatgttagagaaaatgaatcagagctaaaatcctgtcatcccccagtatacaagacttagaacttcagctaaaccagcatcttactttcaatcaattcaacacgcattcttcgtatctgtgtcatggaccaggtgtccacgggacggaaagctgaatgcagctgtctttgggcctatgctgttcacaatctatgatcctaagtggtcaatcataaaaatgtgcggccagttctctgccagtcccatgaggaagatgccgagagcagaggggagcgatggctccagctacgcttgtcttgtgctgcccttcataggcagagaaacttggaccatcaaccacacaggcttacggctggttttctcccataaaacagtcccagcctgttctgccatgggcagcaccaaaggcctctcctgtaataaacaacaaatgatgttttaaaatgaaaatgcacctattaagttatctttcaataaagtagggagaggtgtcatgtagctgttacattactaccactatttacggagaaatcaatctcgcaaaacctgagaatgaaacatggttgcagagccatttttccctgggactgggggagctgacagtgccacactgagcgtttatttaacccccagagtaaaggtcagctttgtgtgctgaactccattttcgtgagttttatgcatgattaaatggtaattaagctttaatgaaaagtgtcaggctgattacaattaacataattgcagtagtcagttcatgtccttctgttttacatgctgtgcagagctggcaggacagtggacctttaatggggtttggatatctcatgagcctctaaagctcctttttctagtggagaaaatttagtcttccataaagtgaaggtaaacgcacataaagcaaagtttaggtcacaaccctactccattgatggccatcaacatgcacgtagacatgaagcatggaagatgagcaaggactttctctaacctcttctttttttttttttttttttttgagatggagtcttgctctgttgcccagggcgaagtacagtggcactgtcttggcccactgcaacctctgcctcccgggttcaagcgattctcctacctcagactcccaagtagctgggattacaggcacatgccaccatgccttgctaatttttttatctttttatttttagtagagatggggtatcaccatgttggccaggctggccttgaactcctgaccttgtgatccgtctgccttggcctcccaaagtcctgggattacaggcatgagccactgcacctggcctttccatcctcttactagacagttgttgctgcctcaagattattttaaagcagtgaaaaaaaatgatcagttttaatgaagaaaatttaccaggtgatagattaaaaactatggttacttaaaaaatgaccattgaacttcataaaactattctgcctgatttccaactggtatcaaaattttaagtgatcaagagtaaaagaactttatcaagaattataacacttaacaggtcgacacagatgcagcccttttattatataggtataatgtgttctttactcatcaaagcaagtctacagtatcaagtacttctgataataaacatacaaaaccatttactttaaactatttatcaacagtggatgtaaaataatccagaggggaaggaactttgctatttgtattagtctgttttcatgctgctgataaagacatacccaagactgggtaatttataaagaaaagagttttaattgactcacagtttcacatggctggggaggcctcacaattatggcagaaggtaagcaggagcaagtcacatctttttttctttttttttttaattttttatttattattattatactgtaagttttagggtacatgtgcacaacgtacaggttagttacatatgtatacatgtgccatgctggtgcgctgcacccactaacttgtcatctagcaataggtatatctcccaatgctgtccttcccccctccccccaccccacaacagtccccagagtgtgatgttccccttcctgtgttcacgtgttctcattgttcagttcccacctttgagtgagaatatgcggtgtttggttttttgttcttgcgatagtttactgagaatgatgatttccaatttcttccatgtccctacaaagcacatgaactcatcattttttaaggctgcatagtattccatggtgtatatgtgccacattttcttaatccagtctatcattgttggacatttgggttggttccaagtctttgctattgtgaataatgccacaataaacatacgtgtacatgtgtctttatagcagcatgatttatattcctttgggtatatacccagtaatgggatggctgggtcaaatggtatttctagttctagatccctgacgaatgtccacactgacttccacaatggttgaactagtttatagtcccagcaacagtgtaaaagtgttcctatttctccacatcctctccagcacctgttgtttcctcactttttaatgattgccattccaactggtgtgagatggtatctcattgtggttttcaatttgcatttctctgatagccagtgatgatgagcattttttcatgtgttttttggctgcataaatgtcttcttttgagaagtgtctgttcatgtcctttgcccactttttgatggggttgtttgtttttttcttgtaaatttgtttgagttcattatagattgtggatattagccctttgtcagatgagtaggttgtgaaaattttctcccattttgtaggttgcctgttcactctgatggtagtttcttttgctgtgcagaagctcttcagtttaattagatcccatttgtcaattttggcttttgttgcctttgctttttgtgtttgagacatgcagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctgcatatggttagccagttttcccagcaccatttattaaatagggaatgctttccccattgcttgttttactcaggtttgtcaaagatcagatagttgtagatatgcggcgttatttctgagggctctgttctattccattgatctatatctctgttttggtaccagtaccatgctgttttggttacggtagccttgtagcatagtttgaagtcaggtagtctgatgcctccagctttgttcttttggctcaggactgacttggcaatgtgggctcctttttggttccatatgaactttaaagtagttttttccaattctgggaagaaagtcattggtaacttgaaggggatggcattgaatctgtaaattactttgggcagtatggccattttcacgatattgattcttcctacccatgagcatggaatgttcttccatttgtttgtatcttcttttatttccttgagcagtggtttgtagttctccttgaagaggtccttcacatcccttgtaagttggattcctaggtattttattctcttcgaagcaattgtgaatgggagttcactcctgatttggctctctgtttgtctgttgttggtgtataagaatgcttgtgatttttgtacattgattttgtatcctgagactttgctgaagttgcttatcagcttaaggagattttgggctgagacagtggggttttccagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagtcttcaaagggaatgcttctagtttttgcccattcggtatgatattggctgtgggtttgttatagatagctcttattattttgagatacgtcccatcaataccttatttattgagagtttttagtatgaaaggttgttgaattttgtcaaaggccttttctgcgtctattgagataatcatgtggtttttgtctttggttctgtttatatgctggattacatttatagatttgcgtatattgaactagccttgcatcccagggatgaagcccacttgatcatggtggataagctttttgatgtgctgctggattcggtttgccagtattttattgaggatttttacatcaatgttcatcaaggatattggtctaaaattctcttttttggttgtgtctctgccaggctttggtatcaggatgatgctggcctcataaaatgagttagggaggattccctctttttctattgattggaatagtttcagaaggaatggtacaaattcctccttgtacctctggtagaattcggttgtgagtccatctggtcctgcactctttttcgttggtaagctattgattattgccacaatttcagctcctgtttttggtctattcagagattcaacttcttcctggtttagtcttgggagagtgtatgtgtccaggaatttatccatttcttctagattttctagtttatttgcatagaggtgtttgtagtattctctgatggcagttcgtatttctgtgggattggtggtgatatcccctttatcatttttattgtatctatttgattcctctctgtttttttcttagtcttgctagtggtctaccaattttgtggatcctttcaaaaaaccagctcctggattcgttaattttttgaagggttttttgtgtctctatttccttcagttctactctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagactctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagacagtttgttacaatttctgttcttttatatttgctgaggagtgctttacttccaactatgtggtcaattttggagtaggtgtggtgtggtgctgaaaaaaatgtatattctgttgatttggggtggagagttctgtagatgtctattaggtccgcttggtgcagagctgagttaagttcctgggtatgcttgttgactttctgtcttgttgatctgtctaaagttgacagtggggtgttaaagtctcccattattaatgtgtgggagtctaagtctctttgtaggtcactcaggacttgctttatgaatctgggtgctcctgtattgggtgcatatatatttaggatagttagcccttcttgttgaattgatccctttaccattatgtaatggccttctttgtctcttttgatctttgttggtttaaagtctgttttatgagagactaggattgcaacccctgcctttttttgttttccatttgcttggtagatcttcctccatcctttcattttgagcctatgtgtgtctgtacccgtgagatgtgtttcctgaatagtgcacactgatgggtcttgactctgtgtccagtttgccagtctgtgtcttttaattggtgcatttagtccatttacatttaaagttaatattgttatgtgtgaatttgatcctgtcattatgatgttagctggttattttgctcgttagttgatgcagtttcttcctagccttgatggtctttacaatttggcatgattttgccgtgcctggtaccttttgttcctttccatgtttagcgcttccttcaggagctctgttagtgaaggcctggtagtgacaaaatctctcagcatttgcttgtctgtaaagtattttatttctccttcacttatgaagcttagtttggctggatatgaaattctgggttgaaaattcttttctttaagaatgttgaatattggccaccgctctcttctggcttgtagagtttctgtcaagagatctgctgttagtctgatgggcttccctttgagggtaacccaacctttctctctggctgcccttaacattttttccttcatttcacctttggtgaatctgacaattatgtgtcttggtgttgctcttctcgaggagtatctttgtggcattctctgtatttcctgaatgtgaatgttgacctgccttgctagattggggaagttctcctggataatatcctgcagagtgttttcctacttggttccattgtccctgtctctttcaggtacgacaatcagacgtagattcagtcttttcacatagtcccatatttcttggaggctttgctcgtttctttttattcttttttctctaaacttcccttctcgcttcatttcattcatttcatcttccatcactgataccatttcttccagttgatcgcatcggctcctgaggcttctgcattcttcacgtagttctggagctttggttttcagctccatcagctcctttaagcacttctctgtattggttattctagttatacattcttctaaacttttttcatagttttcaacttctttgcctttggtttgaatgtcctcctgtagctcagagtaatttgattgtctgaagccttcttctctcagcttgtcaaactctttctctgttcagctttgttccgttgctggtgaggaactgtgttcctttggaggaggagaggcactctgctttttagagtttccagtttttctgctctgttttttccccatctttgtggttttatctacttttggtctttgatgctgttgatgtacagatgggtttttggtgtggatgtcatttctgtttgttagttttccttctaacagtcaggaccttcagatgcaggtctgttggagtactcggccgtgtgaggtgtcagtctacccctgctgggaggtgcctctcagttaggcttcttgggggtcagggacccacttgaggaggcagtcttcctgttgtcagatctccagctgcatgctgggagaaccactgctctcttcaaagctcagatggaaatgcagaaatcacccatcttctgtgtcgttcacgctgggagctgtagaccggagctgttcctattcgttcatcttggcttctccgactgcaagtcacatcttacatggtggcagagaagagagagcttgtgcagggaaactcccatttataaaaccatgagatctcatgagtcttattcactatcatgagaacagcagaagaaagacctgctcccatgattcgattacctcccactgggtccctcccatgatacgtgggaattgtgggagctacaattcaagataagttttgggtggggacacagccaaaccgtatcattattaaaatagcagttacatatttattaaaggctttactatgaaaattttgaattaagctcagctcaattacaaagcatattgtttacagtagatgaagaggtattcattatgcaaagtcatactaatattttcaacatttatgcacgtggaaaattttcacgcatatctaattagcagacacttgttggatattgattatatgtcatgttctaggaaaacaaagaccatctgccctcaagtaacttaatccactgtattaataaaatggtaacccacaatgggctaagcactattatagaagtataaacattgtgtttggggactggaagtgacaatgtgattgtcttcgctaaagaaacctttgaatgtgagataggcacactggaatttcttgtgcaacaaggcggggaaggtcagtccagtgtgtaacaggaacacacatccaagctgagagaggctagcatctgagtagaggtttctgtaggctttgccagagtggaggatggtgattgaggatgatgttgaaaattgcttaggggaagttttcagagggttttgtggccttatttttggcagtggggagaatgagaagtcaccctggctgagatgagaagataggggagagttctaagcagaagtgaggcgttgcccacgttgctgcggaaaaggttcacctgggtgcctgtgcgcaggtgggccagaaagtacgcaggtgcatgaagaaggaagcccgtgagcaaggcagggcagctcagacccccagcggcgtagaccaaggcggcagggcacaggttgggagaattggattttggatctattttgaatagggactccactgaatgcattgttggattctctgtgtggtgtgagatctacagaggtctaaaaatggctccaaaagtttcatcctgacagcctgagccactggcaggatggagttgactttaccaaaaccgggaagatgtcaaggggcccaggattgggaaaagcatgaacaaggactgtggttgagtttcaggtgttgagttgcctctctgcatctctgcagcaaagcagagacatcaagaaggcaggtggacactcaggggagaagcctgggaggctggctggtgtttccttaggagtaccagaattggacatttattaactagtaatgggattggggggatgaattatgtccaagggttacattaaaccacatggaattgccaacattccatcatttcttccctacaaaagtgacaattttatacagttcaaattggtacacatgaaaagctgagtaaaagaaaagtaagcaagcgtcatttctgcagaaaccttcgtgggtatcttaatgtttgttgcttcttaaaaaatatatggatagagaagaaagggagacccaaggacaagccctcctggcatctgatctttagagtttcaagggaaaaaatatatgaatcagccaaagagccaatgatagagtgacccttggaataaggaggaacaagagagaataataagatgaaaaacaactgaagaaagagtttccagaagagagagtcaaataagtgtttaaaaagctccaatgtaacatggaattacaagatagagaggtagtgcaaccctgatgttaaattattttttaaaatgtacttcaaagtgtgcttgggaaaaatatagtaattcaaatgtgtccaagaaaacaaatattcacataactattttctctccaataatttaatcacacctctaatgcttatttcacatgttactgacatagaatcaagtaaaaatagcctactaagaaatctcatttaatacaattgaataaatgtcatttttgcttggaaacaatggccacacttaaaacatcaatcatatgaggaaaacatttctttttgagttctatttaaaaatttttaaaatcataactaattccaatgttttaaattataaaattagcatggtttatgaatcacaacacaatctaatttataggtaaagttcctcgttttttttttggtcccaggttcataaagacaaaaaaatgagagatttccatcttcccacccatcctcccacctacaaaagagtagtgatggcttcttgggtgtgatggacaggctgttttgcactttgtgaagagtttcccacctttggtttggaaagacaccagcttgatttagtttcatggctggattcgccagtgaggggacgaatgtgggtggagtgagagggacataacagcccagtttcttcctgcagtgaagcagggtaactgggtcagtttcttaattacgactgaggggttataggaaccttcttttctaaaactagaaaaccaggacatgatttattccaggtgtaggagtcaaatgtttatcaggttctcagggagatggagactggtgcccgattctcactggttcccagaagtggcaagctacattttgtggagagtagctgaatgactggctttggggtggtcagaccagcgtcttcgtgttccagcctgagatccttagagagaaacacatgacatgaattactgtggccgcccagaccgttggcccccaaatgagagcacgagggaatataatgactagtggagaggcaggaccatgtccctctctggactcaccacactgaatcatccagcaactccctggccatccaaaattggcagcagattttaaaaatagactggtattggacttcttgtcaactcgaatgcatgggagctagaactggatataatttgtcttaggaaaatgacttttattttacagccctgattgtagtacactcacaggcatttcatatgcttgccaaggtcctttacagaactgtattttttaaaatgccacatggtacgtatgacaatcccagtgggataatttgagagtttcttgcctaaggttgggtttggaaattctaggaagaagggattatattagtctgctctcatgcagctaataaaaacatacctgagactgggtgatttataaaggaaagaggtttaattaactcacagttcagcatggctggggaggcctcaggaaacttacaatcatggaggaaggtgaaggggaagcaaagcaccttctttagagggtgttagaaaggagaagtgcaagcaggagaaatgccagacccttataaaaccaacagatctcatgagacttacttattgtcatgagaacagcatgggggaaactgccctcatgatccaaccacctccacctggtcccacccttgacacatatggattatgagcattacaattcaaggtgagatttgggtggggacgtagaacctaaccgtatcaggaaggttacttggaattagtacagagatccggaaagagatggtcaatgcagcagcttgagcaaagccgtccgtgttgatcttggggcacatcggcccccggggtacctgaagagagaggtactaggcctctgtgccctgacatgccctcctgccccatctcttcacccatgctggggcttcttattggaataacccaatacaggtttgcctcgagagccacagagtagttaaaggaagagaaagtagtagatttggggccaaagggaaaataaatgacatccagcgtggaattatggaagacagaaatgtccttagaaattgatactctatcctcatttcataaataaagtaaaaataacagagacaaaaggtcagtctcaaagcattagaggtcaagatagaaactcacatttccagagttgtagtctagactatgctttttaaatgttgtaccactctaagtttttatatcttgtttttcctttcaataaacttctaaagacaatcttgcagaaaatccttcatttaaatgcctcagagtcaatgttatattctagcccctaaatgagtatttctgaaaatttataccagaatttggatttattaactagtgatagggttggagggatggatcctatccaagtgttacgtgaaaccatgtgaaattgtcaacattcaatcattttttacgtataaaaatgacaatttcatatgattcaaactagtacacatggaaaactgagtaaaaaatagtaattgtcatttctgtagaaactttcatggtgtcttcatgcttatttcttactaaacactaataattaattatatgagaagaaacatttccatgatcctcaaataattataataaagggtcttcttctttttttctacccaagttagaaagatgttctctgaagagagaatcatgaatatatagaaaaaaaagaagtgatggccaggtttcaacagtgattgttaaaacaggaagattttaaaaggccaggagtaaaatgaagtacattctttccacataatccatgaaccctcttcttaggtatctagtcaggtgaactgaaaacttacgtccacacaaaaacctgcacacagatgtttagaggcagctttaggcataattgccaaaattttgaagcaacccgtatgtccttcaataagaaaatgggtaaacaggctgggcgaggtggctcacgcctgtaatcccagcactttgggaggctgaggcaggtggatcacctgaggtaaggagtttgacactagcctggacaggataatgaaaccctgtctaggctaaaaatacaaaaaaatagccaggtgtgttggtgcgtgcttgtaatcccagctactcgggaggctgaggcaggagaattcctggaacccaggaggcagaggctccagtgagccaagatcatgccactgcactccagcctgggcgacaaagcaagactccatctcaaggaaaaaaacgggtaaataaactgtggtacaacaagtcaatagaatattattcgctgctaaaaagaaatgatccgtacagccatgaaaagacctggagcttgaaagtgtcttactaagtgaaagaagacaacatgaaaggccacacactgcgtgattctaactctgtgactttcaggaaaagacaaaactatggagacagtgaaaagagtgattgctaggaattaggaggaaggaagggatgaacaggcagaacacagggaattgttagggcagggaaatgactgttggtgatgttattactacagatgcatttttccaaactcattgatatggtttggatctgcgtccccacccatgttgaattgtaatccccactgttggaggtagtgcctggaggggttgattggatcatgggggtagtttctaatggtttagtaccatcccccagtgctgtcttcatgatagagttctcaggagatctgattgtttaaaagcacgtagcaccttccgcttcactctgtctttccccttccccggtcgtggaagatgtgactgcttcccctttaccttctgccatgactgtaagtttcctgaggccctcccagccatgccttctgtacagcctgctgagttgtgactcaattaaacctcttttcttgataaattacccagtctcagatagttctttacagcaatatgaagatggaataatatacccatggaatgcataacaccaaaagtgaacccggagaaaactgtggatatcggctgataatgatgggtcagtgtaggttcattgattgcaacaaatggaccactctgtggggatgttgacagggaggaggctgtgtgctgtggacagagagcacgtgggaactctgtgccttctactcaatcttactgccagtgcaaaactactctaaaaaaataaaacctgttgaaaaaaatgcctggagaatacagaatggaaagaagaggaaaatgaacataatctcataactttctcaacttttttgttttgctaaataaggccaatgaatcacaattctaccatctgctcttgccaccatttcaaaagattaagaaaattttatatcacaacaaaaaacaagagtgatataattttggagtaaaggactttttttcccccaaggcaggatagttggaacactcttactttcatattttttgtgaaggaccagtgaaaattttaccatgtacaagtactattccacaggcacgtgtttgcaaatcactgttcagagcacagtgaaaccagaggtaagaaattgtgcagactataaccagaggtaagaaattgtgcagactataacctcaattatattagcaaccttttaaagcattaaactgacctaactcaattttcttatgtaaatcctaaatatgacttgtcagtgagctgccaagagataaattgagtctgaatgtgtttgtgtgcaaattccacttgttttatgatgatggctgaccttgtgtgctgcccaataatatggcatctctccacggtgccatccgaagggcactaaaaggctgaactgccacaaaatatctccactccttcctccttcggaaacctttcatcaaaaatgggctagacagcaaaaatggcaactatctttaggagattatagttcacgtgtgcagatgtggtttcacactagtaattcagcagaggttcctctgtcatattagcttcttgaaactttatccctaaggtggaaaaaaaattcacggaccgtcctgaaccgggaagttgcaagcagagaatcaaagcgtgtttgattagcaggttgtttgcagagagacttcattacataaagaaagtgtcagactggggcatgtagggaacctggaatcggggctgggttaggggagccctgaagataggctctacatttatgtagagacccacacctgtcttgcatccaagtctagaaatttactgactaattgaaacctttaaagtcgtacgtttttttttttatgtaactaagtaggtccattgctggtcctgatcttataatgaaaagaattccctaaaacaaaattttcctttgatactgacagtgttcagaaccactccaaaatatgcagttttgaggaaactgcagaagcaggaaagccactccagcctctacttgccccttctgccctgaagcagggcatagaataattctctggccttccttggaagcaggtcatgaaaccttcattccagaaggacactcccaggatgcagaggaaaggaatgaagacatagacacacagggaagaagctgagcaaaggagacttaagttcctccccgtttatcaccactaaattctatcttttcgtcctctaatcatacttctgcacgactatacattaaaacacacaattttctctctttctttgggtcttcatttctgaaggttccagtggcatgcaaaatgcacatcaaatgagtttggttatgcatttctcttaagctggcttctgttatcgtggcctcagccatgaacccagcaatgggggaagagaactcttctctgcaacatgcattttcctaacttcaaattaggctcaataaattgcatctgtgtaaggagacgctggtgaatataaatggagggagatctgtgttcatgacaagactttgatatcaaggtaaagaagaagcacgctgtgccacctactggagaactggatggagaagccagacttgctgatgaagaagtcgctgtcgaactgcagggtgagtgagttgaaggtgctgtggatgtcctccggaagggcggagccactccactccttcagcaggatgtcactgtccaccggcccgtcccagaccttgaggatgtcgtgagccatctccgtgtcgaaaacaatgaaatggaggctgcaagagagaacacagtagcgctacttgccgtgcatcgagcatgtcctgaccccatagctgtaaagtaagcaagctcatttcgctttcacacaacccccaccaacatgtgcctcggtacttactgtctgacaatgaaggatgaggaaaatgaggctcaccgaagataattcaggagtgtaaattaggataaagcacacaggacctcagtctgtcatggacgcagagagataggtgagctagatgctgagctatccattttaggataaaaggattgcttttgagacttccagatctctgtataatttaagctttctacggcacacaaaccaaatataagcttggcattgacagatgtgtttgaagcagatggaaggcagcttcggtgcagtcagtgttgttcacgaaatgccccgctaggtggcagcagccacagcaggagaaaagagcttactccattacgaccttttctacctgtgtctgaatggtctgctcttgtgttgtacttctttctaaaaattatattttaaaacttcatcatttaaaataccaacagaaaggcaaaaatgggtaacataaactcccttctttataaaattttaccatacttctattagacttccaggtatttttcagagtgacttaaaaatctctatgcctaaggactcacattcagaggcagcaggatctatgtagtcctatttagggccattgaagcaagaagggtttagttgaaacaccaacaaaaattagcagccctgaatgggtctgatttacagttttttatttcctgcgtattgcacaccgattacaagggaggtaaagtcacagtggacgacaaacaaaaaaactacccacgagtctcaactgctttgttttgcatatattacatgtttaaagaaaacacttatgtcaccctgtgtaaggtatggaatgtgtggtgtatttttaaaataatcaagataaatccttaaatatagagaaaagtatagcagatagtagatctttattttcctacattttgccctatttttgtcagaactttttttttttttctagagatgggatgtcgctccctctcctaggctggagtgcagtgtcatgatcttggctcactgcaacctctacttcctgggttcaagtgattctcctgcctcagcctcccaagaagctaggactacaagcatgagctgtcatgttcagttattattagtattattatttgtatttatagtagacatggggtttcaccaagttgaccaggctggtcttgaactcctcacctcaggtgatccacctgcctcggcctcccaaagtgctgtgattacaggcatgagccaccacgcccagaccagaactttttataaaacaaaaaatcttatacatgcaacaattttttgcctccactccaccaaatcattggttctttctcttatcacacactctgaagttgtaatgtaatatccccatttgtgtatatatatatatattttattattattatactttaaattttaaggtaaatgtgcacaacgtgcaggtttgttacatgtgtatacatgtgccatgttggtctgctgcacccattaactcaccatttaacattagataaatttcctaatgctatccctccccacttcccacaacaggccccagtgtgtgatgttccccttcctgtgtccatgtgttctcactgttcaactcccacctatgagtgagaacatgaggcgtttggttttttgtccttgagatagtttgctgagaatcatggtttccagcttcatccatgtccctacaaaggacatgaactcatacttctttatggctgcatagcattccatggcgtatatgtgctacaatttcttaatccagtctatcattgttggacatttgggttggttccaagtctttgctattgtgaatagtgccgctataaacatacgtgtgcatgtgtctttatagcagcatgatttataatcctttgggtatatacccagtaatgggatggctgggtcaaatggtatttccagttctagatccctgaggaatggccacactgacttccacaatggttgaactagtttacagtcccaccaagagtgtgaaagtgttcctatttctccacatcctctccagcacctgttttttcctgacttgttaatgatcgccattctaactggtgtgagatggtatctcattgtggttttgatttgcatttctctgatggccggtgataatgagcattttttcatatgttttttggctgcataaatgtcttcttttgagaagtgtctgttcatatccttcacccacttattgaaggggttgtttttttcttgtaaatttgttagagttcattgtagattctggttattagccctttgtcagatgagtagattgcaaaaattttctcccattctgtaggttgagtgttgactctgatggtagtttcttgtgctgtgcagaagctctttagtttatttagatcccatttgtcaattttggcttttgttgccattgcttttggtgttttagacatgaagtccttgcccatgcctatgtcctgaatggtattgcttaggttttcttctagggtttttatggttttagttctaacatttaagtctttaatccatcttgaattaatttttgtataaggtgtaaggaagggatccagtttcagctttctacatatggctagccagttttcccagcaccatttattaaatagggaatgctttccccattgcttgtttttatcaggtttgtcaaagatcagatagttgtagatatgcagcattatttctgagggctctgttctgttccattggtctctatctctgttttggttactgtagccttgtagtacagtttgaagtcaggtagggtgatgcctccagctttgttcttttggcttaggattgacttggtgattcgggctcttttttggttccatatgaactttaaagtagttttttctaattctgtgaagaaagtcattggtaacttgaaggggatggcattgaatctataaattaccttgggcagtatggccattttcacaatattgattcttcctacctatgagcatggaatgttcttccatttgtttgtatcctcttttatttccttgagcagtggtttgtagttctccctgaagaggtccttcacatcccttgtaagttggattcctaggtattttattctctttgaagcaattgtgaatgggagttcactcatgatttggctctctgtttgtctgttattggcatatgagaatgcttgtgatttttgcacattgattttgtatcctgagactttgctgaagttgcccatcagcttaaggagatttggggctgagacgatggggttttctccatatacaatcacgtcatctgccaacagggacaatttgacttcctcttttcctaattgaatactctttatttcctccagctgcctgattgccctggccagaacttccaacactatgttgaataggactggtgagagagggcatccctctcttgtgccagtttgcaaagggaatgcttccagtttttgcctattcagtatgatattggctgtgggtttgtcatagatagctcttattattttgagatacgtcccatcaataccttatttattgagagtttttagcatgaaaggttgttgaattttgtcaaaggccttttctgcatctattgagataatcatgtggtttttgtctttggttctgtttatatgctggattacatttatcgattttcatttgttgaacaagccatgcatcccagggatgaagcccacttgatcattgtggataagctttttgatgtattgctggatttggtttgccagtattttattgaggatttttgcatcgatgttcatcagggatattggtctaaagttctctttttttgttctttttctgccaggctttggtatgaggatgatgttggcctcataaaacgagggaggattccttctttttctattgattggaatagtttcagaaggaatggtaccagctcctccttgtacctctggtagaattcggctgtgaatccatctggtcctggactttttttggttggtaagctactgattattgcctcaatttcagaccctgttattggtctattcagagattcaacttcttcctggtttagtcttggcaggatgtatgtgtcgaagaatttatccatttcttctagattttctagtttatttgcatagaggtgtttatagtattctctgatggtagtttgtatttctgtgggatgggtggtgatatcccttttatcattttttattgtgtctatttgattcttctctcttttcttctttatttttcttgatagcagtttatcaattttgttgatcttttcaaaaaaccagctcctggattcattgattttttgaagggtttttctcttttttatatagactaattcctataattgtatttcttttattttattttattattatactttaagttttagggtacatgtgcacaacctacaggtttgttgcatatgtatacatgtgccatgctggtgtgctacacccattaactcatcatttaacattaggtatatctcctaatgctatccctccccactccccctaccccacaacagtccccggtgtgtgatgttccccttcctgtgtccgtgtgttctcattgttcaattcccacctatgagggagaacatgcggtatttagttttttgtccttgagatagtttgctgagaatgatggtttccagcttcatccatgtccctacaaagcacatgaactcatcattttttatggctgcatagtattccatggtgtatatgtgccacattttcttaatccagtctatcgttgttggacatttaggttggttccacgtctttgctattgtgaatagtgccgctataaacatacgtgtgcatgtgtctttatagcagcatgatttataatcctttgggtatatacccagtaatgggatggctgggtcaaatggtatttctagttctagatccctgaggaatcgccacactgacttcacaatggttgaactagtttacagtcccaccaacagtgtaaaagtgttcctatttctccatatcctctccagcacctgttttttcctgacttgttaatgatcgccattctaactggtgtgagatggtatctcattgtggttttgatttgcatttctctgatggccggtgatgatgagcattttttcatgtgtcttttggctgcataaatgtcttcttttgagaagtgtctgttcatatcctttgcccactttttgatggggttgtttgtttttttcttgaaaatttgttggagttcattgtagattctggatattagccctttgtcagatgaggaggttgcaataattttctcccattctgtaggttgcctgttcactctgatggtagtttcttttgctgtgcagaagctctttagtttaattagataccatttgtcagttttggcttttgttgccattgcttttggcattttagacatgaagtccttacccatgcctgtgtcctgaatggtattgtttaggttttcttctagggtttttatagtattaggtctaacatttaagtctttaatccatcttgaattaatttttgtgtaaggtgtaaggaagggatccagtttcagctttctacatatggctagccagttttcccagcaccatttattaaatagggaatgctttccccattgcttgtttttgtcaggtttgtcaaagatcagatagttgtagatatgcagcattatttctgagggctctgttctgttccattggtctctatctctgttttggtaccagtaccatgctgttttggttactgtagccttgtagtgtagtatgaagtcaggtagcgtgatgcctccagctttgttcttttggcttaggattgacttggtgatttgggctcttttttggttccatatgaactttaaagtagttttttctaattctgtgaagaaagtcattggtaacttgaaggggatggcattgaatctataagttaccttgggcggtatggccattttcacaatattgattcttcctacctatgagcatggaatgttcttccatttgtttgtatccttttatttccttgagcagtggtttgtagttctccttgaagaggtccttcacatcccttgtaagttggattgctaggtattttgttctctttgaagcaattgtgaatgggagttcactcatgatttggctctctgtttgtctgttattggcgtatgagaatagttgtgatttttgcacattgattttgtatcctgagactttgctgaagttgcttatcagcttaaggagattttgggctgagacaatggggttttctagatatacaatcatgtcatctgccaacagggacaatttgacttcctcttttcctaattgaatactctttatttctttctcgtgcctaattgccctggccggaacttccaacactatattgaataggagtggtgagagagggcatcctggtcttgtgcctgttttcaaagggaatgcttccagtttttcccattcagtatgatattggctgtgggtttgtcatagatagctcttattattttgagatacgtcccatcaacacctaattttttgagagtttttagcatgaagggttgttgaattttgtcaaaggccttttctgcatcttttgagataatcatgtggtttttgtcgttggttctgtttatatgctagattacatttattgattttcgtatgttgaagcagccttgcatcccagggatgaaacccacttgatcattgtggataaactttttgatgtattgctggattccatttgccagtattttattgaggatttttgcatcgatgttcataagggatattggtctaaaattctctttttttgttgtgtctctgtcaggctttgctttcagggtgatgctggccccataaaataagttagggaggattcccatctttttcttttgattggaataattgaataaggattggtagcagctcctttttgtacctctggcagaattggactgtgaatccatctggtcctcgactttttttggttggtaagctattgattattgcctcaatttcagaccctgttattggtctattcagagattcaacttcttcctggtttagtcttgggaggatgtatgtgtcgaggaatttatccattttttctagatattctagtttatttgcatagaggtgtttatagtattctctgatggtagtttgtgtttctgtgggatcggtggtgatattacctttatcattttttattatgtctatttgattcttctctcttttcttctttatttgtcttgctagtggtttatcagttttgttgatctgtccaaaaagtcagctcctggattcattgacttttttaagggttttttgcgtctctatttccttcagttctgctccgatcttagttatttcttgccttctgctagcttttgaatgtgtttgttcttgcttttctagttcttttaattgtgatgttagggtgtcaattttagatctttcctgctttctcttgtgggcatttagtgctataaattttcctctacacactgctttgaatgtgtcccagagattctggtatgttgtgtctttgttctcgttggtttcaaagaacatctttatttctgccttcatttcattatttactcagtagtcattcaggagcaggttgttcagtttccatatagttgagcagtgttgaatgagtttctttatcttgagttctagtttgattgcactgtggtctgagagacagtttgttgtaatttctgttcctttacatttgctgaggagtgctttacttccaactatgtggtcagttttggagtaggtgtggtgtggtgctgaaaagaatgtatattttgttgatttggggtggagagttctgtagatgtctattaggtccgcttggtgcagagctgagttcaattcctgggtatccttgttaactttctgtctcgttgatctgtctaatgttgacagtggggtgttaaagtctcccattattattgtgtgggtgtctgagtctctttgtaggtgtctaaggacttgcttcaagaatctgcgtgctcctgtattgggtacatatatatttaggagagctagcttttcttgttgaattgatccctttaccattatgtaatggccttctttgtctcttttgatctttgttggtttaaagtctgttttatcagagactaggatggcaacccctgccttttttgttttccatttgcttggtagatcttcctccatccttttattttgagcctatgtgtgtctctgcaagttagatgggtttcctgaatagagcacactgatgggtcttgactttttatgcaatttgccagtctctgtcttttaattggagcatttagcccatttacatttaaggttaatattgttatgtgtgaatttgatcctgtcattatgatgttagctggttattttgctcgttagttgatgcagtttcttcctagtctcgatggtctttacattttggcatgattttgcagtggctggtaccggttgttcctttccatgtttagtgcttccttcaggaggtcttttagggcaggcctggtggtgacaaaatctctcagcatttgcttgtgtgtaaagtattttatttctccttcacttatgaagcttagtttggctggatatgaaattctgggttgaaaattctttcttttaagaatgttgaatattgcccccactctcttctggcttgtagagtttttgccgagagatccgctgttggtctgatgggcttccttttgtgggtaaccggacctttctctctggctgcctttaacattttttccttcatttcaactttggtgaatctgacaattatgtgtctttgagttgctcttctcgaggagtatctttgtggcgttctctggatttcctgaatttgaatgttggcctgccttgctagattggggaatttctcctggttaatatcctgcagagtgttttccaacttggttccattctccctgtcacttttaggtacaccaatcagacgtagattcggtcttttcacatagtcccatatttcttggaggctttgtttgtttctttttattctttttttctctaaacttctcttcttgcttcatttcattcatttcatcttccatcactgataccttgtcttcctgttgattgtattggctactgaggcttgtgcatttgtcacgtagtcctcgtgccttggttttcagctacatcaggtcctttaaggacttctgtgcattggttattctagttagccattcgtttaattttttttacaaggtttttaacttctttgccatgggttcaaacttcctcctgtagctcagagtagtttgatcatctgaagccttcttctctcaacttgtcaaagtcattctccatccagctttgttccattgctggtgaggagctgtgttcctttggaggaggagaggtgttctgatttttagtttgcagtttttctgctctgttttttccccatctttgtggttttatctacctttggtctttgatgatgatgacgtacagatggggttttggtgtggatgtcctttctgtttgttagttttccttctaacagtcaggaccctcagctgcacatctgttggagtttgctggaggtgcactccggaccctgtttgcctgggtatcagcagcagagactgcagaacagcagatgttggtgaacagcaaatgctgctgtctgatcattcctctggaagttttgtctcagagtaccaggccgtgtgaggtgtctgttggcccctactggggggtgcctcccagttaggctactcaggggtcagggacccccttgaggaggcagtctgtctgttctgagatctcaagctgtgtgctgggagatccactacgctcttcaaagctgtcagacagggacatttaagtctgcagaggtttctgctgccttctgttggtctgtgccctgcctgcagaggtggagtctacagaggcaggcaggcttccttgagctgtggtgggctccacccagttcaagcttctgggccgtttttttagtcattcaagccttggcaatggcgggcgcccctcccccagcctcgctgcagccttgcagtttgatctgactgctgtgctagcaatgagtgaggctccgtgggggtaggaccctctgagtcatgcacgggatataatctcctggtgtgccgtttgctaagaccattggaaaagcaagcccagtattagggtgggagtgacccgattttccaggtgccatctgtcacccctttctttgactaggatagggaattccctgaccccttgcacttcctgggtgagttgatgcctccccctgctttggctcccgcttggtgggctgcacccattgtcctgcacccactttccgacactccccagtgagatgtacccggtaccttagttggaaatggagaaatcgcccgtcttctgcgtcattcatgctgggagctgtagactggagctgttcctatttggccatcttggctccacccatcccatttatatttttagaagcttcatatgtgtgtgtatttgtattcctaaacaatatattgtactactctgtgtgtttaagagtagttacatattaaatattacttgacatgtgtgtgcttgtatcactttcaatttgcttttattttatttatttattttattttatttgagatggagtcttgctttgttgcccaggttggagtgcagtggtgtgatcttggctcactggaagctctgccacccgggttcatgccattctcctgcctcagcctcccgagtagctgggactacaggtgcccaccaccacacatggctaatttttttgtattttttagtagacacggggtttcactgtgttagccaggaaggtctcgatctcctgaccttgtgatccacccgcctcggcctcccaaagtgctgggattagaggtgtgagccactgagcccagcctcaatttgcttttgtactattatgggagagaccgttatactgaaaaaaaggtagaactttgttaatttactttaaaactgtaagtgttttattttcgtagttccttactaaaggtcagtttgtttctacattttaattttgacacgtggtaccgcactgtatattccactgtactgatgcaaggatctttctaggccagcatgataaagcagatttgctaactcgctctcccttgggattctaactgctttggtccagggtaatgtatgtattgcccttgttttattatatctttaggaatacctgattaccgtcagactaagagttctacatatatatagaaaatttgatggttgtggaatggtgtcttgtttaaattactttccctgatcactcataaagttgatcatcattttgcatctataagacgttccctttttgatttagttcaataattcaacatttactcggcaccaagagtgtactgagtgcacctcgaggaactttgcatacatctgccaagttgagtcctgccttcgtggagttcgtgttgtacagggaagagataggcaaaccacagcatccacaataatacagggaagagacaggcagtccacagcacccataacaaatgagtgaagaatatggaatgttagtaggtggtaaatgcaattgaagaaataaaaaagtagacaggaaaagaatcactgggatactaattcttaggggaggaaggggaagcctgaagtattaaatggggtggttaggctaagccatcttggcagaggcagattttggtgcagccttgaaggagttaagggtgtttgtcgcatcctgtgagacgtaagaattcagccaagcagaagccccacgtaaggggcataccgtccgcatttgaggacagccaggagccagtgcagcaagaacagaggaagggggactgggaaggaagagctgagagcagagaagaatgggggttgtgaattggatggtgggagagaggtgcctacgcacagagggctttgtaggctgttttaaggatgatacaccgatgcgggattttaaggatgatataccaaggcaggagtcctcaccaacaatttaaagaactggccgtgcttgcttgctctgttgacaacatgccatggagggaaaatgacactctgtcaacgttttgagtaatccaagaaagtggcgtatgtgctgagatgagctgaatatggaggtacccaggcactggtcaggtcctggatacgttttgaagggagagaaaacaggcttggaagaggtgtgcgtgaggtgaggatgtgctggccctgtaggtttgtccctcagaaactggaaaagtggagttgtcatccagtgaactgagaaacggtgcagtatgtttatgggatggggaaaatcagagtttctgtcttggacctgttgagtttaagttgtcaactagacatagatggaggggtatgtaggtagctgttcacgtaagttggagtttcagagagaagtcagagtggagaaaataaacatgtatgtcttcaacaaagaaatagtttataaactataggactggatgaaatcttcgaagttcttaggtggagaatagaagaggactatggattctgaagtacctggtcacatatgtttgccattaagcagaaagcatcctagagctggaaataattctaataaaaaatgtgcaggactttcacccagaaaactgcaaaacatcattgagacaaatcatacaaaagctaaataaatggagaggtatacaatatcaaggaccagaaagttcagtattataaaagatgtcagttttccccagaatgatctattgatgtcatgggatatcaataaaaatccaggcaatttcttttgtaaaaaattaagagtgtttctgaaattcatatggaagtgcagaaggccaagaatagtcacagtgatctatatgaagaagaacaaagctagattatgatactgggtatcaagatgtattataaagtaaatcaggaattaagttaggttttgtactagataagcaaatagataaatgaaatggaatacagtttggaaacagatctgcatagatctagttgtctcgttaattactaatttgtactatagtgcaataaagaaataaatcacttcagcaaattgtcaattgaacttaactgtggacaaaaatctgtgacacttcagtctccatactgtacacaaaaatttatccccagtggaatagagatgtaaatgtgaaaggtaaattaagttttgtagaagaaaacctaagataatatttgtatagctttggggagggaggagctagcaatctggacacaaaatcactaaagccaaccttaacaaagtttgtggcatagcatacatttaaatatagtttaaaaatttgctaaccgtaaagaaaaaaaatgagtaaaaattattatgactcattggaattaaaaacctgtgtttatcaaaagaaatcatttcagtataaaaaaatgggcaaaaggcttcaactggcaattagtaaaagaggatattcaaaaggccaataaacatataaaaaagtgtttaccttgatcagtcgtcagggaaatgcaaataaaaaggtaccacacccccagtagaatggctaaaatgaaaaaacaatcaatcccattgttggttagaaagtgaagttcctgaaattctctcatatacaccctctcagggagtgagggtaagaataaccactttggaaaactgatagcacctaatactgtggaaggtaggattcaccattacccagcaattcctggcctcagtgtatacccatggaaaaagcatacatacattcaccaggtaacatgtcaaagcatattaaaagcagcacagtttgcattaactccaaactgcatcagaaccatccaaatgtccatcagcacccagaatggataaataaattatatcaggaaatatctaacggtatcaatgggtgtgaagattgaggaaatgaagtgagacacataattaataaaactgtacaatctctctctctcttttttagacagagtcttgatctgttgaccaggctggagtgcaatggaatgatcgtggctcactgcaacctctgcctcccaggctcaagcaattcttctgcctcagcctcccgagtagctgggattataggcgtgtgccaacacaacttgcttattttttaatttttaatagagacggagtttcaccatgttgatcaggttggtcttgaactcctgatctcaggtaatctgcccgcctcagcctcccaaagtgctaggattacaggcgtaagccatcgtgcccgacaattatcttttacataaaattcaaatttggcaaaactcttctgaagtcttaatagtgattgtcctggagaagagacaatttgaatagagctcaaaggtctatcctgagtccagataattttccctttctttatctgagttctggttacatgggggtgtttcttttgtgaacaagccacatggcagtttttatgctatatgctaatgagaagcttacacagaaaaacaaacatgcaccctggtaccatggagttttgccatcttggaaaatgtctcatgactccaacaaaaaatatgatacaacaaaacttaaatgtaggtaagtgtcagtcattttttattcaaatgtaaaattgttaaaagtcaaaatgccagacacaattccactaggtaaaggaagttaaaaaaaatggagtgaagccaggtatggtggctcacgcctgtaatcccagtattttgggaggccgaggtgggtggatcgcctgaggtcaggagttcgagaccagcctggccaatatggggaaaccctgtctctactaaaaatataaaaatcagctgggcatggtggcagacacctgtaatcccagctactcaggaggctcaggcaggagcattgcttgaactctggaggtggaggttgcagtgagccaagatcacgctattgcactccagcctgggggacaagagcaacactttgtctcaaaaaaaaaggaatgcaatgtggtatcatcgctaaggaactctgtgatatcagatacaggcacgtgaggaaaagcacacatcctccaacgcacagtgtcccaaggtctggcagataaaagcacgccaccatacagcggacataggtgtaattctgcctcacaaagtgtgggaaggctcttgtccagccaagagaaagcaggaaaggaatccagggaaaggagagaaccggaaatgcaggtgggaggtgaagtgcacagagaagaggaagtcactaaccaaatgtattcacatgtcaaaaaagtcaacataggaaaggtataaacagatataaccaataaaatgtttggaatattttttttctggacagattgttaaggactgaaaagcctttgtccagtttcagagagaatgtagagacgcccaatttctatgtactgctggtggtatatctactccttttagaggcaatttggtaatggctataaaaattgaaatgtgcaaacatagcaaatgcagctctagaaattcatcatgaaaagtgccctggaggtgacacacggggaggatggtagcattacttacaacagtgaaaaaattaaaaacaacctgaatattccaaaagggtgtagtttaaataaattaaggcacattcaggcaatggaatactatccggtaactaaataggatgaggcaaaattacaaatttggatgtaaacatttggccatgtttattaactcaaaataaatgttcagaataacatggcgtaaaaaataattaaataaaaagataaatgaacatatcacattttatgtttgtatttgcatagaaaaaattttaaaaagctatatcaccttttcaagtgtagttttctttggtgtttaagattacagaaaactacatttaggggtttttttttctgcagcactttattattttaaaattaagaaaaataattaaccataaaccatgccaaagagcttatcctgcacataatgagtggacaaaatagtttttgtttttatagcaagctcaggcgagtgaaatgactgactctgctttatagaaagacttgtactaagacatatgaggatgctcacaccctttgacccagcaaacaaatttcctaggcatttattctaaggaattatataaatataagcaaagatttacttacaagactacttgtcacatcattatgtacaacatgaaaaattagaaatggccaggcctggtggctcacgcttctaatcccagtgctttgggaggacgaggcgggcagatcattggaggtcaggagtttgagactagcctggcaacagggcgaaaccccgtgtctactaaaaatacaaaaaaaattagctgggtgtggtggcacatgcatgtaatcccagctactcaggacactgaggcaggagaattgcttgaacccaggaggctgaggttgcagtgagccaggattgcgccaccgcactccagcctggacaacagagtgagactctgtctcaaaaaaaaaaaaaaaaaaaaaaagagaaagaaaaattagaaatggtataaacaagcaacaagagagacaatgtttaatggtacatgtccacaccacacaatatacattgatacgtataagacatttgccattgatgtctataggggaataatacatgatttcttcaattgtttttttttaattttttcaaaatctatatagacattagttttatagacataaacataaatttttaaaataaaacaaaccatattgtttggggtaggagcagtgggtgcaaggcagcgtttgcagggtggtcagtggaaacctggtgagttaggagggtctacccagcgaaggaaccaggtggtgggcagggaggagagtttgggaggcttcagatggggtctaaatgagaaatgaagctcacagaagtgtgggagctagtgaaacttgccctggaggtcttgacatgtggatatgatattaacagagattattagtacagaaggaaggtaactgatgaagagaaatgatgagatcagggaacaacacagaatatttctggatgggataataaaaatgaatttttgctgagccctaagagatgggaagaaactggaggtgagtcaatgaggagaaactcaagacagtgtgtgtaaagagagcaccacagtagcacaggctatgatcagagatcagtcaagctttctttgtcctgaagtcgaaagtatccatgagcagccaaagatacacctggaaagccgcactaagccaaattctagagggtattatggttctgggtaaggagctggtgcttgtcaacgtacagtgagggtatttgagagattggagagaataaaggatggatttgggaaggtcagttgagagaagactaaagtaacaggaaagtcatgggaattcataatggtggataagaagaaaggaaacataaagagatggagaaatgacagggctttgttttcagattctatgcacttttttttcagtgtctcgtctaaagaaatctcatataatttatcaaaagaattccatgagctgtacagtcctattttcattgttttaggtgggaaattattggatattgagggaggagaaataagcaacagcagagcataacactgaagactaaagtctcccgccccttggagggagacagtaacacaaatagggaatgatgacaataatgatgaaataatgatgaaatgtgaggagttgggaacacgtgatgagctctgaggagagatgtcagggaagtttggatcagcttccaccattttatctcttgtgcttttcagatcctgaaataactctagaagtttctttaatgtttttttctggagtcacttcttctggaatatctccatcgttctcatcacagcatctcctcccttacactcctacgtccttcttggctgagtttccctggctgcctatctaaggtctctccgcacagcagtggcaatgttcccacctcagctatttctcctgtaattccatttatgtgtgatttgagtttcacttcccatgatatcacttctcatttcttccctgcatgtctatcttttctgggcaattccttctttgcaattcccgttttttaagacatcaagtgcactgatcactgggagcaaagaagacaacacaactaccctctttgctgtctgagaatgcactgaatagcaggcaccctgtgagcagtcaccagcagatgttgaaagaggagatgtgatctgtcaccagtgatgatgatgtgcctcgttatccatatagtgatgtaggaactgaagagctcagaatttgtccttcatgcactttctcacagtttatgtaccatggcagctgaaatgtgagtggtatggttgggagctggtgttatttaactaatctgtggcaactgaaaatatgagtcagaactttgcaaagtgagtggggttgcaggtttctttcctctgactcaggctctcctacatgtctggtaaggtcacccatgaccagcaactgctcccagagccccaggttaaagggggtctggagtagcagccataggcatagggaaaaactgtagacttctataactcttttacttcatggctgaaattacttaaattgttatttctttgtattgtctatgaaaactaagggaagggtctatagtgatgttgataggaatggagaaattggacatgcttttattcctgagtggcctcatacctttctgtcctgtcaggaaaattctccaacccatggtctatgtacagaggctggacatggagactggggataaatgtatagttttctcttaagtgtatttcctactgggatctggaaggttgatcagaaatggattaatattcctagatctccagtgcaatttcactctaatctctctaaaagctgatgccactagaaagaaaatccaggtcaggacagccagcagaacaccagggtcgtcaaaccacatgttaccttttctaaaagtctgcataggaatgcttttgacaaccttgatacctttttgatatgcgtccaatgtttttcatactgtgcgagcttattaaaaataattcccttcaactatactaccaaatgcaattttctgctaacaattaggaacagaagtacattcaaagtgagctttccagacaattacactggcagaaaagcaattaaagcttaggaacagtgtacacatatggttatgtaaaacatagcctttaatgttgctagctgaagaagtttataatgctgttacttttgttacataaagcaaagcatggctgtgcccagcaatgaaatatgctggatctcttagagaaatattaccaaataactttcaatggggctaaattttctacaatgtcttgtgattagacttttaattaaatttggctcaggtaactgctctatagcatacatgttaaaattagaaattcttccagacccaagtgccccataataataactattttggggtattgcgccccattataataactattttggggtattcgattacctcaaacaaagaggaatagcactatataagcagaagttgctctgggcctcaatgaaatcaatgtagctctgcaataattggcctaaagtaaaatattgaaaccagccttttcatattttccaagatccggctgtttattcattccttgagagtgaaaaatatttacattaagatatcatagtataaatgcatagtaatgattacatttatattaagatattttaaagagctaaattaatccctgtgttcatatttatatgactgatgtatttctcattttcaagttaacattgtaggtaatacagactatgttaccattgaaataaataagacttagtaaccatgcaagctaatatcaaggctaagaccagacaccattttttctgagtattagtacaattttaagtacatgatatacaattttagtatattatgtacttctaattatggttttgccagatcaccatactaaaaattgcatttatgttattcatgaagagtggttcaatcatcaaaaacattttgggattaagttgattgtcaattgaggaaattaaggataaacatggatggctaccctcttaagctgcttattgggaagaagtttatgctttaaatttaatagatgtatttataaatttgatagtgtgtacctcatattgaaatatacgtatacgaagaaaatttttcaaggtcagttcatgcaataaaaactgcacgtttttattcaaatatttttttatttttctctttttaattttttttattaaaatgttaacaaagtattagattcacctgtaaagagtgaatccatgacttggtttgcatttagagaaagacaatgctcactctaattaattccagtaaattaagccacaaaggaaattttaagaaaaacaaaaatgtgaaattcttctaaaagaagataaattatttttatataaagtcattccattagcatagatgatttctacaacttttcaaaatcaaagccattggaagtggtttttacattactcaaatctagcatttgtgaattcaaagttaaggactaatatttaatttaattaatttatttacttaagactgcagtggtgtgatcatagcttacttcagccttgaccaactgggctcaagacatcctcttgcttcatcccctcaaagaaagtgctgggatgacaggtgtgagccgctatgcctggcctatttatttccatagaaacatgccttcatagattttcatgaggaatatgaaatattaaattctgttactcagctataacttagtgttgtcccaacagatcaataatcatcaaattaatcatttatcttgattaattttaaaatgagttattataaaatagtatgtgctatggttttactgtctccaccaaaactcatgttgaaatttaattgccattgtagccatattgaaagtgggagcccttatgaggtgattaggtcataagggctgggccctcatgaagggattaatgctgttatcatgggagtgggttagctatagtgggagggagcccctgataaaaggttaagcttggccccatttcctctctgtctctagtgtacttccttgctatgtgatgctctcaccatgtggactcatcatctgccaatgccatgcccttggacttcccatcctccagaactgttaagaaactaaacttcttaacttactaagtctgtaatattctttttcttgagacacagtctcactgttgcccaggttggagtacagtggcacgatctcagctcactgcaggctccacctcctgggttcacaccattctcctgcctcagcctcccgagtagctgggactacaggtgcctgccaccacgtgtggctaatttttttgtatttttagtagagaaggggtttcaccatgttagccaggatgatcttgatctcctcacctggtgatttgcctgccttggcctcccaaggtgctgggattacaggcatgagccactgcacccggccccacagtctgtaatattctattgtagcagcagaaacaccatcctaagatgtttgcattctagatatgctttaattgttgttcttgctccttttatgtagggagaacctttctcatgtagggtgtataatatgcattttcctcactccacttcatcccattttatttttgttaagttatagggttgcagtgaagtaagtgtatgatatctatgtgtaatacacattactaagcttgatagggtggcttttctgaataaggacaaaaatcatttgtttataaatatttttcatccttccacatcttctgcctcagtatcctgagtagctgggattacaggtgtgtgccaccatgcccagatgctttttgtatttttagtggtgatggagttttgccatgctggccaggctgatctcgaactactgatcttaagtgatccacccacctcggcctcccaaagtgttaggcatgagccactgtgcccagcctgactttgacctgtaactttttttcagcttcacgtatgtgtaggaggagctgaagcagctgggctgattcatttagtcttttgtgggtataatagcatgatggagtgtagacgcctgggacatgcagattaaggctattggaggtcagagtttctcaaaagcaaattttgtacagaaaattaataacaacaatgaaacagaaaggttaattgaaggaaaaatacattttaaaaaggattggttaggactgtgtgtccacttcattttaaacaagaactaaaaataaaactgattttaaaattaccttttgccttatgtgctatggttttggagacagatttctgagtagatcaccaagagcttactttaaaaatattacagagcttactttaaaaatattactttttgttggtttaaataactcatcatcataactcagaactcactattggaatagaacactttttgtttaaatgttcacatcattttctgaaatttgcaatgattttcttttatatgtgttactttagagtactttcttggtctacctcaaagttactttggtataattgcaaaatgacacacattgctcccatccctgcacacaagtctttttaaaatatgactttgcttctcttcctattaaaagaacagtagagtgtatttcttcatatcttgagtcttgcctagcccatgagacttgctttgacaaagggcaccttagcaagtgtaatgtaagcacaagttggaaatttgttcatcccttgctgctacaaccctcccaccgtgactagcctgctgcaggaacagaagcctggtgtgcaggggctcctgctttcccaaccatcccagctgaggccctcacacctaaggaaggtcatcctggactgctcatccccaggcagtctcacgcagatcagaacagcccaggcaacccacgaagtcatgatgttttttttcagctactaaatttgggggatagtttgttatgcagcagaagctaactgatacactctcattttggctttactatatagaacttaattaatggtttcaaggcaacagcaaagtaagcaagtgagccaacaaaacttttagctacagctttaccttttcttctttagttcagaaactttaaccatggatatttggtgtaccactatctctgctacaagaatagaaggcatatctcttttctcaaatcactgaaaccaaaataaaacaagtacctaatggtctttcctgggtctgcctctataatccaggtgcagtggaggttgttgtcatacggagctggatagccaggggacaatattcgtcctgatgtggctgcatggatctgaccaccacattccgctgtagaagacacagagagatgggaacgttcagcttcaggcatcacatgtttctatttagctacttttcaaaaccaaagccattatgtctgcattatatacatagagaaaaagaatcaccatcatctctctctcctgaccgtttcaatatttcttccaaatcattacctctgtggaaagtctttatcctccatgcaattaaagttgagagcataaagcaataagacactcatgtgataattctaataatatgtgataattctaataataacactgtacctatagtctccataacagaatactagaaaaactgtctttcatagctgaaaacacacactcacagacacgtgcaaatctcagaatacataaaactcacactggaaagtgtgataaaattcctcctcttttccaataaaggaagtcaatgcaacatggtgcaagcaccctaaggcctggcttttgcacaatggtatgactgcttccacactcacctatgcacgaaggtagtggtttgtcccacactctcctgtctccactcaaacaggtcagggtgttgctgccatgcatggcgtaccccgggttgcaactgtacagaactacagtgtcggtaaagtggccttcatcacggatcctatagccgtagttagggatgcccggatcctcacattttaccagatcaaaacctgcaagagagaaaggcaaggaatgaacagaactcaagggtggacatctgccttaaaacagagatgaaacaaacaaggttgctaaatgctccttgaagggtagggagaaaaaaggagattgtgaatttacaaaggggaaaagaaagatgggtctgtactggggctatttgttacccatttgtgatttcttgaagttcggtcatcttatttgttcctccctacttacaagtttttttttttttttttttttgcttttgttgcccaggctggagtgcaatggcgtgatcttgcctcactgcaacctccacctcccaggttcaagtgattctcctgcctcagcctcccaggtagctgggattacaggtgcctgccaccatgtccagctaattttttgtatttttagtagagacggggtttcactatgttggccaggctggtctcgaatacctgacttcaggcaatccaccccctcagcctcccaaagtgctgggattacaggcgtgagccactgcgcccggcccctcaagctcttgttttccggagttccacaacttcatctgtcagtccaagcctccagtctgcaccctggattctctggtgagccccaatgccctctaggacctctaggaacgggatactctgctgcctctttgcccctctgtcacaacctagacctccaaggaagaggggccacctatcggcactgccagggtgctttgcagaatcctgacagccagcacttattccagcccattgtcaagacccgcccaccttcccgacaacttcttccaaactccaagatgtcaacttcatgggaaaagaaaaaaaaactggcgctcctgaattactgccgaccacactcctgatggtgcatggttatgaggctcttgaggaaatccacacaacaacagaaactccagaaatgaatcattataatgacctcatcaaaataagctcttaaactcaaagaaatagatgacagaaatgaagatttagcttctgcagtactgagagctgtatattccttttatgtgaggcaatattttaaggccatctgtgaaagacagtcttacagtaacatatttctattcatatcatgatgcaaattttgacaattgtaaaagggagagctggaaacttgagggaccacatggtctctttccttctatttccaccaaactttgaatgctttcttttctcaaaaagaaattaaattttgaaatgaatttgtgacttctgctacatcctcctgtcaatgtgaagtctgagatgcccttccattgaggaaaatgtattcttaacttcacaatataattttaccctgctgatgtctgactaatcaggattgagatttgcagctttgtataggagaaagaggacatgcttgatcctttgcactcagtgactaagaaaatttccttccataaagtttccttccacaaagagtcagtctttaccaaccatgacattattatttttacgataaccctgatctatttaagagacaccaataattttaattcagatgcctggaattcaagaacagaagagtgtatccatcttggtgcaaaacaaagggatatgctaaatgtccacaaaggggaggtagaaattagggggatggtttcaatcaatcacctccggtttcagggtcattcaaatatttgatgaccttcatctcactgcataatgccaagaagacagggcagaaaggaagacattcaatatcatgtatgacaaaatccatcattattacagattattcagtgctcatttctgttttcgcagagaggaaaaaagaagcagaagtctttactgttgttattgttgtagtgttactgggtttgcgggtttggaagtgacagcatctgaacaagtctttagaaggcagtcctgcccagcattggggatgaccaccagcaaactagaggcagaatgacttgttggaggtgatgattctccctggccacacttggagtccacctccctattaataacaaacaatcttccaaaatcttgcgctatcttgaatttacattaggtatgctgcttatccaatgtcattggaacatacaattggaaataaccattaggcacacaaaatcggggtgtaaaaaacttttgagttcagcatctatccctatgatcagtaccactggaacaggatcctgggaaaacttaaaaatctttttgaggggtgagggccgcccatgctaacagggcatccaggtcctgtccgtgaagaacaaagctgtgaatggcagcggggccaggaaactgtggggttctgcacacagcacccaggaggtatccaccttaacaaaccacacccaatgtgacccgaacttctcgtttttcaaggggcaaaagaaatctggagttttaaaaaaagtttttaaaaagaggtggaatattgcacgtaatgcttctaaactgagctttgaaacacatctgctggggatgatgaaagcctggactaagaagtggtcaagatgcctacacaggctgctcaacttaacaaatgaggttacgtcccaataaacccattaagagtgggaaataccttaagcagaaaattaatgtaatatacctaactaactttccaaatgtcttaaattcacctagcttaccataaatatgcttaggacagttaccttggcctatagttgtggaaaatcatctagcacaaagcctatttattttataagaaattgttgacatgagatagtcctccccactactaataacaaacaacttttttttttggaaatgcagtctgtctgttgcccaggctggaatgcagtggcatgatctcggctcactgcaacctccatctcctgggttccagtgattctcctgcctcagcctcctgaatagctgggactataagtgcgagccatcacacccagctaatttttgtatttttagtagagtcagggtttcaccacgttgtctaggcttgtctcaaactcctgacctcaagtgatttgcttgcctcggtctccgaaagtgctggaattataagcatgagtctaatcagctagagagtcaacactttcttacaaaacaagctttatgctagacgatttgtgctagtattgaatactgtacaggaaatgaaaaacagatggttgcatgggtgcccaaagtatactttctactgaacgtgtattacttttacatcattataaagttgaaaaattgtaagtgaaccatcataagttgtgggctgtgttcattttgacaataaattatgttctgattgtacagaagcgtttatcaatcataagagattttcttcactggagacatgtgtaataacattcattttcctgtgggacttacaaattgtttcagtagtttatagccataagctctacaagtagtttatagctattaatgctttaaacgttatccagaatatgcctctatgttcagaaatcatggcttttaaagacttcaatcaaaaaaggttaacaaagttctaaaatccaaaaataggcttattttaaaattagtttaagaagaaacattttcctctaccctaaaacttgcattaaagctttgttttgtaatgtttctttccactcttctccaaaaaaaacaagcaaagaaaaaagatgtatccattaaaatgtctactaaactttacttgggttgcattttgtacagaaatatgttttattgctttttctatcaatcattcaatatcaaaagtttttctttctgcttaaactacaccttgtcatacagaagaattaagccaagttatttatggcagcgtagttttctctttatatgaccagctgtctcctttttttctgatgccttttcttgtttttgcaaaagatcacttaagaccttgacagcatcattaaatttattatcttgtaaaaagctctataacttaaagcctctaggcttgtgtgatgtctttttataaaatacattcctctttcctgtcagaaagttgaaagtatttggccattctagagatcagttttccaattttcagtagactgaagagagctttgttctctcaaagctcctcgcaggatttgatggttcacacacagttgctgggagaatcataggcctttacaatgggaagtagcattggaatcacagccatcaataccttgaaggactagagaaacatccctagaaatctgaagcttctacttcgtgtcacttgcgccgtgaaccagcttagtcgcctgctagggagaagagtgctgcctccaccgttaaactgtgcccttagagccatagcatgtcagcatctctcaggttctcaaaggcagttagacttcaatctggtgtttcagacactttgacccctaggctgttactttatccacattcgttaggatacagcctagcctgctgtttccctctctgcaaattgcatgaagtacatttcaattgagctttacttgctgtgtgtttaaagactagaatataatcattgtttcctaaaaatgtcaacactgtttttgaatattggtaaaataagttgatgtgtaataggagaattctgaaatgacaacataaaattctatgatgttaattctgcactatttcagaaaagaatgtttccatgttttaagaaatctcagatggattaaagacttaaatgttagacctaaaaccataaaaactctagaagaaaacctaggcaataccattcaggacataggcatgggcaaagacttcatgtctaaaacaccaaaagcaatggcaacaaaacccaaaattgacaaatgggatcggattaaactaacgaggttctgcacagcaaaagaaaccaccatcagagtgaacaggcaacatacagaaagggagaaaatttttgcaatctactcatctgacaaagggctaatatgcacaatctacaatgaactcaaatttacaagaaaaaaacaaccccatcaaaaagtgggtgaaggatgtgaacagacacctctcaaaagatgacatttatgcagccaaaagacacatgaaaaaatgctcatcatcactggccatcagagaaatgcaaatcaaaaccacaataagatactatctcacacgagttagaatggcaagcaatcaatcattaaaaagtcaggaaacaacaggtgctggagaggatgtggagaaataggaacactttcacactgttggtgggactgtaaacgagttcaaccattgtggaagtcagtgtggccattcctcagggatctagaactagaaataccatttgacccagccatcccattactgggtatatactcaaaggattataaatcatgcttctataaggaaacatgcacacgtatgtttatagcggcactattcacaatagcaaagatttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcacaaggacaaaaaaccaaacacctcatgttctcactcataggtgggaattgaacaatgagaacacatggacacaggaaggggaacatcacacaccggagcctgttgtggggtggggggagtggggagggatagcattaggagatatacctaatgttaaatgactagttaatgggtgcagcacaccaacatggcacatgtatacatatgtaacaaaccctaaaacttaaagtataataaaaaaataaaaaataaatctcaagtttttaaaggatatgtttaattctacaaagatattcttccaaatagagatatttccattttaatgtgaatttaagagacttttgactgatcaattttaagcctgctgaagagtagtaactttaaaaacatacagaaggtatccttttctatcttgaagccactagtctgcaattattcagggcacaaatactggttctgtatttgctttatgctctagaaactttaaaaaagactaaatcacattatttgtgtcaaagcactattaagtattattacaatcaaaacttgaatgtatttagtaattctatttctttgttttctagtgatttcattttaagtcaaagcacagccaaaatactacgaacaaaatgttctaatcaaaacaagctccaaacattcagctgatgaaaattacttctccatatatgttgcatgaattacgcagtcttaatattcttaagaattaaatcctatgtatcttctaacaatattagagttctatgagacttgcttttagctttcaagtattcggattagttcttatcttccaaataaagcacttgtgtttcaagagaaccggctccagacttaatccattttatacattaggctgaacaacgagctcacagtaatgtgagttttttcagcttctatctgagcaactcttgagaaagtagtttcatgctcaggtgagctctgaaaacataactgaagaaaaggaatactggtcatttttgaatctctgatatattttctcatgagcaactgaaaaaagcttgaagtatttacaaaaacatactatctatctgttaattttacctaagacatttcaattgggataatgtacttctttggcaaaaatctctttaagaatgactctcatgtgaaaaaaagggacagtgttttcacaccatttccttcagtgtaaagaactgcattaaaaacttaatattgctttttattaactctatttggattcatctgaataggaagggagtttcaaaggtaattggttaaatttattttttatagttcacttgagaaggaaagttcattaataatgaatttcctgaaatgtgtgattatttcctgaaatgtgtgattgttccatgttttacaatacatctctctttattcaagaatgaaattctaggtgaagtgagtgtgtgtgtgtgtgtgtgtgtgtgatttttaaactatcttttaaattatttatggttttttaagctacagatgctattgttttcaaattgagtcctcttgttagctactattttcatttaattcattcaatttttcccatatattaagtttttgctgacattattttgtaatcctatgagcagccccatggtaagatactccacatttttaaaaaatagcaatagcaaacaggttgttgacaatgtttaaacagaaatgtaaacttctgaacttaaggtaaaacatcaaaaagcctgtaaatgtccagaatgaaaatcagatagccaaattatctattttttggaactgtcttattttttatcaagcaaacttttaataaatcataaagcaagttaatcatacctaagaatttaatgagtcaatcttgaaacattttataattttaaatacattacattaatcccaagtgaatttaatgctggttgtactttgatcttgtgcagagcttccagcaggtcaaatagttaatatcaattctgagacgtctcagtgaaataattcaaattattcactttctcactgatttttttaccactatgcacgtatgttctctgttgaggatatttaaaactcagagtgggggaacttggggcaagaccaggatcaggcacctacatggatgaactgaaataatttcactctaaattcatctttaaatacatccagttggcaaatattgttctaacttgtacaaggtggtaagaacttacaattaggtgctaactatatactgtatgtattgtaacatcaccatgtgccctgtgccccatgaatatgtgtaataattacttgccaataaaaataaaggaaaataatgagctgtaaaaaaaatgttttcaaatctatcaggaacttttttggggcatggtgggaagagtaaaataaaacggctcctatcttcccctgtctaatgaatgacagataggaaataaatacttataaaacaacacgatgaatgctatggtttgcgtgaaggttgagagggacaaaggaaactagtatattggtagctggaggggttcagtgagccttgcgggagagggtttgagcaggtctaggggcctcctggacgccatccactcagagggagaacagtccaggtggaaaaggcttcaaatcgcatggcagttgggaacaccaatttacaggaacatttgtatatgctgatgcttccttttaaacgtgtggcggttgtgatggagacagggattgaagggaagacaggaaaggtcacgggaaagactggaaaggactcggctgcagcaccaaggagtggagaccaactcagcgtgcagtggggggaaggcaacggagaagactgcacaggaaactgacacaagtatattcgtatttcagagagataatcagaagcaatgtgcaatatggacatgggtgagaagaaagaaaggacaagcaggaaaatctgcaaaagtatttatttagtgctggaaaggagcctgtgtcagtggatgtggggaggggatgaggcaagagtgtgtgcgtggatgaagcatgcacaaatactattttgcaaattgagcctgagtgagagtggacacagaagactcagtagatgatagatggggtctgtgatgaagagaggacaccagagaaaaatgcagctcatgggagaggtgagggaggaagaggagaatcatcagcattgttgtcacataatgattctgatcttctcatagcagatcccctgtattaacccagaaaaggaatacatctttcattgataacacctgttatgaaataattaaaaataaacatgctttggatatgttaggagcatgaggagcacagagcgagacaatctcagtccttatggagtttcacagggaaattagacatcctaacaaatagtaatcgcaataattacccaagctataggcatagacagtatgagtcaacattgacactcaatcacacaagtgtggacttgtattctctgttgttctggtgcctgttttctattacgttttctattttttcccaattaagtgtttgttttgttgtactcacttctttgtatagcaaggggtgaatagttaaaaaataaaaagcccagaatgacttaattttgttttgttttgtttaataggaacttctgtgtgattgtgtaaggatggctccttttgtcaggtagaaccagcctacagttatctggttaatactacgtttatttggtatcattacttgatgtgttcacaatatcatgccttgtacacattttaactttaaaatgttataaattttgtgtttagtaaaatttcatgtaaaataaagttgctactgtataagtgaacttttaatgttattttttgagacaaggtcttgctctgtgacccaggctggagtgcagtggcgccatcttggctcactacagccttgacctagcaggctcaagcgatcctcccaccttagcctattgagtagctgggaccacagatgtgggccaccatgcccagctaatatttgtatcttttgtagagacagggtttccccggctgggctcaaaaccctgggttcaagtgatctgcccaccttggcctcccaaaatgttgggattacaagcgtgacctatcacatttggccttctccctgaatttatttttaattatgatttctttcctgatgatgaagctagtaaattatatatagtaccttaggcttgtaatattctatttttatttatgaaatatctttcatagtataacttcttactataatgttttgcttttgttccaattttttaataggtgttaaaatgaaaaaagtaatgaaaaaatagaaaatctctgtagttctctaattgagaacataaatctggagtagcatatcctctggcctaccgcattgattcattaatgcaatcacttagcatatgaagtgcctgctcggcttcagatattttgctagacgccgaagatacaaaattaactgacctcagtccttgctcaccagaaactcatagtctgtgtagataaaagataacatataaaagttaacatattccctattaaaaggatgcccattcattaattcaacacatacttattaagcgcttaatatgcagtatctttcgtgacacaatgctgtgtttcaatgtataagcatggttttgccctttgggactcagagtttaattggaggtattatagcaggtgcatgacgagagtaagaaagcatttgctttttgggtggtggtcacaggagttccctagctggagtgtcacggttccttctgcagggtttctgtggaagccagatccgagcacagggcagcccacacacacagacagccacacaccaagaaataaatgcagctgcttccaaaggagccccctgtgctttccacggggcaggtgggtgactgtaaactaacacaggtcatgcttgatggcaggtgctgctttcagctttacaaataataaaaacatacaaacacacacacatatgtgcatttatacaaagggagacccagaaacacaacaacacagattcagccattcctatggatcactcccttacacagaatggaatttgattatcctcagaacatactgcaaaacaaactggggatgtttatgtgtcttgcatccagataataactgaagaagtaacttccttgctgaaaaggcctagcttttaaaaaaaatctaggaataaatggtcaaaaaaatgaaactcacatatttctgtttttagctccaaaaactactaattgcttaaaaatatcttgactatcccgagcatttgattaactagtgttggttctttaggatttaaccacagggattagaaccactgcagagtcttcatggcaaagtacaaatgaaaatatttgcaatacacaaagaatttggtataattttatgtcagtcaatataagattcaaattaaacataattgaaaacagagtttgatagcttgagtaattaaatattaatatagagccaatatatagaaaaaggtggcaagtaaaagatagttctaccaatatatcccaaataccataattaaaatgtatctaaattatattgaaatataattctatgctttcaaacacttccgcacacattcaacaataacttttaaaaagaaacatgagagtttctgtgaaattgaattatatgattatttttaaagatgggagaattctcagattatttgtttttttttgcctgattgctgaagaaaaactaaattgataaaaatggtaagaaaagtgtcagaagaacattaggaacacgtcagccgggctatttttaaagtaattcttcattagtagtgtaggtttctcagcacataattttaattttcattgtctaaatctcagtaatgcttatatttatatttatttgctcttagatgggaatatcaaattgatgactcattaaaaaaacttttattttaatggagaaatagcagctctggttaatttattgttatcaccttagacttaagtctctaccagtggcttagaaaccaagtgaatagaccgggccccaacttcaggagtgtctggcccagaacctcatcactaccatgaactccagcatagaggggctgccaccagcgcacacagaagacatgctctgtgccacacaattcatcaggcaggtttgtctgtgctgtcccatataatcctgaaaatcacctacaaaataatgacgattataagagtccaactaagcagtggggcccgtggccctggcactagtttggagagggacggaggatgagaagaaatgggagacaactgagttcttcccaaattctgtcccggactcagccctcacacaccctgcccctgcctcgtgcctccttcacatcttagctgtgaagggcactgcttattgcttggctcccccatgctgtagcgatttttacaagaaaaactaaaggatttatgaaaacacgataagctcctcgtacaagtaaaatccatgtaaatataagggattatcaacaatacctgaatttgttgctgctgttatgactcataggctgatactttttttattctacaactaataaatacaaagaaattgtcccaccatatgtaagaattcaacaccttgagcagtggagccaggtggtcaattccagagaagtgacagcctcaactagaccaccgctgcattgggacgcaagagcgcagttcctccttttccatatctcattctttgaaagaatttctgctgagtgggtgactgccatccatcagcctaactgtggcttgcaggtgccagcccatcctctctgggcttattcctgaggcattaataacctaagccacccgcctgcagagcgagggcgcagggtcatcctgcctatggggatacaacgcctgcttgccgcacacttttgcccctgacatgcatattctgcacctcactgaccgtaaagcgttcagtagcaaaatacaaatacaaagcaaaatggagtacgtaaccaacatttttggaaataaaggccgtgagttccatctcttccccaaaaatggcctcgcttttgtatttcccagttcatctgaaagacacgcaactctcaatctcttccacctttgcctcccttctttccactgctcctgtcaacctagccaccgaaggcgtgcaaagccccctgcacccaccatcaggtgggtcgaatcctttgctttctaagcttccagtgcttagtctaagccttcctcactgcacacaagattgctgttgttgctgactaacgggtcgccaagacaccatggtgagtattcaccctggtcccagtcttctaaggatcctgccatctggtgatgccctctgcaccagggctcatgatgctttgtgccgtagtattgtccagatcctccctgccctttaagatcaagctcccttacggctgcagctgtcctaccctaccctgcatattcctcctgaaggctcttcctcctccctgaatttcctgtgaatcccaccacaagtaggcaatgacaggtgctctgcgtgtatctaattcttccaagtttccccatgcaaataccccattacttcgtctagaaatgaacctccctgaacgcacgggtagcccagagaacatgcattgtttactgtatcctctgagtctggcagtgaaagtggaaacagtgaaatgtatgcatattactatatttaactggtgcttattttaattctagacaatgtgtctgtaagtgcttttgattcaaataaagtagtaagcttctagtgatttcaaagtgttataaaaacacaaagttaactgtattttctaaataaaaataagtgagctgattttcaaaatcgtgaaaataaatgtgtttcaaattttaacactttctgatttgtacaaaatttgggaggatttaaaaatagcactcaaccagaaatatgcaattaggggaatttcagaatggattcagtattatttagcaaacctaaaatggaacctacacagtttcataaagtgtttttctgaagagggaattccatcagctttcattacatatcagtgtggaaatgtgtggtgacgtatttacataataaacatttccatggattattttacataatatatgaaagtcagtgcagacatcttcagtgttatgaataccaaatactgttattttggtcataatgagtttgaggatgataaatgaactgacaaatatattcaatacatttcatggccaggaacatgaataacagcacagatttccagcaggagcggaacattttccttcacctcctgatgaatcattttatttttatattttcacttagagccattttattcctttaggtctgttacattttacagtattagttaaatgactgaacattcaaattaataagaacatatataagaatgagcaatttcttagtatttccttcaaatcttgtactaagagcacagataaagaatttcttcttccaaataggcctatttcatatagatcttgttttacgctaaattgccttaagggttctggaagtttccagaagagagagctaatccatgcacatacataactacctatggaactttcttgtcttgttccctcagttggtttcattggccagaatgtataatgcaccaggttccagtaaagtgaccaaagttgtagggacgcccctggtcacctggcctccaggtgtggttgcattatggaggtgtcagacttcatggcagtggagtccacagccagtggggcaaggttgcccatccagggcatatcacgagtacccgtacttaacccgcaaacctcaaacatcaccaaggaggcatttctcctgtccagtctgcttacaaaatcatttccttattcttaacaaaggaaattgatttctggttaacataatggcaaatgcctgacttaggaagtgctgtgattcctagataagtctctgaattgttttttgcttttttttgtttttgtttttgttttcctatggaacttaatgacactgaagccttcctcatcagaacctaaacctcacagtcatggtttattcctttcttcatctcatttacaattcaagtcatcactgtcctataaattatgcagttttaaaaacatctgtcatttatctttccacctctaacattgtgtttttgtctaacattgtcttattagtaggttgtatgatgtccaatgggcaacttctaacttcgtgggcatctataatctatggttcacatcacagcaagattaaaaacctaacacaaatgacaagggacctcaacattcttgcacccttaataaaatcttacctctctctatttttaccttcaataatctacccttccccattttcccaagtcttacctctaaataaaattttatctctatttatttttaccttcaataatctacccttccccattttcccaagtcactaatagtcatcaaagccagaaacgctggtccattctgaacccctctctctctctctcacatactccacacccatgatcttactcacaccatttttagaaggagttaaaagggaaacttgcctaaaaccatcaaaagaaaactttaaacactctccaacagttaaaatactctttgattttttaaaaaaattttatagcatttcagtactaagagttttcaaaaacaacgttgtgtttacagaagaaacacatgacctgggatatgacagatgaagcagcaggtaagtagcagagccaagaggcccacatccaaccccagagacccaggagggaatttccttcaccccacctttcatcattgttaaaataggcccacatccaaccccagagacccaggagggggagtttccttcaccccaccattcatcattgttaaaacagacacacatctaacacccagagacccaggagggggagtttccttcaccccacctttcatcattgttaaaatagacacacatctaaccccagagacccaggagggggagtttccttcaccccacctttcatcattgttaaaatagacacacatctaacccccagagacccaggagggggagtttccttcaccccacctttcatcattgttaaaatagacacacacccaaccccagagacccaggtgggggagtttccttcaccccacctttcatcatggttaaaatagacacacatctaacacccagagactcgggagggggagtttccttcaccccacctttcattgttgttaaaatagacacacacccaaccccagagacccgggagggggagtttccttcaccccacctttcatcgttgttaaaataggccacacctaacccctgagacccaggagggggagtttccttcaccccactagtcgtcactgttaaaatagacacacatctaatccccagggacccaggaaggggcgtttccttccccctacctttggtcactgttaaaataggcccacacctaatcctcagagacccaggagtgggagtttccttccccccaccattcttcactgttaaaatagacacacattcaacccccagagacccaggagggggagtttcttccccccaccattcgtcactgttaaaatagacacacatctaacccccagggacccaggagtgggagtttccttccccccacctttcatcattgttaaaataggcccacaccccaccccagagacccagtagagtgagtttccttcaccccacttttcgtcactgttaaaataggcccacatctaaccccagagacccaggacggggcgtttccttcaccccaccttccatcatttttaaaatatctgacggtgagtgttcaatcttggcatttactattgaatggtgctaattgtatcacttcagatctttgcagatttcaagctcaatattcccaattgccttggtatgttttcatgttcctcggtctagttgcctggcactggaatttaattgacaggattattttcatatcagtgttttctgaaatttttacttggtttaaaagaaaaaaaaaagcatttgttgtagaaatacaaataggcttcaaatgtttttatgtcagaatttgtggagcagagaaaaataacaattttgaatctgaatcgattttagaacattttttcttttaacgacatcattaaaaatgacctacataacaaaaatcaaaatcagcaacagcatgacctgtgaccccttacccagtgttttcttcctgagacggtgtccaggtctccaggctgtttaacttcctacaaatgaaccttgcaaatgcaatgcatccatgactgactaatacaatcacaatcactttttattacccctagagaagaatgggaaaatattctgtcatcgctcctatcataacattttagattttatagcatttgatgataccatctgttggccttcattttatttcacacttaagtcgtaagccttgagttggatcctcataattacattatttatgtcatcctcctctaggtccttttgtctttctccaagtactggtggccaacaacttattcctcaattagttccacttgatgaaagtaaataacaaggtcgcctgggcatgctggctcacgcctgtaatcccagcactttgggaggccgaggcgggcaaatggcctgaggtcaggagtttgagaccagcctgctcagcgtggtgaaaccccgtctctactaaaaatacagaagttagctgggcatggtggcaggcgcctataatcccagctactcgggaagctgaggcaagggaattgcttgaacccgggaggcagaggttgcagtgagccgagactgtaccactgcactccagcctgggcgacagagtgaggctccgtctcaaacaaaaacaaaaacaaaaacaaaacaaaaacccaaaaatgaaagtaaataacaatgtgaatccactatcagatcatcacaaaatataaagaataattcattatgcaaataagaaaaaataattggcaaaactaaaccttgcaggaaattattcaaatcaatggaaaagctggtcctagactgacatgacctctgtaggatttgagggcatgacagcggtcacccgggtgatcacagacccttattaaacaaatctcccattacagccacagaatgcttggcttcttcccacagaatccaagcacagaatggtttcagtgggacgttcgacaacatcatacactgacagttccgtcttcgcgatgatatacatgttggtcagttagcaaggatgataaaacatcatattaaactgtaagagactggaatatatgcccacctctacctctgatttgctttttgacattgagtacatcaattaagcatcatcttgtgtcactgtcttttcttacaatggtcatcgtggtaccttccaccttcctccctttgagaaatggatgaagatttatgtcctgtttttagggtagcctcaccttgaaacagacgaaggtatgaggtgtttcggtttcagagcactaccgtgctacaaagacacatcccaaacttgccctctcctgaatgttgtcacgtttggccccaagtgccttatgttttacagttgttacacatttgttttcaagcttaaaatagacacataaaagtaaaactttctaacgtaaaccaggaattgtatgtttgcattcccagagatggggatgtcttccctccttgtaaaatgcccaccttgtttcataataaatttcctcttaggtactctcaggcagcctgtctccctattgtattggaattgcttagactgcctcatctattgtgatatttccactgaaaatcattctattgaagaatattttataggctttcttttcttatagcagaagtgtaaaaatgccttttcaggattcttacaaggtgtaagtttataaaaatgtatggctatgtcttgatacattgataggaaagttttgctcatgcctgtaatctcggctcttagggaggaagaggtgggaggatagcatgagcccaggagctcaagacctgcctgggcaatagagcaagaccctactctccactaaaaggaaaaaaaaaagacaaaaaataaaaacaagtggaaaggttggcaaggattcaatcacagaaacacgtgcagagtcatcctcctgtctcatcattggcattaacacttgacatctttacaataccatctttttttttttttgaaagagactctctctgtcacccaggctggagtgtgcagtggcaggatctctgctcactgtaagctccgcctcccaggttcacgccattctcctgcctcagcctcccgagtagctgggactacaggcacccaccaccacatctggctaattttttgtagagatggggtttcaccatgttaaccaggatggtctcgatctcgtgaccttgtgatctgcccacctcggcctcccaaagtgctgggattacaggcatgagccacctcgtccggcctacaatactatcttttttatagcacagaaaattctgagtttacaagttaattttcctcttaacatacacatctttttattaacataatatcagtttaatgtctgttagaaatcaacttttctttctccacaactgaatgtcaccatgttgtactcaataagaattcgtaggataattgtttcagtagtgacctgggaatagtaaagtttgaggtagaccactcattttgggggaatagaaccgaagaaatgagcacatacagattacttttagataaggaagtaaagtaactttgttagatttaagtgcttagtttattttttataataaatcagtttatcttttaaacaaattgtgaaataagtaaatgttgtgttttttcctttagctccgggtcctcatttctcttcacctgcatatgccctgtgtccttctgttggtcttccatggatattcactgtgacccggatcctttaattgggtcaccttgaactctgtaaatgaccaatgccctacctagccctagcccagaatgcatctctgtgtataattggggcatctccagcattgccagccaattcgggttccagtttccagaaactaccctgtccgtctaaagcaggtaaagccatccgctttctgagactcacaatgagggcatcctgctgctggtttgtttctgctattgtgattcaatgtcaaaatccaagccacttactttccctaaacctggttcttggatgcatctctaattaaaccgatgcctccttctgtgtctgagcctctaatctgacagtctgcctgtgtcctacattcctgtaagcataggttctgcttcataaatgctttttccacattggcgcttctcactggagctctgcctgcctatatgctgcttaaggcacctctgcttcctctctcaatatcatctgaccctaagtgacttttacagtttatccacctatcagaatttgtgtgacctcatattgggcacccaatgctaaatatctgcacagaataccttacaaaattttgtctgttgctacaccctccaaatacttcaaatattgtgttcagactgtcatatgatcttcggcctaaaatgtattcctgtttttcctggcccacagcaatgatcagtttcaatccaagtcgctccaatgtacatatagtgggctatgtgtctgagggttcagaaaatatcctgttatcatatccacggtcttatcagagttgacaaaaatacacaaaatacgttggcagaggatgaggttcatgtgaaaccgacaagacagtaataaaaaacaaagagaaaaatctggcttttgtcatccaatttataaacaaaaaatgtgaaataaattttaaattaaattggggaattagttatatatgatatcttttaaataaaaggcactaaactcttagtaatatccatgaagagtcttaaggtcattatatcattccttcaaaataagacagcaagtattttattataacgtgcttgggctcaagtctattacatcccagaattccattatcatgtaccaaagggaagtgaagaaagcatcaggaagaacctagggctgaaaaaatttacctaaatatggaggctgctgttggcatggaatggaggtggaagatatgtagttgagggagagagaagatgccagatgttggcatagaatggaggtggaagatatgtaattgaaggagagaggcgatgccatagcactcaagagggcattgaaaaatgaccttgttttaggatattatcaataacagaggaggctgagctaggaaagtggtcattgacagcaaaagtgaaccctataagacacatttccagcaagcaaaggggactctggacagccggacccctaagagcaggcttcatcatgacccatttgcagcgtgacagagcccagttctgcaggagaaaggaatgataagcaggggacagaaaagacccttcaagcagatggagagttcgagatgtgttccacattacaggggagcatatatgatgaacggggaaactgcggcagccacacacagactactgttatctagttaacatcttttccccatgagaatgtgcagcagttcccttcccaaggcctatgcaatcacagacagccgtatttacccttctcatgtaccatgagtgcgtccccttcacaggttggagctcaggctactacaaaggtctgcctgccatcaaaagtaaagccccattaccagaaagagttgcccagccccggggccgcatgggcctgcaggaccagtgctaactgaagagtgtgagcagaggccatgccatcagtctgtgcagggtgatgcattgtgagtgagccttttctgccttctctccttgtctgctaggggctaacttacttgctaggggcacagggcacagtgcctatggcccacagtctctttagaggctcatggaaatgctttgatttccttaaatcagaagaaaaaagtaaatttctgggttaaagaaactgtattaatatacaatcatctattgatagttataggcacacagtcatgagaagaaatgtttgatgttttgtgtggaggaatggactgtataagaagctcaagcccatggcagtcatggtgtggccccatccctgggtgcagctcctcccaggtcaaagcagggtagtgggtagagagccctgcagacagaaatgtcattcaagagatttctccttacattgataaacttcttcaattactatagcattcttcatttcattttcttagaaacaatgaaggaacatatggttaaaaacaacttgcctatactcagaggaacataaactgttctaccataaagacatactcatgcatatgttcgatgcagcagtattcacaatagcaaagacaaagactcaatctaagtgcccatcagcgagagactggataaagaaagtatggtacatatacaccatggaatactacacagccataaaaaggaatgagatcatgtcttttgtgagaacatggatggagctggagggtattatcgttagcaaactaaggcagaaacaggaaaccaaataccgcgtgatctcacttctaagcaggagctaaatggtgtgaactcatgaacacaaagaaggggatgacagaccctggggcctattggagggtggaggatgagaagagggagaggatcagcaaacataactaatgggtactaggcttagtgcctgggtgaccaaataatctgtacaacaaacccccgtgacatgagtttacccaaataacaaacctgcacctgtgccccaaacctaaaacaaaagttacaataataaactaagattaaaaagcaaatactttattttgaattttgttgctctcccatggatataggaatgaattatcagcaggtaggatactatagcaaaactgtttttattttttatttacctcatgaaaatgctaaaatattacttcttaccacgtatgagagatgacatcttaaataaaatatttcaaatataaaagaaaagcaacagtgccgggcgcggtggctcacgcctgtaatcccaggactttgggaggccgaggcgggcggatcaccaggtcaggatatcgagaccacagtgaaaccccatctctactaaaaatacaaaaaattagcctggcgtggtggcgggtgcctgtagtcccagctattcaggaggctgaggcaggagaatggtgtgaacccgggaggtggagcttgcagtgagccgagatcgtgccactgcactccagcctggccgacagaacgagactccgtctcaaaaaaaaaaaaaaagaaaagcaacttccctatttagattctgatttcagactgagggagcaactaacgttgatatctgtggtaaagaatcatgtaaccagaggcactgatcaaaatcccacataatttcagatgtttgctaacagtggccatgagttggtggccatttttatctgatgcggtgaaaacacagaatgcttatgatgtatcagtgggaagctcttgagctttggattatactaacagggtttgaatcctggtgctgccactcactaatgataggaccttaacttatggaaccctcggtttcctgtctttaaactgaaaataacaaaaggatcatcttcaaagggctactttggagataaaatgagacaatgaatgtgaattgcctggcacgtggtcagtgctcattgatatattatccaatatttctcttttaccatggcccccaaagacacagctggcggtttctcttgcgtatgtacctggaatgaacttggtatctgaccttcagggcttcatgccagatctttaaagttaccgtgtgaatgatatattgaatagcagttactcctatttctttatgtgtaaacttgattcatttcaatgtacaacttttctggcctatgtaagagtagagtgtcctgtcctccagagagaaattcagaagatcattgttgacaggtgactgataatagatagctagatagataaaaacagatcatagataaataatgatagataattgcctcgtcaatcagtagatacatatgtaatagatggatatagacagaatgataatagatcatagattatcaatcaatagatgatcaattaattgacagacacatgatagatacgtagggatagatgatagatgatgacaggtatgatacataaatgtaaatgtttgttgagatatctattagatgcacggatattatccaaaactactgcttgatggcatgaaaacaatgacttttccttaaaacgtcatctctaagattaaacattgatgacaattgtatcctgccctcttgctttgcatgtgaataagaccctcttgtaagcttttcctagcagagaagggaaggtggggttgctgagggcttgcccgctcctcacccacctccagacatctctgagtctctccaggtggggcctgaattagctgggaagaggagaggaggggcctggaaggccaaccggagctgcagtgaggctgatgcttagggaagatcgaggcacataataaaactatgcctgtgaccattcagaatgtcaccgctgaaacctgttttatttgcagacaacagattaactactgtaagctgaaatatttcctgaaactttaaaagtacatgtaagcaatgaattgtacattccctttattaaatatatactttatgtcttcaagtgtgtgtgggagtgcgtgcatgtgtgcgtgcgcacacacacacactttattttaaatgaaattatctgagatggaaggaaaacattcctaaataggaaactctgacgggcagatgttgcagggaccctgatgccctcacctcctgctgctccaaccctggatgtatgaatgattcttctccttccttgagtgtgggcacagtctgtgacttgagctgacaactgaacatggcaagtgtgagagcaccagatgccacggaagtgtctgttctgtcgatgctgagtttgtcaagatacggagcctgactcaatccagggaaagcccttgaaagagggtctggcctccatgaggtgagggctccccatggctttggagaagccagcaaggacacgccctgcccagagaagaccacagccacgtggcagggaaatgccagtggcaccaaggagctgggagtctcagtctgaccactgtgacgacctgagttctgctgacagcctgaagaggcccctgacactcagatgagaccacagcccagccaacacctggtcacgtccttgtgagaccctgagagaagacccagccaagccgtgtctgggctcctgacccacggatgctgtgagataagaaacggtgctgtttcaggcccctacacgtgtggtattttgttacagagcaatagaaaactaaggtacacaacactgcctattatttgaaaacactttaaaacactttataaaattatctacaagttaactgtgggaaaaacaaacactgcttattggatattttcccaacgtttttctcagctaggttaacagctatgtaaaaacaaaattttgccgtaagcttttatttacaaatgatatatagatactgcaatttacaaactacacagatactgcaatgccaggagtagatattagagcagcataatatgtttgccataatcttaatctttattgaaataagtaaaaatctgtgagtgtggatttacgtgcaggctgaatatttccttatttttataaccctattctatactttcccctggttcttagcatggttgtgaataatttttaaaactactcactggatgaaaagatgctttgactcaatttcctaaaatataatacaccgtaaaaagcaagaaggcagtgaatgctattctttgaatactataatctcttttactttaaaacagcaatgcttacacatcacaaccaagaatgtctgggaaatctgtgagtgtctttattattgacaaaattagattgtagaaaatgtgcatttgaggactgcccctcagcttgtataggatttccaaaatctagttcttaaaaagaagtaatcaatgatgacatggacccatcgtgatgcccttttatatcttactcatagccagggaggtgaaggcattgaaagaatctatatgagacgcacacagagtgtctactgatgtgtttgggtagagataggtgggagaggatgccagaagaaaatgacatcaaccttttcaaggtatcagtcaatcctataaagaaagcattatctctcttgatcaacgcataatttcagggactccaaatgatggattctgacataccctgctcttcaccttcaggtttgtttccagtaattgattgcattcagcagctgtgtacacttcatgcttgcaatattttctccttgttttcaagcaccaaaatgacaatgcttagtgcttctgtatcggtcctgagagtgtattcctgtccaaagccactctctcatttatagtagtatgtttaatgttgatgtcatttttattttcaaagccactctgtcatttataatagtatatttaatgttgatgtcatttttattgtatcaatgtgttaataaaaccagcatgacagctacataaacccacagctccatgctttaattttcgcatccacaggctacgttgtaatgtcttcagaattagtcgtcaatatcagatcacccaccttcaccttttacttattgtggcaaaaacataaatatggagctgcagtgcaaacggctgcaaatggatgggccattttacagaatggatgccattcttttttatttcacattgaatttgcagagtaagtagagtgggacttcctaggtctctctctaatgttctttaaactgagtatgaccaggcagtctgcagatccacactgcaggtggcagcacagcctgctggggagctgcaatgtgtcaccactgggtgatcccattgcatctgtagcacggctaagagcgtcagctcctagtccaacgagccttctccaaaacacaactcttgtaataatgctcccctgaaaaaagtgagttaattctaggagatgatactgtctcttaaacatttctgatacagctcatggcagagtgagaagtatagctatgactcatgaaaccgagaggagcccaggaccctggaggtgcctgcagtcaatggtggttggacatcctacaccactatgtttctctctccctccctctcatgtcacttgttaggggtattggtgaaccagcctctaatggttccttttgcccataccctctgctctgtgttacgaattcacagttccaacctctcagtcactgtgatgaccgtgccatgaagagcacagtgacaggatcaatttcccctccatcacacacagccagtggtgtgtgtcccaacgacacaaatggtctcacatttcatataagaagaaaggtttggccaggcatggtggctcacgcctgtaatcccatcactttgggaggccaaggcgggtggatcatctgaggtcgggagatcgagaccagcctgaccaacatagagaaactccgtctctactaaaaatacaaaattagccgggtgtggtgttgggtacctgtaatcccagctactagggaggctgagtcaggagaatcgcttgaacctgagaggtggaagtgcaatgagtcgagctcgtgccattgcactccagcctgggtgacagagtgagactccgactcaagaaaataataataataaataaaggttaatggtaacaatggcttctgtgtatggaatgtcacctaagagtagagcagacacagagctggatgttctatacaatgtcactaattctcacaacaaatctgcacagtgctttactattatttgcattttgccagggtggagactgggctcagagaggtgaattcatggatggaagttcaaagagcagaaggtagaaacctgatccaaggcttctctgttctcaaaagtctggccttcctacccagcgcttgtagatttttattttgggctaatttacatgcagaggacgatgagtaatccttaagcctagaaaacatttctcccataggactgtgttgaggttaacgtacaaagtgctttgagtaactgaagttagaaaaaaatccctatccctcctgaaccatggaaccatgggcaggtttctccaaacctctgttccctcatacctaaggcagtagaaaaatagtaactgtggggttttcatcagtattaagttagatcatagcaaggccttcgtgtgtgagttacaatacatgctaatcagtccctttgcaacttggggtattatgagtgtttccaaggcccctgaaccctgagaactgtctccacttcccatcacaaattgtaggcattcctatgccaagagacatgtgtcaccttctatagcctttttcatgacccctgttatacagagtctgaagaaaaacatacttaaattcatatagcacttggatgttttcaaaagccatttcatatgtgttttctacataagttagaaaagtaaactattattgtccctgcttcacagataaaatcaacactgggaaaaagtgtggtggttgggattgaacagagtaaggaactagaggaaagatgctttaccccgctctgattttgtctcactttaccacagagcaaggggcacactgagagcatgtacttcatcacagagccctgtgcccccatccagacagaggacccagagactgttcccgatgtgggcgagagccctgcacacctaacttcctgttttcagaacagattcagagtcccgcccccagctgcatgcatcgctggccctgggctgtgtgtgggcttccaggacaggcacagctcctgtctaattcatatagcacctggcattgaccttaatctgtagcatgtctgagatggtcagatcctagtccaacaagccttctccaaaacacaggtcttgtaataatgctcccctaaaaaaagtcagttagttctaggagactgaccttatgccagttgctatataaattagacaggagctgtgcctgagggtgtgtcctgtgaactgtaactttctggggaggctggagctggggttggccaggccttgctgtccccctgcctcaaaagcacagctgactaatcccctggaaccctgggcatgacaagaagaagactgaaaagggttcagtacatgactctgccacaaaccaacgcaacgactcgccctatccccatcttccgtctccttacttatctcaaagtctagaacctttcaaaagcagaaaatattttgataaacataccaatttggatgaaataaattgcttttattattcatcactttttaattaaacctttttgtatctattcagcaaatatttatgaagcatcccttagaagcaagccagggaaagtcattgttctgcataattacacccgtgcctgactctcagccacaaggtttattctacaaccaaaatttaagcttgcgtttattttgatggcttcaaagatctctttgcggttggcagtcttgcctaaacaatgagataggtgtaaagaatgacagaggatgttctcggtaagcgatggccactctttcatcaatgctatgtctaatgctgatgtacagggaatgcatatccacaaaaccagcgcctggacagagaggtccatggccttaagctcaaccatctcaaaatgattcaaagaccagtcttgcgtctgctgagatcaagtgctccctaggagtttgggcactgatcacacattcacctggaatcggcctaatgggtagagagaaagtcagcctatagggatctgattattttatgagtcattaaacaaaagtattcctttgagtggctctgctacaaacccaaaccgtaagtgtttatgatgtttcttctacctctgttcaaacttctgccaatataccctggccaggaatcactggtgctttgtggaagggaagctcggctaggttttccctaatgagcctcttcaccacgtctgaacagtagacacttctctagcttcctactttggcagatgcttttatttcccaagcgatatcattcatgaaacttaatgccaagcaggcgttgtgggattggaattgtgtccaaaaataaatgcaaatacaaaaggacccccttgaggagtctgtcatccctctgaggtgctaaaaccagccacaagacacaacgtatttgatatctgaatccagttgttgaaccacacgtgtatgcctgtctcatctccatgtccaggtcaccctggcatccacgcctctatgcccagggagtggcttagtcatgcgtgggtgctgggcgtttcttgacaagttgagtcagtgtccacagaacggaaactagcaagtgaatgagggcagtagaccctgaccaagtacataaataaaataatggaaattgtgtaaatcaaaacacagctaagtacaagaaagggatagacagagaattcaggatagtgatgaggggaccaattcaggatcccccaaaaatgaaaattcagcagggatgagaaatctggttgtggggcaggatgaagagaaagaattgtgaatgtccctatttccctgtctttaaattaaacactgttgttgccaagtgcctgggctcagagtcagggcctctcccgtgataccagctatgcagctgattcattttcagggctggccagtgcacttctgcagggtgcatcctgaggactgtaactttccagagaaagggctttatttttttctttttaaaataattggtacaaagttgccatatggaattgtggcagctctatcatgcagatccagctgttcatctccagcctttcttttttttttttttaaatttttatttttatatttttaattaactttaagttttagggtacatgtgcacattgtgcaggttagttacatatgtatacatgtgccatgctggtgcgctgcacccactaactcgtcatctagcattacgtatatctcccgatgctctccctcccccctccccccaccccacaacagtcccctgagtgtgatattccccttcctgtgtccatgtgatctcattgttcaattcccacctatgagtgagaatatgcggtgtttggttgtttgttcttgcgatagtttactgagaatgatgatttccaatttcatccatgtccctacaaaggacatgaactcatcattttttatggctgcatagtattccatggtgtatatgtgccacattttcttgatccagcctttcagtgtttctttggaatgtcgtttatacccatctgtaattcctcatccattttcacaggcccttcacttcaagcctctgtttgcagaacactttaaagatgttcctgactatgggttctcttctctatcaaaaaagtgagacttttaagagccaagggtaggggggttgccttaggaaagctagccagctgtctttcaaaagcattccctgggtgatttggtaggctcagaattctggttccatcggtgtacccaaaatagatttatctcatcagagggccaatgggactttaacatcagaatgccagttccgtaatttgaaataattgacgaagctggtccatgtaccggaaaccctatgtcaatatcaataaattactctcagagggctactctgatatccaatgcttctgttacttcaggtgaaactcttacttcttgcctgatacagctctgtggaccctcagtgtcaccagggaatacaatttgaatgacaatcatccattctaagcttcttatgtcacagatcacacatctgtgtaaggtgcgaagaagtacaaacaagtggacactcattgtccccgatttcacagagctatgggttatggctccattggacatcattatacaccagaagcatattatctggtatgaacatagacaagtctgtaataaaaagcagtgttttctaacgaaggtacacttttaaagttttattttggtctgacttactattcagaaaacagtacttgcttaataaatgcctattcagcaacgtatttattccgatttggcccaaagatactctggtttttcttcccaggcaattcctctgcatgtatcaatatcggtcaatatacttgatgcctgccaaatgaggatcaccgaaaatcgttgaaaataagttcatcagcaattctggtattcagttagaaggcctggatttgggttgcaattacaccactccctgtgtgcagcaaattactaaaatatctgaagactcggtttttaattcataaagaagagtagaaggagctatttcccaagacctggaattaccaggattgtaaagttgaaaggtccctaagtgtatgcttttataaatatgaagggataaagaaatattgtttgtacccatttctaaaaatgttagggtttttttttattaagctatatattttactctctgttgacattttctaatctactcatgtatatgcattaattatggatctgaaacatttaaatactaatgtttccttaagtagtgcaattaactatcaagaggcaattacaaaagtcttttgaaaatagctgaaagtgtctttacacagtcttaagcataaataacttgcgtaaaatattttatctaaccggtcatcatttctgagacatctttttggaataaatatttgattcaggtatttgatgaccttggggagctggggatttcttcagcttatttacttatatttacaactaacaatttaatgtgaggttaatactattttgattatatggccatcagcaccaccaattttctattacaaatatatcttcccaccagacagtatgttccagctctaagataatcttgcaaaggagacctgaggagtctccgggttttgcaggtggaacagaaaggtgaaacagggagaacaagaaaattactcctgtcaaattgattataataagagctaagtgccaatcctctccaatatttctttctcctatttatagaacatttgtgctactatgtaatcaaaaatgtctgtagaattggaaagtgcccacaaacagatgaatagattcaagcttttacaaagttactcagtgaagtggaagtgacctcaaaacttcctaaagtgatgctggatgccggggagcaatagagtcacagtatccatgtggggtccaggcagggctgagcctcgcccactgacgcaagccttctgggtgagggagggtggacatcaacatggaacaagccgaccacctatagtttccatacggtcacacggctctggagcacatggaccttcctaactgctacctggacaacagaagaggcttcagaattatggaaacagctcagtatccctacattgattccaagcccctgaaattccagtatgcataaatcttcttctggatactttttgcatcaccatgagaaaatgagaccaagtgtttacaaatgagaaatcattccaactggaaatagtcggaggaacatgggaaacagttactagggttggaaacgtaatgagaaataacacacgagctgagcacaatgtgttttttgtgaagcagccacaggaagggaaaaagtgagcttagtaacatcgcaaattgcagcagtgttgagagtgaggtcccaggagagagggaggatcccaggccaacgttttctgctctttgcccagggagccatagcaggggcaggatttgtaagaaaaagcaacgaaaatgtgttcagtggcaagagaactggaagaacgccgtaggtgtgcatggaacttccccgtaattagacaaaatttaatttacccacaggcttttcaaacagtttttcttctcaagtatctgtgttcctctaagactagtgtaggggcaaggaagcggggatgaagacatccaagtaagaaaacaaaatacattgaacatctcgacagggacgagaagtggaaaaaacaatcacaatagcattcattccatctgcaagcaaaatggttttacaagagctctttgagacatttctgagagggaaatcctggaaggtaaaattctagtaaaaattttataattataggttgatcttgtaacatcaattgttatcagtttattgtgcacaaatattaattcataggctttctatttactcagtcttttcaatggtattatcacaaaggtgaaaaactggtttcctcatgatttcagccacacttattctattttttggccaaagtcttacaattcttcacctgtgattttttcctcctaagagggatttgaggtgattaatcttcgtcttaggctcctggattagctctgggtctgtgggatgattattatcttttgcaggaccttttttgcctatccatcaaataaaggtatccatcactaacatacttttatgctcaaaaacccaaacttttaaatttctaatgtcatggtgttcagtatgatatagtttttacatttatcagatgagtgaaggatttgacaattttatatactttaaacattttaattaattagttaattttaattacttatccacaccaaatagctttttcttttacttcagaactaaaaatgctgaaagtggcagttatcactttgcaaattcctacttttgaaacacagcatctcttttatttccctgttcttttggcttcttcatttacatctttaaaaacatattccacattgatttgttcatacagatgatgggaagcaccgataactgggagctacagcttcaatcctggctccaccaactcttaaaactgttatctctggcaagtattcaaagtattcctcttagttctctcgtctcaaaaattaatggtgaaaagaaaatagtttactacatattatgtagttgttgtgtgtgtgtgtgcttatacatatatatgattaaatgtataaatatatgtgtgtatgtgtgtgtgtgtgtgtcattcaaagtctattacctccggttgtatcaaacatctcttctaaagccttcatatataagcacatgaatttgtatcaatgtatactataccccaatcaatatatttaagcccatcagatctaaaatgttgtaagacgtttccttttcaggtccaactattttgttatttgaattaatatttccaaatagataaatttcaagctactagtaatgtgtccgaatatacaaccagtcaacagagtacagaattaaactgcaatcaaaaacacagtaggcagccagaaaaaaatcaatatttaaaacttaatataagccaagtatcagatatgtcctgacaaaatgaaaaaagaacgtgattaagtcgtatgttacttactggtataggtgagttgaaaaccttggtcggtgtcagatccattggtgttgaactctagccacaggtgattggatgtgctgtttaggatcagccccagaagttcatttttagtgaacgtgcccagtggacgtgaggaactgtcttttccatcatatacctgatgaaaattcacagcatgagtccctctatgccttcactggattcttatgttagcaatggtaataaacaatccaaatcttcaaagatgcagttttaaacaatacttaaaaaggcatatagtttacagaaagataaatgaaggacttagagctaaatcatatttgttctttaaattttatctttaccattaacactggaggcaaaagattccattcttgttcagatcattttatattcattactttaagagctctttctgtgttcatttaaaattaaataaatatttctttacatttccaggtttcattatctacctttttattccttttctcatagttcagttataaaagtaaaaaggatttataatattttagtcttgaatatctcctctgaactctcaactaagtcaaagaacatacccttcctttctattcccttctgtctgaatgcactaaaggacaacaagatgtgccggaatcttgtcacattctgtagtctgcaagcctccggtggctttcatcttgaatttgaaataacagaagtatctcatcatgcaatagtaatacagaagtgtgatgttgcttaaaatgctctgtatgtggcattatcttcccaagcagttgtaaaacgagagtagatgtaataagtatacggaagataaggaagacaaggcttggttttgaccagccgggagagggaaggttcagtcatgggttcccaactagtggggagacaggtcacatggtggggagcagtgggtctgtgtcaccatcataatctgaatgaggatcgggtaaaagtgtttaggacccatgcactttctgccaatgccatgaggctcaggtaacagaaacagcactgactttctagtaggacaaatacctaatgcatgcggggcttaaaacctagatgatgggttgaaaggtgcagcaaatcaccatggcacatgtatacctgggtaacaagcctgcacttcctgcacacgtatcccagagcttaagataaaataaaataaagtaaaataaaaaagtcaatgcagcagtcctcgctcccaataacaacagagcactaggtgggcacggctaatccacctgcctccctcactagcagggggctgtaaaaataaacatttattacacgatattggaaaatgttcagtttgtcttaatagaaaaatggtaccctaactaaataaaattaaacagagtcttagtaggctcttccaatgtgtttgtctattttccccacttctttcctctttatacagattaatttttctttcattgtctttcaatcaatatataaacccagggatgtacacagatatagatactcagaaaaggagaaaatacatttagaaaagataattttgtgggtagttatttcattacaattaaatatgcacatgctagtggggtagaatcagatactctctaatctccttactaaaagactattgacccaggtcattgtgtaaaaaccattatttggtttattccatgtttttattagacgagccggggtctgacatccagagactaaatggttttaattccagaggaatctgggtcaaagagaaaaggtgcaggtctccctaggaaggccttgggctaccccgtataccatggaattgtctgtaattgacagaaatccataaagatggggaaatacgaaagaactagacactcagtgaagcccctgctgggtcctgacacactgtaggttcatccgctctcctgaatcttggcttccccgtgtcctcatgaggacttgaccaagcgcaccgtggatccctgagagattgcaccttgctcccagtggcttcatggttacaaccactaaaaatgaacagctcaaaagctgaatcgtaagattcttcagaacaacaattctgcgttctttatccatgtcatcagcaatcagcactgggtccaaccaccgaaaccccagagaaagtgtatgtcgttgatgaacatggaacactcccctgtcagttctctaaagttaaaatctgggttcaggtttcgcactgatcacaaataaaaacccagataggagtggaagtcagaagacttgatttctgattccaattggatgaggaacaggctacacctgttctgtacaacatttcctagttatattttttcacctataagtagctagattcaaagggttcttttcagttattagagaaagtctttgggattcatatgtttaatacaagcctgtaagtatctgcactacaaaccctcctcagagttcagcatttaatgccatatactcaagggatgttgctgggttagctgatgatcacagattagaagacatcacacagaatgctagcatgacaacattgaaagttctggggaaatctttcccagttttacagaaactataccctgcagatttatttccaaaattaattgcgttttccattctatattcctttcatgacatgcttctgagagctcgatatctcttacatgatttttccacatgaagcaagaaaacatcatgtttatttacgtgtgcagggggtgcgtgtatataaaattttagtctttattattacatcacagtatgtgcgaaggatcaatgtgaacagcattaggcttgaaaattaagataattttactataaacatttttaacagagatattttttagcatatttaacaaaatatatgcctgcaaaatgtgtaggtattttatatgactgacagcttctctgtaattaaatgtgagaagcacgtttttttaaaaacaactttttgttataatcaactttaaacagcatgcaatcacaaatgaacataatttccttccttccattgcaataatatttatccttgtgtattttatgcagtatctctaatcattcacctgcactaaagtatagttaagagttatttaaaactttgccttaaaggcttactgacttctaaatttgaggttattaaaaaattcagttgcgatgtaactatttctttttagattagtaagaatgtgctagtttcctgcctaaaaaccacttcttcatgacagtccctcatactgccagtgtgagatttcaaaagactattaaaatgaaagaacaactagaataaaaccactctactaaattatgacattgaaatacaggcaaacgcggccttaggaggaagtaaggccctttaatctgtaagcttctcctgacctttgcacataacttctaatgaggtcaagtggagcccggcgggggctccattccagccattctgtaaagggaggacacacagtgttttcccttttagttggctttctgcatattctcttagaagtctcatagttcaaagtgagttgacaatactgaatctaaaatgcatcattatgtgcatctacgtagatgtaaattaattgaaaaaccctagaattttaaaaagggaataaaaagagccacgtgttcctttcttgccagaaaccaggcttctgtccaactaaattgctcacctcgctgaaataagcaggtgactggacggatgatttatagcaggggagtccaatattttggcttccctgtgccatgttgaaagaattgtcttgcggcacgcataaaatgcactaacactaaagataactgataagcttaaaaaaatcacagaacatctcataatgttttaaatatgtttacgaatttgtgttgggccacagtcaaagctgtgctgggccgcatgtggcctgtgggccgcgggttggacaagatagtattatagcattagctcttgtttcttgaagcttttccttttcagtgccttgaggctaggttgcccattctccaacccctaggccatggaaggttcccaatttattgaaatacttacaggagaggtgaaaattatatcaggactcttagaagttaagggcatttctagttggagctgggattttgtcaatcaacgcaggacctgggtacccctgccatcaatattgagattctgtcttgtcctggcttggcttctcctcatcagccctgtctgtgatctgaccactgtggctggatttacctccattatcacttcagaacctttccagctttccacagtatgaccacatttaaaaatcaagattaactacagaaagggttggtttggggatcctgcaacttttaataattacaactatgtgctagacacaatgctaggaacatccacttatattattgtattaaatcctcaagacagtccagaaaggtaggtacaattgcattttgttacacataaggaagctgaagatcaaaagtgttaaataactttcataaggtgctggactgataaatgttagatcgaggtttatctacaaagttatttcaaagtccacatacactgctctaagcgaagtgacattacaccttctcaaactcattgtgtaaataaatacaaataaatcatatataaaaatatatgttaatatgtgcatatatctatatgtagaaaaatagatagacaatgtattttttgagaagaaaacttggagtcatcatgttggagaagattctttttacctttagagtatctccttcaaacagctggaagcttcgtgttctaaggtggatgcccttgccggcttctgtttctattttatagatacactcatggttattatcataattggatggaaaatttggagacagtaatgttccttcatttcctttgacacttgctccacattcggctacaataaataggacatgagagaaagaggattcaaaagtggaattactgtttttaacagattaaaaactttaaaatcatgatagcctcctcttctatcaacgtatgtgtgttagtaatatattatttcaaaatagatcagtgatttttttttattgtttgaccaactggaccaaaaaagataccccacctagctcattttgaaaattgtcttattaacagaatgacctctgactatgtggaagcagcatgctatcatacagagagttctagaataaaacagaggtgctccagcaccatggctcactggctgtgtcgtcaggttgtcacagcacctctcccacccacctcattcctgcctcatgaaatgtccccaccagttcccacgctcccattctaccattgtttgtctgcattttccttcattgacatcttatggcatcaactgggacgcattcaaaggggaatctaacgacagaccaaaccactgagttatcttcaggatgtcacatccctgaatgcctcagcattatgtcttataatggaagaacattcaatggcagtaattatctgcttctccctctttcccaatgaaggaagagaaaaattgacttctagatctaaatttgtatcaaacaaaattcctcttatcaaggtaaaagtgaaaatacatacaactctctactttctgtcaacctggagaaagtcacttaacctttcagcacctgtctcacagtgaaagtgaacagtttaggtcaagaatgctttcagctccaaaactctaagtccaatacgatcacagaaaaataaagtggctacatatacgggtgcacacacacacagaggtttgtctgtgccaagagagctccacaggagtctgcgccaacaattttacagactatactatgtgcccagcacaccgatgtaaacatcccacagaatgcctattcttttgaagaataattgtcaggttggaaaccaagcatcagttagatgccaggtatgtactgagagcaggagagaaggatgcacagtattccttttccactgggttgctcaaggtactgcagaattttgcagatgacttctgcatgcccactgccacgatactgattctttcacaccctccttccctctttgacaacgaacacaatcagctacatcactggccatgatatcctaatccacttgccagcaggaagttgctagagatccatgattgccccccagtgatttgtgcacgttgaatctcagaatgcctccatgtggaagggtgtgaggagaaagtcagagaggagaacgcttgacatcctgggttcacttctccctcatcctccttaaataaagacagaaaagcaggctttggatgtggctctcggggtgcaagtgttgaggcggaagtgcaggcaattggtgactcaaagatgccattgggaatttataatcattttaagaaattacagtaattatataactataattatgtatttgtataattataattctgtaaaaatcattttaaaagagaaatttatatgtatatatactcacgagtaggtgtatatatctataatatataaatactttatatagttatagctataaaatagatataagtctaaatataaatatatctataaatagatataaatatacatataaaatatatataatatatctagatataaatatatataattatataaatatatttatatctatatatatatttataatatatatttatatatatttatatattatattatatataatatatattatatgtgtatgtgtgttataatacctataatacctataattacttgtgtatgtgttataatacctataataacttgtgtatgtgtgtgttataatacctataataacctataataacttgtgtatgtgtgtgttataatacctataataacctataataacttgtgtatgtgtgtgttacaatacctataataacctataataacttgtgtatgtgtgtgttataatacctataataacctataacttgtgtatgtgtgtgttataatacctataataacctataataacttgtgtatgtgtgtgttataatacctataataacctataataacttgtgtatgtgtgtgttataatacctataataacctataataacttgtgtatgtgtgtgttataatacctataataaccttcgtgacatgtcaataaaccccatttacagatgaggaaactgaagcatagaatagtttacaaaccaaatgtctttcccaaggtcacacagctagtacagattaattactgatgtgatataaactgtgaagtactcataaagggaatagcacttttaaaaaatatcctaaataacacttacatgtactttaaaattaataattcacactactgttcataattaataataaaactggagtaacacaagtttaaatgttcaagaaaaaagtgtcttcttaaggacttttattctaaataggtcaccgattaattgcagctgatatttgttattacattagcatttaggacattagctatataatcatttctcataatacataaaaaaggtgggacaagaaagaataattgagcatttgtatccatgtgaagaaaaaaaatctaaaccaaaagaaataattttacatgtttttattagcctttggaatctgggattttttttaaaaaaagcagatatataataaatggtagtaactaagttcaagtcctcactatgcaagaataataactgtgcaaaattaaccatcccgttgtaactgatgaccctgtatagacagacaatgctgctgctttgccttttagaaaaaatcaaggcaaaagcaactcaccatccttctagcacttcccaaatctcactttatattcacagcttgaaactaaagtcttctattagtatctgaataagtatctctcataacctgagatgcaattaagatttctcagtgaatatgtaataatagctcatttattcaatatgtagctataactgaatgtgaatatacatgaccaaaacacttaaatgtacaaaggtaggatttcattactctagggtagtgtggcacaggattcaaaagatagtctttcacatggcattttccccaaaagtattaaattgctatgaaagtatacaaacttggccaggcgtggtgacccatgcctgtaatcccagcactttcggaggccgaggcaggcggatcacctgaggtcaggagttgaagaccagcctggccaacatggtgaaatcccgtctctactaaaaatacaaaaattagctaggcgtggtggcacatgcctgtaatcccagctacttcggaggctgcttgaacccaggaagcagaagttacagtgagccgagaccacccaactacatttcagcctgggcgacacagtgtgagactctgtttcaaaaaaaaaaaaaaagaaaagaaaagaaaggaaagtatacaaacttggcttgttaactagaaaaattattttaatacatatacattaaatgatatacgaataattgtatatagaaacaaaaatcaaatatatatttaatatgtattaaatataaatatattaaatgtataatatatattaaatacacatgtataatatacatacaatgtgtactcactatttaatttatattttagtacctatatttttcaaagattttaaagacgattaacatagaatcacatttttaaaaatttaaattatgacttttacatcttttctctgttttcagccgttatttgtgtttgagttaataccatcctactgaacataggacagttttgtttttgctttgtcaccttttttttcggattttatgtggaagtcaataagaaaatatgatattttccatgctgaacatgattagccattgtatcctgagggcctagtgcttcatgagtccacttgacaccgcagccgtgttggcatctccaaaggcctactgagaaacatgggtggggaaggaatgccaggacctgggcacactctcaggtgcaagacaaataggatgtttttatgattttatcaacatgactgaagtggagcatcacatgaaggaactatgggagatgggattgcaaacacagcctgaaccaggttgcagggaatgccctaaaacagttgaattttaaagactttaaacaaaaacacagaaggtatagatgttgtgaagattgacttgtgacacaaattctagaatttcaatagaagagaagtatctttgaaagttcaaataaataatcacaggaaaaataagttgtaataataccatgcctgatggggtacaggaatttatctaattttgtttttggtctatttgtcacttacacagtgcatgttcttattactattacatcattggctgggcgcggtggctcacatctgtaatcctagcagtttgggagcgcgaggcaggcagatcacctgaagtcaggagttcaagaccagcctggccaacatggtgaaaccctatctctattaaaaatacaaacattaacctcgcatggtggtgcatgccggttgtcccacctaattgggaggctgaggccggagacttgcttgaacccaggaggtggaggttgcagtgaaccaagatcgtgccattgcactctactctgggcaacaagaaagaaactctgtctcaaaaaacaaacaaacaaagaaacaaacaaacaaaaaacacgaaaacacatgggggtatataacaaaacaaaaaacacaaaaacacatgggggtatataacaaaactaagcccatgttacagatgagaaaactgaggcacaatgacactaattaacatgctcaagatcacacaggtgtgagagggaaactatgatttgaaccccaggcaatctgttatcagaaggtgcaataattatactacatttgttaatacacaatattggtaattattcctattggcagataggaaataatccatgagggctacttgcttatgactttaataaccttgtgattccaagaggataggaaagtgttgctgctgagggaagcaactttctgaatgggatgggttactattttacaaaatgttctttgaagaaacattggtatacttttggaggcatgtcttctgacttaattccgttttcaaattaaatcagaagaattcttgcggaagcttcttatctccattcctatctgctctctaacactacccctacctttctgaccaagataccaccaaatagctcgcatatcacaaaatgtttccttttccttatttccaaagctgtgcaggtggcctcctagtacacaaaaacagatacaacatgatattcaaatgaaagaatggatgtgtcaaagaaactgcgagagcgctccagaccctggggcagtatcccgtaggacgtaatttaataagacactgacattaagtaaagagcaagtgctcagaaaatcacaagagttaagtgaccaaaatttcaaaaattatttgagcttgatttaaaacattcattgaaaatcaccattagcagaattaaatgtttcattttaaaaaagtttttcaatagtctatttaatactaatttaagatgaatgaacacagtttcttaatacaaatcacttgctgttttataaaaaagctactgaaatgttaactataattgaattgtcacttagatttttgcaattgaatgaaactaattaaaatgaaattaacacagaagaaaggagttaattgatttttcagtcaattcttctgtacaaaggaatctacctgtgaaatttcctgtctcagtctgcttggcctgctgtaacaaagtaccacagacagagtggcctcaacaacagacagacgtggaggctaggaagccccaaatccatagcattaaccaaaatgtctgtataaattaatgcatattcaatattcggcaaggtcattttattggggacattaaataactatttatttaattattttaaaaagtaggtgaaaatatataacctctcaatctgcctattcaatacagttaaattggattcaaattctacagctgaagcaacttgtccacctaaataacctcgagcctatacaatgcctcacatttaacagagatgtttcttaacataatggctggaagtaaaggtgtatggctctggttattaaaatgtagaaattgttgtggggcttttgagggcactgtgaaattgggaaaactattaatatgcagatctctatgttttagaagctttattttaaaagcacagaaatagaaaacagctcaactaagaaacagaaacagaaagtctacctttctcctttaaaccaagttcattgtgttctacgcaacaaataagtaaatcttgcccgtaatagaagtctatattaatcaaaatatgcaattccatatttactcacgaagaatatttaagaatttcacaaaatggtactatttttagcccattcattatcctataaacctttatttttacaatttagtgccgttattggattagcttttaagaagcaacagaaactaacattttagcttagaacgttgtttcaattttttaacccaaaattaaataactacatagaattatatacagtttagtgatatatatatatcactaaactctctctctctctatatatatctatagatacatatatagatacactaaaccctctccctatatatagatatacatatatctatagatatgtctatctatagatctatctatagatatgtctatctatagatatagatatatatagagagacagagaaagagagtttagtgttaaactagatataaattaaactagatataaattaaattaaaatacaggcaagatattttgtttcactatgctgtcggaaataacttgtaatccattcaaaaactgaggataagggtgttgatattttttcgttttttatttcgcccaatgactttctactttgtcaagcaaatagagttaatacagttaatcaataagaggatatatatctcactttcattcattttttaaaaaaatctcttactagatacggatttaaggcttatgctgatgtatacatacagccctttaacaccctgagaaaattttttgttcaaataattctgaaatgatgtcatagatgcaatattaggttatggaattatagcaaacatttatctccatcatatatactctctaactttgctcctgatcttttgaccaaaatgtcacaaaccatcacaaaatattcagtttttgttattattcaaaagctgtgcagatggaattctaaatgtgctaagccaatcacgactgccctggccacaatgactgctcaggaataggcatgggactcaatgtgggccaatgagaggaaacccaggacttgtacataagcgatcttcacatagctgtttccacagaactgcacgatgtggggctacagcactgtatgtgatgatatgagatcaggaagccacccagtgctttacccagactggcaaaactgagagatgctgagacctcaggttcttgttgatgaggttgaacccttgatcaaacctcacctgaagatgtccctaggtatggactttacatcaccttaccaataaactttcattttgacttaagccaatgtgggcaactttttctctaatttgcaagtgaaaaagaagatcctaaacaatacacgtgtaatgcacatgccaacaggtgccagaagagagggtttgagcattgaggttgaatacccaaggaatacatgatactatttctatcatcctaaatgcatcatcaggttgaaaaaaaccctaaaatgaataaacacaaataataaaaaagtttccatctctttcatttcaaagtgacttgatagagagagaaatagttctcagctcagatgctcactagaaattccatttaagtcagacacttattagggaggttaaaacggcacacttttaactcagtcgacatccttaggtgtcacctgcaacctttggtatggatttgcctcttttttgccacaggcaaatcatttttatttctataattttagagaaaggaacatgaagcatggatgaatcaaatttttgagatgaaaagagaaccttgtgaggaaagcaattttcctcttttggatacacagaacttagggatgaggcagaccactgtaaaggagccagcagtctgaggagggagacaaagagatgaagacaacttgaggccgggcactgtggctcacgcctgtaatcccagcactttgggaggccaaggcgggcacatcacatggtcaggagtccgagaccagcctggtcaacatggtgaaaccccgtctttactaaaaatacaaaaattagccgggcgtggtggcatgtgcctgtagtcccagcaactcgggaggatgaggcaggagaattgcttgaacctgggaggcagaggttgcattgagccgagatcgtgccactgcactccagcctgggtgacaagaacaaaactccatctcaaaacaaaacaacaacaacaaaaaaacgtaatggcaaaaaccgcaattacttttgcaccaaccttatagaaagagccctggtgctctgtgggcctgagagggctccatctgtctgcaggaggctgctggctgagcactgggtgcactctggagagccagggaatgagggactctgatccaggacagcgtggagggagagtgattgctctgattagtaggggaagcactgaccaggctctgttacactgggcaaatcgatggggttttcactttggagagagcattctgggagctgcggcccctggggttggtggggtctggggagccagggaaagcatcagggggactgcggggttctggagtgaggtggggctaggagggtggggaggaggagcctgaactgagagctctgcagcggccagaatcctccagagctaggacataagcaggtgtggggaattagagagaaatgaagacagcacccgaatgcaccagaggggctggaggaaaaatcaggaaactgcaggcaaaatgcaaaaggctaaatacaaaaagggcctgtccaaggccctcctgtccagtgcggtggttaaaggctgagttgcaggctccctgggttcgagtcttcctagctctgtgtccttgggcaaagtttgtagagtctttttgtcttaacatttccacatgtaacagggaactgtccatcacagcatttacttcgtagaattgtcatgggactaaacacgttattacatggaaggagcctgaagcagtgcctagtctaccacacactgtttaataaatagtacctattcttccaactctagttactgagttttcatattttagaccacagagtaaaaacctgaatgacaagaaaaacagtgtaaagataatgactctggatgaaatagaataacatttaatgggtcttaatcattataatcagtagactactgactgttacatatctagatgtcaccttgatttcattgagttgggggttttgtccagatttcaaactatctcagtcaggagtctttagactccaaccaattctgggaactcctatgatcacctgcaaaataccgtattttttttcttgagataacagtcaaaatttgccttccattctcaaataaatattataaccacaaacagtaagaaccattattttaggagaaaagcagattgtgaaaatatatagatacatgttttggaaacagacacagatgatttgattcatgtttatttgtttaattttttaataacgaaattctgactgtgtatctctggttcgttaaaatccagaaatatagctttatcatttgagttacataatatccctaagcaaccccaaaaatctgccccaaaggcagaatcaaagagattctgcaccatggtaaaataaaacaagttatgctaaacaagttatgctaagtgaacatgtttgtgttttatatggactgttaaattttatcttcagaccttccccacctgcctccagttcgttaactggtgaaattagtgtggttcgtattctggactccccatggactcagaaggcttggtattaaggagaaccttggttaatctctcatctcccttttttcttcacaatgacattagtcagttttctgtaactttaaagaacaatttgtaagacccagaatatgctgagcaacatggctgggtggcaggaactagacgttgtccgtatagctaactacgagagctctggctgtgtggacaacacaccctatttaagctacaacggcagttacgattctcctttgctaaacttcttagagtggcacagttcccagattgctaataaacgtcaccccactggatcagcaagccaattcctgcatgtgagcctagtacttcatggcaaagtaccgaaataaaaattcctgttactcttcggaattatctcttggattcctccagaacacactgaaaaagtgaattcagcattcagatgcctcttgtgcccacttagcaggagtgtgcaaccatcatcccatcaaaggctgccactgacaacaaaaacaaaattgtcaccatcgttataccaagggacacgtgctgcttttaatcaatgcaattgtcagaggttgtgttattatagcttggcttctatcttccagtttttcttttgctccagattttctctctctccgtatatatatattttttcccttcataaatatgcttgacacatgctttggtttcactcttgttcaatcataaaatttcagagctgaaagggacttactttatagatgagctaattcaagcccagagcagttaggcagctcccctctcccctggttggcagagtggagcccacactttcaccctctccttccttgtcaacaaacccccacccgaccccgaccaccctaggcttcttgcctgggctagaccctgcccccatggatgaatgaaatgaaagcgtgtgaccacctacccacacaccttggcagaggtgcactccacacacggcggcccccacccaggcaggtaagcttggtggcaccttctaaacgatatcccaggaagcaggaaaacgtcagagagtctcccacaccaaagtgaaaaccaattcttcggctgaaggcagggactccaggatcatcacatggctccaggtcatattctgaggcatgcagagacagagtaaatgcatgaggatttgggtaaatacacaaagattaaatagcaagaataaaaagtgctattactaaaaaaaaaaaaaaaaacctacatatatattttccccaaacacttataactgttacgtgcattttttttcttgtactatgaactgtcttatgacaaatgacatgggatttagtatttttttttttttaagaattgacaggtaagaatgagaattactagaggctgggaagggggtgtatggagggaaggataaagtgatgttggtcaatggatacaaggatacagttagaaggaatatgttctaatacttgatagcagagtaaggtgactatagtgagtaataatacagtgtacatttcaaaatagctcaaaggcaagatcggaaatgttcccaacacaaagaaataataaatatttgaggtgatgggattcttaagtatcttgatatgtttgtcacacattctactcatgtatcaaaatatcacatgcaccccataaatgtgtacaattattatgtaactagaagacaagcagacaaatagcatattaaaatgagataattcacttcaaaactgtcagcttgagagtgtggaataattttactgatatttctaattgcttaaattggttactgtatccctcccaaaggtgctttttggtaactaacgcatgaagcataacataaaagcaaaggcacagggctatgtttctggaaatcttatcagagccaattttgcctctagaatatacctcagtgaggaacagtggaattttcctctgtttattttcaatctgtaaaccatgtgagattgaaaagtagtagacaagattttgtactaaaattactataaaccattcaagaaggaagtgctaaatataaattaaaaaataaatgtctgatattttgctgcattttgggagtaagtattcaaaatgtcagcactgatatctcacttctgtgtttgccacgttctttacagccaactccttctgatctccgtagtatgtacgtataattgagctctggctgtcaccagcctcttggtccattatcaagtccatggttttgacagtgggaagtgagaaagtgtgggtaagtgcctatttgtttggtttcctccttcttgctgtttccccagtctgtaatgcccagttttgtcagatagtatcaaacagtcagccagccaactaggaaaatatgcttaggtattggaatggtaagaagagtttcagagagaatcttgaaaggccaactaaaagatgtgcattattgcaaagaattgggacaatgaagatcactcttagtttaccgtggggaagaaacgtttagaaaactatgctaatctttctaaaaaaaattacttctacttttttctaacaccatctttagggttcccctaactcggaattttaggttcattattttcactggacatataaaatccaactgatccttttccccttagtattcctcaaatctgatccttcttttttttttttttagtttagttttcattatctgctgagtttgtcactgagatctcatacctgcacttttataaaaacttttatggaactctgtacctaaacacttccttcatctcacttagcttactggtaaagctctgaggtggatactttctgaattatctttgcgtttagataagcaatctactctggatctgtaaaacattcaaactaacattgataaccttgagatatacttattaatttgacttatgcatagtatgactcagaaagaaaataatatagacaatgtcatttaattgaactcaacaaacattaattgacaacctatcatacgtttactttttagaacatattaaaataaagatgtcacaattcagataatattatcacataccttgctgttatcattctacttctatctaaggatatactgtgtgcactcaattcaagccatacatttcctgtcatttctttaaaaatagttgaaaactccaggcactgtggctcatacctgtaatctcagcactttgggaggcagaggcgggtggatcatgaggtcaggagtttgagaccagactgactaacacggtgaaaccctgtctttactaaaaataaaataaaataaaataaaaaataacaaaaaaattagctgggcatggtggtgcatgcctgtaatcccagctactcgggaggccgaggcagaagaatcgcttgaaccctggaggtggaggttgcagtgagctgagattgcaccactgcattcaagcctgggcaacagagcaagattccatctcaaaaaaaaaaaaaaaaaaaaacaaacaaaaacattcttgccaaacaggagaatattttgatattattatgtgctatacctattatcttatataaagaaacaccatgatcttatggttctttgctttaagtatatttttactatatattgtagtttatacaatatcctctgaaagcaacttagaaggacagaaagcctgaaacaacaccatgaggttagaaggtgtgtgttagttgtaaccatcttgattaggctttctaaggattctcttatattaattatcacttaatcattattatacaaagtatatttgcaaggtgtgcatgttcatctttgtctaacacaagaaaagtgtattgccttcagaattccatcttctcaccaacgcaaagattttgttcttggagtttatcctttttttcccccttcatcaattctcttatttccatcaagataaaaatatgcgttacacggtcaatcttaagaatgagataaacaaccaaaaccaccaacaaaacaaactaacaacaccaatctctggacttcacagtcacccagccaccatatccctactctggttatcattagcacaaatttttcaaagtgttgggtgtaccttccattttcccatcctcccttccaagactgtcttcctctcatctattcaggctttccttcacagccttccactcaaatgatcttaccaaagccactgtgacctccggatgcaaaaaccaatggtcaattcttaggcttcctcttactaagtaggttttaatacagttgaatgctctcttttttctccaaaggctttcctttcttagctccctggatgccactctcctcctaactcactggacccaacttctcatttggctgattcggaacttctgctgccccatgtgttgaaattaattctatgccgatgggtttccagtatttctttttctttaatatgatcctgttatatgaactgaagactcttgtcaatcactcttgaatacatccctcaatatccccaggagaaaaaggtctgtattttcttcccaaacctgctttgcttccagtggttttcacgtaaaacagagcatcctcattcatgcaggtgcaaaatcttgaccccactctgtattttatatgacaccttcacttcctgccaatcaagtcagctctaaccttgcatccttcctgtagtctcagcttccatcttgcatctcttgctgggattattgtgtaacatgttcctgttgagactcacgcattgtctttcaagtaaacattgaaaaagctcagatcatgtcaagctcttcaaatccatccaatggcttcatgcaacatcctgagttaacatccaagttacttatgttatctgccctccataactaacttcacgtccctccactttcccctcggtttcaggggtctggccacagtgcccctctgctttatcctaaacttggtgtcttggtcctcccattgtacctctgtctgctgagagcccacccaaattagctggcctgtccattccctgcttcacaatcaagtctcagcctgtcagagacctgcctaggcaattaaagaatgagcgtactctcctctgtcccaggtactcatgactcaaccacagaagaagaaacagtatcctcatttgaaaagtcatggtaccattgaaggagacaaatacagaaaagtcattatgggaaaggaataattttggtgtaaaaacgtcatggaaacgtttttctcctgtattatatagaagaaaacaaattctgcctagggaaaagaagaaaggctgcatgtcagagacaccctctgacctggacaggaggagttttgcctggtgaaaaatgtagaaaggcttatttatttatttatttatttattatttttttgagaccgagtctcgctgtattgccgaggctggagtgcagtggcgcgatctccgctcactgcaagctccgcttcccgggttcactccattctcctgcctcagtctcctgagtagctgcgaccacaggcgcctgccaccaaggcttttgaatgaagagaaaatcacatatgtaatggcacaaagtggtccaacttttaaccttttgaagagaatgactgagaaatgatgctaattcactagaagttagcactgaagaagtagacacgtcgtagcgagtgggaaagtaagtgtggagtatccagtgcacatagttagcaactagtagcagacaatgttatgtagaatggggattgtgcaggtttatctaagccaactggaatacggggctctttttctacaatattaccgttaacatctgcagaaatactgactaggaaacacaatcaggaaacactgctttaataaggccttctgagaaaggcagaaataaactcgattaacaggaaagaaggcagatataaaagcatatgaataccatttatgataaaccacaaagtctctggatgggtaaatgcctcatttgtataataaagttgctagttatttgtatacttaaaaaaaaaactccatggtatcagtgtcactggcaattgtttgcagcacagtttctaggcaaaaatcctaccaaatgaaattactcctctaacatacctgaagaatttgtttactttaaagtcgactttgaaatccaaagtgttgtcttttgtttttaaaaagactttctgcttgtgtgcaactgtctagatgaaatttatttcttctgcaggctttaggtattattttctactggttatgtttaaatgaattgttctgaatgtttacagactgttaaccactttaaagacccatgaaagagtattttattgttgttggcttgcttgtttgtgcaagtagtttataatgacagtgtcagctgtgtagttacattctgacttttatatggtctgagtgtgttacccaaaatccatgtgctggaaatttgatcccctttttgggagtgtttatgtcatgagggacccaccctcattaatggattaaagccattaaaagggcttcttctcttttaccccatggggatatgggcgattctcccctttctgaccatattaccttctgccatgtgatgtcacagcaagaaggctcaccccagatgccagcaccttgatcttggacttcccagggtccagaattgagaaacaaatttctgttatttataaattatctagtctcaggtatgctgttatggcaagtggcacaaacagactaagacagtagtcgtcaaaagagttactgtcagacctgtggtgagggcaccagaataagaaactgatgcagtaaaatgaatagaatttgcacagacttctgagaaacacctgcagaagtgaactgtaacagacttgcgtcactgccattttctttttttggagaagtctatttaaattcattttgggtcctgatgaaagtaagaactggaggaagtgatattctcatagcaatactaattgagatacaccaggggagaatgcagagagagagggatttaggaattagtgttgggaagatttaagtctttgatatataaagtggcaagtttcatgattactgctgattacaacaaatttccaagaaatcaagtggtctgagccagtcttgaaagcttcacttgagtagtgaaataccaagaaaaatcaacaaagtcagattaagataaatggcaactaggtagaattagagggagtataaagtagttcagagcatcttaaaatccccaagaaatattttccttgaagacactatttgattttacataatgttaatcaacatgcactagttagtaggcaattgtgaagttcttattacagttgactcttgaaaaatgtgggtttgaactacttgaatccatttatacatgaattgttttcaataaatacattgacaattttttggagatttgctacaacttaaaaacacatgcagacgaaccatgtcatcaagacttaccttagaaattagtaaaatgttaggtatatcatgaaagcacaaaatatatgtagatactagtttatttatgtgttaattgactgtaggcttttggtcaacagtaggctattagtagttaagtttttggggcgtcaagagttaccctcaggttttccactgtgtgggggttgacaccccaacccttgtattattgaactacagttgaccttgaataatacaaggattaggggtgtcgatccccgcacagtggaacatcatcttacttatgagtaactcatcttacagtaacatacagcagtagagctgttgtttatataaaagtggggcaagcaaactttctaccaagatcttcagttttggtttgggagataagataaatactcaactattgtgacacataatctcataagtggcatcagaagttattaaggaatttatgagatctcaaaagtagaataaattacatgtgactgtggtacccagggaccaccttatgaaaattacatttgatctgggctatgaggaataaggaaggaaaaccctcttcgtccaaagcatcatatgcacaaatgcaagttaatatgattgttcccatcctttggcagctgtagtgcagcagggccctttctgttggtggagggtgggggcatgctggaaatgaagacactgcagaggttctcagtgtgacctgttcactgagcatcatttgtttatgtgaccaagtttatctctcacatgtttggccagtttttaagtggcggcaattttttcttatctgtagaaaaaattagcatctctgtcatagaactatacaaattaaacaatctaacccatacaaataatttctgctgtaacataaaccttatgcaaatattatctatatattatcattaaaaataaagatgttacctaacttggagtattttttgtcattgcatatgaatatattaaactacaagctcatcctcaactgtgtgtgtccacctgcttctttcatcctagaggtggttgtcaatgcaaatattggcacctaccgtagggtagaaaccaatgcaatcaggtgacaacagacccagaggatgcctcccaataaaggaactttcctcagagatcttgtagagttggtgaagagaatcgagtgagaagggctttgcagaatgtagtgacatctacagatttttcaaagacgagaattcacaaattgtgtaacacaaagtggcattttctggatgccacataactgtacttgcaccctgcttcgtggaggctcagcctcctgcaccccattagttggaatcaagtcacgcatgtacaaacacacacggatgcacacattacacacacacacacacccacacacattctcactaacagaaatggcagtattgttgccagaggagagaaacagcaaacaagaccaacatacctgaaaatgtgatattgaagccctcgtacgaaattgagaagtctgatataaaccgaagctgggcagtgaagtttccaaacaggcctgccttgatcgtatgaggcaacaccgacccggtgagcctggcaacgggctcggaaaaacttccatcctctgtgatcagtaaatagtcgtgggaactctcaagatgaaaggtgtgaaagatcatttgaactcctgagaaatgaagccgggggagagagagagagacagagagagacacacggggcggcgggggcagagagggagcggggcagagagagacagagacatagagatgacagagatggagaggaagagaaaataagaggggaagacagattgcagagagtaatagccacagagagacagagatgataaagagatgagacagagatggagagagatggagaggagagagagaaaaagagagaggttaggagaggtaacaattgctgaaaaattttttctggacttagacacatcaagccttaatcaaaatattaaaatgttatcttgatatgaaaatctagctttgaagtttaagaggaaaattggtggaaagaggacggctttagaaatgaaaaaaagcagaagggataaacaacaaaaataaatacttaagtgcatataagtacagatatgatgtaaatatgaagatatgatgtggacatcaatattgaggaaatatggagattatagatgtagttatatatagatacagatatagatgtacatattggcatagatatgtatatttaagaaaaacaggtgagaatgtttacaatgggtttcatttaaaaattgtcagtagactcttagggacagtatttgtcccagagggacaaaggaccagacaaattttcaatttactctaaacaggtgtcctttagaaaaatcttatttggaggtctgcataaccgaggaaaaacttccttaaaaatgtagttttagatgcccgtaaagcatatgacctcatagtaaccggaactacaaaggcttatttctggattcctatagtgaaattaataaaattaactgtgaacagataacttctaataaaaatgtgtatttttatgattataaaactttgatcactcataatctgtgtcttctttatgcttaatttccttcagggcaagttcttctttcatgtcattcatggcagcatagtgccacacagtacacataataaaatgtagccatttcatattaagtcgggttcaaatctatgtgaaaagacgaagtctacataatacttatgtgatcgaaattccaaatagactcttgtttattttattttttgagatagagtctcgctctatctcctaggctggagtacagtggcgcaatctcagctcactgcaacttccgcctcctgggttcaagccattcccctgactctgcccccagagtagctgcgattacaggcatgcaccacgatgcctggctaattattttgtatttttagtagagacaaggttccaccatattggctagtctggtctggaactcctgacctcaggtgatacacctgtcttggcctcccgaactgctgggattacaagcgtgagtcacttcacctggccccaaatagactcttaaagatgacacgtttagtcacagaaaaaagtttcaggctacaatcctaatcccagtgtttataatctacatttcctgcacaaaatgcaaaatatcctgatcttcactatgcttacctataaaatgaggatagaaatatctattctatgagccatctctggattatgtgaagataaattattcattatgtatgatgatactgggtaaacataaaatacaaggaaagtacaaaaattgtcccagatatatcatgaaattggaagttggacaatcgcttatttccctttatttaatcaatggtcagattttattgaatagatgcctttattccttaccacgatagctatatttcaagcttatgttcacatgcgtatattcaggttatctgataaacagagagcaaaacggggaatggtttttattgtacagttgaaagactattgttcttccaaaatcttattaaataataagttaaaatcttgaactatacatgagaaaagtagttatctcacttgtttacaccgtaatatgtttttgttttgttcccgtttttctgtctcatttattagtctgtatgtttgagacctatgatagattcttacctttcccatgagacacttcaatggtccacgtgcagtttagagagtttggataaaaatctggaaacccaggagaaaggactgttccactcttcccttggatgtagcctccacatagagcttaaaataataaagagagatgattacagcactaaagtttcacaatgattgccagaacaaaatactggttaaatggcatgcaatttgcacaaggattaacaaatttaatgtcatatccaagaaaaaccaagcagaacctgagctttatgttacttgcaaatatcatatgctagttcatatgaagggatcttaaccactacaaaaccttgacaacgtaacacagaataaggcacagcaggagagctggaacctgcattaacaagcctcagaattgcagacatggtacaggtttgcactcctgagagccgctggtcttcttagcagcacttcattgagttcaaatcccctcaacaaaccatgtcatgttcaaacactcacttcagacactcattttggaaaaaaagaagagaaagttttatgtaatcatttcaatgggaaagtggcaacaattaggatgtctgcagaatatgggagcttaagtgctcaactctgatgttagaaagttatgagttcaaatgccagctcagcttctcactagctctgtgatctctggtaagtctctcaatcctttacatttctcccatcttgaaaatagaaattatgataaaatccatctcatggataggtgtttgcaatgattgccattgtagaacacaatttacagtgtgtagtagctactaaatgattaaaatggtacctactgatagatactgatcaaaacgttatctactgagagttgctaacgggaattcaattcttaagatatcaataatttaaccttttgaatagactccatatgccctaattttacagacatcaagaggagaatattgacacgttcccgccaactttcttcttttatttcatatcttaagacctctcaagctatcctatgaatggaagcactgaactgaaaaagaataaaaggaaatggagtcaccagagccggagggtagaggcaggaaaggcaactgccgttcatgctctgcaaacaaacagccatgtgctccgggtcttgctcttctcctggaacctctccacctgcagttgtgaggcctatggatgtcaccagctcagatctcgagaccaggctgcccaccctcactgcagcacctccactgtgatggtgaaggttatgtgccagtgtgactgggctaagggctgcccagatagctggtaagaggccggtcatgtctgtgagggtgctgctaggacagattagaatttgagtcagtggactgagtgaagatttgctttcaccaatgtgaactggcatcattcaatctgctgagggctggaaccgaataaaaaggcagagaaaaggctgggcacggtagctcacacctgtaatcccagcactttgggaggctgaggcaggtggatcacctgaggtcaggagttccagaccagcctggccagcatggcaaaaccccatgtttatcaaaaatataaattattagccaggcatagtggcagaagcctacaattccagctattcagaaggctgaggaaggaaaatcacttaaacccgggatgcggaggttgcagtgagctgagatcacgccattgcactccagcctggggcaacaagagtcaaactccatcaaaaaaaaaaaggcagagtaaagaaaaattttatcttttcttgagctgggacatccatcttctcttgaccctgacttcagagctcctggttcttgaaccatcagacccagaacatacatcttcagctcccctggttcccaggtcttcagtctcagacttaattatgccactggcttttccagatgtctagcttgcagaaggcagatcttgggaccttttggcctcccaaacacatgagccaattcccacaataaatcctggttctgtttctctggagcacactgactaatacatccacttactagttagtaacacgtgcaaagttctctaccgctctgtgcttccatggcctcacatgtaaaatggggcaaaaatcacagctcattcctgcttgctgaagaatgaaataagtgaatacatgtaaggagctcacaatagtgtctcacaagtgaaacatcactcagtgtcacaatttactatgcatttcacaaggttcctttgctttttttttttttaacatgcccacattctgtgcatgtatatatttatacttcttttcttaaactaggtaagatgaactatcatgaagtaaatgatactcagaataacttcttccaattagtatgatcattctgaattatgttttataaaagcctcttccacaaataatattcacaaaagaattagataatctatgaaagatgtgactagcctcatcgtgctcactaaccatccatcttaagggaacaaatcatctcctttaatacgtaaacctcatgggaagcatgatataaaaatcggcaaaagagaaaatttttaaaataatttctagaatattttaagaatttctcatggaatttttgcatctgaagattgcagtgactccacatttcactgtgaaagaagtaacattatacatcccacttgaaattaatgtattcaacaaatcgttattgggcacctgctattgagcaagctctgcccccagcatcagggatgattaataataagagagataaaatatctgcccttctaaagtatgaattccagttggaaaagacaggataaaacctgtaacaacataaaaggcagatgatatacaatattggcagatgacacatgactgtgaagaaaattaagaaaaagggatgggatagtgtgaggcttctgggtggccagcggtgccgtacttaggaagtggtctataaataaggacttgagagagacaaaggaaacagtgaatacctggggaacaatttgggtagagagaaagtggttaggaccagggctcaagctacagtggagctgcagggacagggaacagaaaggacacctctgtgactggggggtccttgtaagggttggaggtttctttcagtgacatgatggggcactggatggccctgcctagaaaacgacacgatctcatgacctacctggggtttagccctgctcctgaggctgtgctgagagaatacacagtggtgaagggaggaaggtggtcaggaccccgaaccagggcattggcagcaagatgggaagacatggtctgaacctgcctgtgtcctgaaggtagagccggtgggactttctcctgaatgggatatgggcattacgataaaaaggaggagctgggggtgattgtgagttcataacctgagtgtgaaataactacaggtgaaggagatctcaggagaaccaggtcatgagtgtaaggcaggcgttcagctttggataccaaagctccaagtctgctgggcttgcctgtagaatggccgacattataacaggttacataggtctggaggccatggaagagggttgagcaagggatagaagggagaccacaactatgtgagaacaccagtggcagtgaatgtagaaataagcttccatagagggaactaatgccagcgcaccgcgtagtgggaagaaaaccagcagaggacggaggagtcccgaattcagaaggtttggattcgtaacttttcactggtctatgattggattggtatgaattgatgcaataatttctcaaatttttatgaagacgatcaccataatgaatgtaaaacattttatgtaaaactgagatatcttatatccaaagctacttgtcagtggtctttatcccaaaatctgcatgttatataaactgataaaattaattcatatccaactatgtttaacagtataaaaacaatcaatctttattttatcctctgtcttcatatcatcaggaaaagttacttgatcatttattggggaaaaatctgggagggaatgtgctctgccctctttttgatgttttccctccataccacacacagaacccggaaatcactgaccagccccgtcatgctgccatcaggagaaagtcagacagaaagttagagataaagctgctctcaggcttgtttagatttatatgggtgcaaacacaacgtagtccaattcagttatcatgaagactttacataaaagtaattctgtccacaaatcctataatatttttcaggagaaggaaatttgatgtatggagaattgaattggtattctcacctaaaattgaagtgaggagatgagagaatgaaatgaaatacctgaattacattttagtgtctatacaggtgagggctgtattcatatgtagacatgtctacattcccttagcagagctacaaatatagctgctcataatttgaattatgttaatctgtttcttcatgcacggtagatccttttctgagtagctgtaaaagacacagtaaaattttactgttgctgtccttaatgctataatttcttgaattttacttttctatttatgtaacccagccaacaccaaggatgcaggtatgttacattagaaatcttttggatggaggactaagatatgcagaaatcattgaagaacaaaagaggagacatacgttgtgatattttcctggctgagttgaagtaaagcatccaactattttttttttttttttttgagatggagacttgcttctttgcccaggctggagtgcagtggtgagatcttggctcactgcaacctctgcctcccgggttcaagcaattctcctccctcagcctcctcaatagctgggattacacacatgtatcaccacagccagctaattttttgtatttttagtagagacggggtttcaccttgttgtcccggctagtctcgaactcctgacctcaagtcatctacctgccccgcctcagcctcccaatgtgctgagattacaggcgtgagccaccatgtccgacccatccacccgtttttcaagttctgtcttttgtcctctacttttatccattcatctatcccatcctgcatttagagttacttattaagaaacatactaatgttttccaaacactcattgatgcttctgggcatagaacaatgaataagacagaaaagtccctgtttttccaaagtttacattctaatggggaaggcaaataacttggttttaaaactccagataacgaggtctgatttattctaagaacaagaatattaagttgctctctaaactcaaaggaggtctagatgattagactatgacggacatgctggtgaatcaacaaagtgatgaatgcacatcctggcaaatgtccactcccaggatggtgagtatggagtaagtgatacaaggtcggaggaaatgcagaagatcagaagcaaccctatggtagcagggtgccccgagacaggctgtctgctgaggtttctctgccaactcattccaggatcctacggcttcctactgatgttcatggcaaagcacacagccctctggggattctttagttatttattgtcttcccaccacccgcaccaccccatcacttccccagaccctgccaaagtcttctaataaatggaagtttgcagagtcagttattgttgcctggaactcagaaattgaattcaacaagtttatggatgggaggagggcggcagttgaagcacgcagacaatttcacaggcaacagtgatctccgtgttagagacggcagtgggaaaaagaggagctggtgatgatacacctgctagctccctggacggtggcattcacctccacggtgcccaactgtaacttgaaacctgacagcttccacatgtacatgttaaacactgacctcgttctccaactgtgttgaacttccaactgcttgccaggtttctcgggatgtcaccttggagtcacctctctctcctaaactcctgtatcctcctagtgacacttctaactactccccactattgctttcttcaactggtgtgtttcaggttatttttgtcttatcaattgcctagcctctgcaagtctgcctcttcctcaaagagatccacctgtgaaagcacagccttgggcctgatctgtttccatcttttctctttttttccatcattttcttgttctcctgaaaccacaaatacagttctatttgaagtcagacttaatgagttactttccacttcaataatattcatagactctccatgccctacagaagtcgctgattttattcatatatttatatgaatacattatatatatttttatgaataaatatgttgttcacatatttatttataatagaaactttccaccaaaaggaatcttgtgcagaaacccccagtaggaaggaggggagtaaattggggcagtccagctgcataggagagattccaatcctgatgaccagcccccatctcaccctcagaaaaaccctggggtcctcacagtgtgatcgctggacactgcagcatgaatctctgcctatggccatagaccagcactcgaggcatttgatcatcatctaccttcagtgattcacacccctcaatcctccagacctctttttttctctttgcacctcagtttataaccatttcttcacgttgaaacatgtccctccctctcaacctccatcttaaagatgtatctccaaaattgcctccaagctttcgatatcccaaattggaactttttttctccaacttctttatcctcatccacttttctgtgtctaataaagcacttacttcattgtgtgatttttaaaaatgtctttccttttgctatgctgatagattttaaacttctgtgtgattgcaaatacagcaggttctcaataaatgcttgtggagagagtaaacagttttcaaaaatacttatttaataaaaaaaattttttgacaatataaaaatattttaataacataattactattgaaatattaagaaataaagagtaaactaattgcctgcaagtatggatgaaaagggtaaccaataatactttttcaaatgccaagaacaacaaatttgtctgaaaacatatttgaattgggaaggaaagcattgattatatctcatggtgacacagacttgtttttaaagctttctattaataaatttttctacagaacatatatcttattcataataaaaaagataattaaaatttacaatgttaaatataaaatattcatatttatcatgttacctcccattctccgtgaaaaatgtgcagttgaactacttgcatgattccaaataaattctttttttgttgttaaaactatctttctttaattaaaaaaaatttcaaagttttctttgcgtttgtctttcacaaaattagaggacaatttatcccaatgttcacttctttaacatttgaatgtgtgaaagagtaatgttaaaaacacactgaactgatgctatgcacccagcacagacactgagtttatcgtgtttcatgttgatatacaatattataattatttttttttcttttctgaaagctatgaatgtttaaaggtttaaatatcctacttatgtaacttttgttgcacgaaaaacccatggggtttaagagattgcttaagatttgaagggtaatgagaacaagccttatggttggatgaaaactatcaaacatgactgactgaaactcccatatcaaactctaacatcacccaaaatttgtagatttagtaatagctctttctttgtggagacagagtcttgctctattgtccaggctgtagtgtagtggtgtgatcttggctctctgcagccttgaccacctgggctcaagtgatccccctgcctcagcgtcctgaaccgctgggactataggcacatgccaatacccccagctaatttttgtgtttttttgtgtggaaatggggttttactgtgttgcccaggctggcctcgaactcctgggcctcagcaatctatctacctcagcctcccaatgtgctaggattacaggcatgagccaccatgcctggcttattaatagatttttaccacaaattctttatactgagaaacatgttccagtgctgcaaattacagtcatgctattgattccttcgaaaggtttaaatctcaaatttacatacatttatatcgacagacaataaagaaacaaaatgaataagctaagtgtacttttattttctatggaaaatgccacccatataactggcatccctatagcatctcaattcctgtactgcaaaacctattggctctttttggtctattcccactccgtttctcctaaatcattttcctattgatccttcactcagtttccattaaacctactttgctaaacctccaggaattcttactgtaccgcacctatcaactcctggtaattctgctcatatcctgggatgcctgttcacatgctggctactttgggaaatcctacccaaaacggaaacaccaggttaagggctgtactttccatgaatgtttcctcagttactaccccctgggagcttaaaatcaaactgaactgactgtattgagtatgtaaaatgtattagtctaagatatattcaatataagttgtaaacacatgttatattatctctctctctctttctatctaactttatggagctgaatattaaaagaattgaggtcagaaaagtcagtgccgtcatggcctggagcaattccagaggaatgctcatcaaggctgagtgtgacctggtcttggaggttgaaaatgatttaaataatgcaacatgtaaggatgaagaagggtattgaatattggatgtgtttgattgttggtaagaagagaggaagacattcaattaataagttttattttctaggtcacctgctgggtagagtagaaaatagtcttggctaaaccaggaagaagtcgaatccctgaatagaccaaaaacaagttctgaaattgaagcagtaattaatagcctaccaactaaaagaagcccaggaccaggtggattcacagtcgaattctcccagaagtacaaagaggagctggtaccattccttctgaaactattccagacaataaaaaagagggactcctccctaactcattttatgagggcagcatcatcctgataccaaaacctggcaaaggcacagcaaaaaaagaaaatttcaggccaatatccctgaagaacaccgatgtgaaaatcctccataaaatgctggcaaaccaattccagcagcacatcaaaaagcctatccaccatgatcaagtcagctttatccctgggatgcaaggctagttccatatatgcaaatcaataaacgtaatccatcacttaaacagaaccaatgacaaaaaccacatgattatctcaagagatgaagaaaaggccttcaataaacttcaacaccccttcatgctaaaaactctcaataaactaggtagtgatggaacatatctcaaaataataagctatttatgacaaacccacagccaatatcatgctgaatgggcaaaagctggaagcattccctttgaaaactggcaaaagacaaggatgccctttctcaccactcctattcaacacagtattggaagttctggccagggtactcaggcaagagaaagaaagaaaacgcattcaaataggaagagatgaagtcaaattgtctctgtttggagatgacatgattgtatatttagaaaaccccattttctcatctcaaaatctccttaagctgataaacaacttcagcaatgtctcaggatacaatatcaatgtgcgaaaagcacaagcattcctatacataaataatagacaaacagagagccaaatcaagaatgaactcccattcacaattgctacaaagagaataaaatgctgaggaatacaacttacaagggatgtgaaggatctcttcaaggagaactacaaaccactgctcaaggaaataagagaggacacaaacaaataaaaaaacattccatgctcatggataggaaaaatgaatattgtgaaaatggcaatactgtccaaagtaatttatagatttattgctatccccatcaagctaccattgactttcttcattgaattagaaaaaactacttaaaatgtcatatggaaccaaaaaagagcccatatagccaaatgaatcctaagccaaaagaacatagttggaggcatcgtgctacctgacttcgaactatactaccaggctacagtaacaaaaacagcaaggtactggtaccaaagcagatatatagaccaatggaacagaacagaggtctctgaaataacaccacatatctacaaccaactgacctttgacaaatgtgataaaaacaagcaatggggaaaggattccgtatttaataaatggtgttgggaaaactggctagccatatgcagaaaactgaaactggaccccttccttacactttatacaaaaattaactcaagatggattaaagacttaaacataagacctaaaaccataaaaaccctagaagaaaacataagcaatacaattcaggacataggcatgggcaaggacttcatgactaaaacaccaaaaagcaatggcaacagaatccaaaatagacaaatgggatataattaaagagcttctgcactgcaaaagaaagtacctcagagtgaacaggcaacctacagaatgggagaaaaattttgcaatctatccatctgacaaagggctaatacccagaatctacaaagaacttgaacaaatttacaacaaaaaacaaccccatcaaaaagtgggtgaaggatatgaacagacacttctctaaagaagacatttatgcagccaacaaacataagaaaaaaagctcatcatcactggtcattagagaaatgcacatcgaaaccacagtgagacacagtctcacaaccgttagaaaggggatcactaaaaagtcaggaaacaacagatgctggagaggctgtggagaaacaggaacacttttacactgttggtgggagtgtaaattagttcaaccattgtggaagacagtgtggtgattcctcaaggatctagaaccagaaataccatttgactcagaaatcccattactgggtatgtacccaaaggattataaatcattctactatgaagacatatacacacatatgtttattgcagccctgttcacaatagcaaggacttggaacaaacccaaatgtccatcaatgataggctggataaagacaatgtggcacatatacatcatggaatactacgcagccataaaaaaggatgagttcatgtcctttgcagggacatggatgaatctggaaaccatcactgtcggtagactaacataggaatacaaaaccaaacaccacatgttctcactcataagagggagctgaacaatgagaacacatggacacaggctggggaaacatcacacactgggtcctgttcggagaatgcagggctaggggaggcatagcattagaagaaatacctaatgtagatgatgggttgttgggtgcagcaaaacaccatggcgtgtgtatacctatgtaacaaacctgcacgatccgcacatgtgtcccagaacttaaagtataatgaaaaaaaaaaaagttttggttagatagtaaaatattttaaaaagtaagttaccaatgctcaaagaagaatttggggatggtacttgaatgcacaggtatgtgagaaggttgttttgagaaaaacctcacttacaatcaaaattatgtatctcaaatgagtcaggcaaagtctcttgcttgggtatatcagttttcattaccagatcaagagcatacgtaattcaatgactgtgctatgatgaacagggtgcgttcacccatcaccttacattcagagtactacaacttttcaatctttacaggtatgactaaaatgactgcaagtaaaacaacttgacaagccccatgtcggtacctgttcaacagatctacccacatgaaaaaaaaaagagagcagcttacacacaccctatgttaaaattctatttttgtctatagtccaaattaacaaaaataaattattaaaaatgcacagtatcatccaagaaagccatatgtgtttgcatggcacataaacattcaagtaaaattattgatacaattaacttattctattgcaaatttagggtaatttaataaaacatcaaacagattcaagttcagttacacatgaagaaaacttgaatattttaagggttatcattcttattgcaaatatttttaatatagaacccaaaaatatgacaaatatttgcatcgtctatatgacatccttgagttttacaaaattataattagccagtagttatcatccttctgacactaaaaattatacagacacatgtagtttatttatttttcattactagagttccaattacaaaaataagactcagtaacataaattcaaataataccaaaaaatgtagagtgaaaaataaaaaatctcactgctcccacgctacagcctagttatctctgaagaggcgagcatgagagttacaattttagaatgtctattttcagtcaatttctatgcaattctgtgtgtacctgcaattacatatatctatacagtatatgcatatacacaacatgcattgttctattacctcttattttttcctttaaaaagaatgtatcaggctgggcgcggtggctcacatctataatcccagcactttgggaggccgaggcaggcagattacctgaggtcaggagttcgagaccagcctggccaacatggcaaaaccctgtctctactaaaaaatacaaaaattagctgggcatggtggtgggagcctgtaatcccggctgctcgggaggctgaggcagggtaatcgcttgaacctgggaggcggaggttttagtgagccgagatcctgtcactgtgctccagcaggaaagggaaaaagttattatttatttgcattcttctgattcctagtcagcactggaatattttttaaagtttattgggttagggttatttatatatatatataaatttatatatgtatatttattattagcattccaataactttagtaattagttatatatatgttattatataatatataacacataatatattatataataacatatataatataatatatataatatattatatataatctatatatttaattagttatgtatataaatttatatatatataaatttatataaatatatatttattattagcattatgtctttctctatatatatctataatagatatataaatatctctatataatatataataataaatataaatataaatatctctctctatatagagatagatataaaatgtatctgcatagctcattttctcatagatctgttggcttattagtgttgcatttcttctctcttccagtagcagagtatgattatttcatgtgtatattacatggagaatgcaactatttttggttgtctgaccctttattttacatctttaatagaataacttttagtgtgcatatagcaaaattgatcaatgttttttcatttactgtttctggatttctttagttttccaagatttaaaaactaagatttctcaaaaaaacccaaaactaaatgacaaagaaaacatgatgctcacaggcatggccacttaaacgctgtgacaaagtcagccgaacaatgagaggagaaacaggatctcaaataccaatgatgccagcgcatgtagatagccagattggagaagaaatggatctggacactacatcgttccttaccacaaatccacaaatttttagatggattgaagttataaatttaaaagataaacataagtttttacttttaggggtgattaacaagttatagatcatggtgatgctttcatagatgttcatatgtatcacaaatcgcatcaaattgttcacattaaacatgcagtttactgcatttcagtcacacctcaataaagctgttaaaatgtttaaagtttttaggagagaacaacagaatgtcttcattactctgaacggagggaagccttcttccacactaggaaaacctcatgcatggagggaagccttcttccacactagaaaaacctcatgcatggagggaagccttcttccacactagaaaaacctcatgcatggagggaagccttcttccacactaggaaaacctcatgcatggagggaagccttcttccacactaggaaaacctcatgcacgaatgaaaacagtgaaatatgggactatcttaaaattaaaaatttctattcatcgaaatgatgccaataagagaaggagaagaacaactccagaataaaagacttacaatgtgtagatcgaaggaactgtatctaaatatttacacaacacctataattcagtaagataaacgcatgtgacccaatagaaatggaagcaaagaaagagatgctttataagagatgatacatcaatgtccaataaatatacaaaaatgtgctcagaacaactgaaatgtcagcaaacagtagaatgaaataaaaacttttgatatgtttaagcaataatattagatgatgagaagcagcgaaacacagctaactgccataatatggatggaccccacagacttaaggttgcaggaaagaagctggacaaacaggaccttccctggataatttcatttatttacataaccactagtgccagacaattaaggttcaaccctgggaggcagtgactgggcgaggctgtgaaagcgaagtgtggagtcctggaaaagttcgtttagtgacctacatggtcttgagctgacagggacatgtttactctgggaaatgcattgagctacacacttatacttgtagaaataaataaatatgtagacatctttaaaaaatggttgtctgagagatagtctaaattttcacataataattttaagttttgaatctttatatcttcaatcaatgtgtaacttatttcatgtacatttttaaacatttttaaatcaaatcaggcatccaatttgagcaacactatgtcttaataggatatcccttttctacaaaatggaataattatattataaattaagtttctgtacagacaaagatctgttactagaatccttacgctattgcactaatatatttgtgtatttccataccaattccacattgttcggtttatcattagtttttcatatgctctgatacaacatgggacagtccttccttattattctcaaaaatatatttcgtatccatttggagcatttcttttccaaattaatttttaaatatttgcaaattgctatttatatattgctatatacatataaattaatatagatgctatttatatataaatatatatttatataaattatatataaatatatttataatatttatatatattatataaatatatatttatataaattatataaatatatatttatataatatatattaatatatgctatttatatataaatatataattaaataaaatagtatacatatttatatatgctatttatatgtaaatatatattatatatgcaaatatataatatatattatatatgcttatatattacatatgctaatataatatataatatatgcatatataatatataatatatatgcatatatagcatatataatacatatgctatttatatataaatatataatatataaatataatatatataatatataaatatataatatataatatataaatatatatataatttatatataaaatatatatataaataaaaatatatataatatataaatatataatacataatatataaatatataatacataatatataaatatatagaagtctaaatatataaatagaaatgtaaaatcatatacatatacatgcatatctatgaatgcatatgtatgtatacatgtgtatgtatgaatatatatgtatgtatgtatataggcctttacatttcttgctagatatattattcctggataatttttttgtgtttttgtgttttaccctacatgtttttattgtatttctaataagttatatcctatgcggaaatctattgacctgttatcctgaatgcagccacctactgaactgattgttgctaaaagtcaactatcttctctttataatatttctaattcatatcattttcatatacttttgcatttgttaggatcttcaaagcaatgttacacaatacttctaaaaccaaggagtatatcctgttcttgactttcaagggaattttataagagtttactattaattatggtgttttctgtaggcaaattcacttatatgacggttctctgtatatttatgaaagcgatatattattttagagtttatgtttaaatatttattttagagtttacttaaagtttaatgtaaaaaaatgagacatgtctttccagaaaaacttaggcataactactgttcacaggttttcacctctttcatctgcttggataagaagaagttggccagagaattcctctgtgggaaaatgccagggctgggtatgcatagtccatgttgcagattcacatatgagaggaaaaaaaaagcactaggtaatttctgccaccatctgtgattgtcgtgaaatagaagaggaattaagaatgtacattttagcaattgtctaaattcttactgtctttcctgctgcaatagtaattcttagctcatttaagattggtaagtggcaaaatgatatcaatacaatgtctaaattaccttggtgcttacaccatattccctagacaaatggagttgatgtattagaattataaccaatagcaggaaaagaaaaatgcctcagctcatctgcacaaaaaaggaacccttttgcatctctattcagaaacttagcagaaagcaccttcacctggggggctcacccctgcgttgcttggccagtggctcatgtcaggctgcacctctttctcagcctgctcgtgtggccccacagacgccgaactcgactcccacctactcctgcccagagtgcagcattcccaccggttccagctggttcgcacacttcccacacttcctgagagggctccagcagctctgtgctgtccacctgcactctgtggtctcggccacagtgccagttactgtgtgggttcgtgctttggtgacaaaggtcaaagattttgagtgatctgcagttaagcagaatttttccataaaccctgttattttgggtgctcattttaaagaagtcaaggtgtttaatgaatgcatgcatcatgtttgaaaggaaatacctttgtctgtgaaaagtattgaagatgtaaatgaaatatttttgctttttccatagaaacaatgtgttttggaacactgttttccatagaaacaatgtttcctggaacgtttttctgcagaaacaatgtttcttggaatgttattttccatagaaacaatgttatactggggttatattcatggtcaagggcaaaataccccaagtttttttggcaaatgattacaagcaacatatttacctaactgttattataactacacacagcatagtataacgttgagcaatacaataacacaaaataatcaggaatgttatttgtcttgagattcccaagagaagatttgtgtaggacaacaggagtggctgttatcacaaaaagctgctgaagatctcctgacagcttctgagctcagaatgagaactcccaggagaaggctctgctagacattcagtccacggaaacaaagacacggactgtagactgagaggaagtgagacactgggacgtatgtcaggggaaaatcaggtctgacatcctaggatatgtgtggcgactataccgccccacgtgccagtttcaataaataccatatgtaaaacacatgtgcagaactaagctccctaagtttgttcattcggggataaagttgaaggacagttgttctatctagtacatacacggtggtaggtaaacttcaaatgatcgggaatgatacgatgatggtatacaacttctcagagggaactcacgccagtcgtaaggtaccaccccctgaaatacacacaccacccagctagttagacgtgtgcgctgtctctgcacaccctgctggtgcattgcctcactgagctgtacctaccgtcgcagctgggcaaggcgtggttccactggtggttcctctcacagacgaggggctcgtcgtcacttagtgtgtaccccgggtcacagctgaaagtcactgtggacctgatgccaaagtctccaccgtggcgatggccgttcacagggatgcccgggtccaggcaggaatccgactcaagcgtcacacctggatgcacagaacgaatgcagtcgatgaggatctttctggttgattgaaaataatagagacccacgccatcaactacgaaatagtctcagaaataataagacctgaaacattatgcaagtgaacccaacaatccatggacataaaagccaatgcatcttcaaacatttgacctcgttttttaaaagagagatttatattgttatgctgtttaccagatattatctacatacaacaaccttgaataattaattaacttctctgaattttacttttcttcttggaaaatcaatgaattgcactaaataaagtctaagacttttcctgttttctatttttcaccaccactctccctgtgtcttatatatgtattaaatatagacatatgtacttctatatttatatattccagttagattttggcagtttaactttcaaataaatgcatacatacacccaaacatatacacatataatgcaattaaaaactgtgctagtgttatttttctaagtttgcattccataaatccatgctattttcaaattttagtttaagtcagccacttgcaagatagctactattagcctttgctaacgatgggaaaaattaatgtgcatgaagtaattatgatcatatcattatgagagtttcttttctcctctcacatttctcatttctctttttagaaaaacatatattttaagagctaaggaaaatgagaataagggaaaagaatatcattgtaatgtttacatatgcgaagaaataaaaaatccttgttattgctgtgtcatcctctcagtaaacatcagaacattagaatgaatatctgaactgtgaattaaaagtcttaaaaatatttctaatttaaagactgtttagtctctaaaggtgatcttcgggatattgtttctgatcattgcatatgttttatttttccaaaatttgagtgctataacttgggcctggccccaatacttttttcttaaactgtttttctaacaaattttctaaacactaacacatgtctattgccctaaacaacagaatgtaactgtccttgctgctgcgcagtatggcaggaaagcctccttccaactctggaggagctttcaatctgccagaggcaacgtggatatcatttggctagaaatctattacctaccacctgctcctccctccctctctctacatacacaccacacacatgcatacacacacacacacacacacacacacacacacacacacacacacattcactttcagaggcattgtttatgacttcttccaggacactcccacagattttatgcattattggctccaaatgaacacatggtacccaatgctgggtgaatgatttttgttgttgttgtttacttttattttaaaacccagtgctgggtgaatgattttttgttgttgttgtttgtttacttttattttaagttcaggggtacatgtgcaggtttgttacattggtaaacttttgtcatgggagtttgttgtacagattatttcctcacccaagtattaagcctagtgcccattagttgtttttcccgatcctctccttcctgctaccctcaaccctctgataggccccagtgtgtgttgttccctctatgtgtccatgtgttttcatcatttagctcccacttataagtgagaacatgcggcgtttggttgcctgttgctgcattagtttgctaaggataatgacatccagctcctagcatcaagatcaaaatcaagacaagaattccctcaaaagaagaagctctgctgaagaaatgcactgatctctaggtttctggggaaaaaaaacagttaactaaataatttcatttcttcaaaaaggtttctgtggtcactaaacaacagtgtatgcactacggcaaaacagtaataggaacgattatcttagaataagtgaggattatatattaatggttttaataagtgaggattatatattaatggttttaataatgaaatttataaaccataaactaaacttttcccacacaaaatttacagtgaaaagagacaaactgcggtagaaataaaaacatcgaattaaaatgttgaattatttacatttcaaactgaataaactcttaaggtcacaattgatgcttagttccaatattatgccataatacttccattcatttttaaataataattgacaccactattgaattttgaaatatgcagacattgttctcgttttcattacaaactgtttgaatggagagtacaggacgggaggactgttgagtggtagaattatgatactacattcgatttccagttcaactgaaactggccatgtaaaagaatcctgaaacaagaaaatggtgagaaagaacatctggaatttggctgggcacggtggctcatgcttgtaatcccagcactttgggaggccgaggtgggtggatcacctgatgtcaggagtttgagaccagcctggccaacctgatgaaaacctgtctctgctaaaaatataaaaattagccaggtgtggtggtgggcacctggaatcccagctacttgggaggctgagtcaggagaaacgcttgaactcaggaggcagaggatgcagtgagccaaggttgtgccgttgcattccagcctgggcgacagagcaagactctgtctcaaaaaaaaaaaaaaaaaaaaaaaaaggaattttgtagcaggtgatttatctccaatggaacaatacatttatgataaactaagaccagtctgtggacacaggtagccaatttaccttgtgggaaaggtagggcaaagtcctaccttctttcccattctgtctcctgcctgacagcacaaagagaaatacagaccaccggactttgttgaaacgacgtgtatattcagagtctgttcccactccttcttacttgaaccttaaagcaacaatgaatttttgatacaaatagttacaaacattactttttttttttcaattggtctttgcaaaataagtgactgaatacatttgctacttaatgaataaagggagttgattactttgcaaataatccgtgtgcagctcatacggaggtacatttgatatgagcagggttctgtatgaatcaacagtctttataaaactcctagtccaaggaaggaatgaacatttcctgagcacatttcatatgccgagcttagagatgtcacttctcacagcctccgagaggtttcaaaatagaggttgaaaagtcacagttgataaagccagtgagccaagaaattaagcaaactggccatgttacattatttactgatattgaaacctgagcctttgcctgcttttctcctctctctcatgtatgcatccatgcgtgtgcctgtgagtgttagcatgcatgggcatgttatatatacctttgcattgcatccagtaccattacatcccgaccactctcctttccttttctgatcatataaaaagtcaccgaatctcagcaaacaattggtgtggtgtgcacgcacatataaaccactaaatatactcctttatcacaatgtttcttccatgaataacatgatatatcaatcacacagtagagtatgtacatttacaagtgatgaatctttcttctgccttcagagatgattaacaagatacttttgacagcattttcaaaaaatgctctaaaattaaatggaaaaccttcatacccttgagaattccatttattttccaatttcttacaaaattatgacaattttaaagtggtgatttaaagatcaacatacaaagcagatgatcattctggagcgagaatgcaatcgctattatatacagacactgtgccacattcctcgtaaagaatggctagactgtcgctggacactaacatatgagatgattcctaagactgagtgcatgaagcagaactgcaattctaggtttgcttttacaaaagcctcaaaaaaatgacttcaacctttgagccacacaattcagaaaggccttctggagtgaatgctgtttacagtagctcacattgccttgtagcaccgctgcaaatataagtcagcctcgagtacctgtggctgtgatttctgcaacacattttgtctgtagagatcattggcatgggcctctatgggcatgaagaagcgtcattaataatttcagaaagcaaggagtgtttataatgtgaaacatgtatgatgaaacagaagagatgagcaatattcctgtttttaagaggcataaagagtttgatataaatcattcttgggtcatggatgaagctggaaaccatcattctcagcaaactatcacaaagacaaaaaaccaaacacctcatgttctcactcataggtgggaattgaacaatgagaacaaatggatccaggaaggggaacatcacacaccagggcctgttgtgcggtggggggaggggggagggatagcattaggagatatacctaatgttaaatgatgagttaatgggtgcaccacatcaacatggcacatgtatacatatgtaactaacctgcacgttgtcacatgtaccctaaaacttaaagtataataaaaaaataaaataaataaaaattggatgacattttcacttgaaaaaaaataataattcttgggtcacaggcaacccactttcaaagaatgtgttggatgagtgagtgtaatcattttctagtgcctgcatcttggcttcagaacctattttgtcgaagggtgctagacggggttacctggatgaaggggttggtagcatttttctcttccacgctttgccactttttctctgtctctgcttttctcgctggactcattggttcctttaaccctccgtgacctctgctggccttggccccttccctcctgcttgcctgtgggttttctctctccctggagcccgggatctgcgtctgccttcaccttattcagaatcacctcgaggacttgattaaaagctcaggattctgattttcatcatgagttccctgaatcacaatatttggaatctgggcttggggctgtacaatttactaagctcccagggatgtgttagtgcactatgatgtttgaagaaaccttccccttcagcaccgggtaaacggggacaccctctgagtgggttgcgagcctctgaaagcactcatatctctacaccacccacagaaatagcaaccagaacatctgagctggtattcaggcattggttttattttaaaccccgcaggtaacccttaggtgcagggctggtgataagcactcataaaatcccaggcctttcctgactcattttcttacaacaagcaaacaaaaagccatgtcctgaacctcattcacttatgtacatttccatatgtctcttcaaatacacagcgactgatacataaataagaagtgatcccaagtcaaggttcagtatcacatccttctgaggtcctatttctcccttaagtcagaggaataggtgacaaacctttgagagccttctggaagttcactatatgcaagtctagatgtgtgtttagagcagtgagcctttgaagtcacagtgctggaaagttccaaacgcaacaatttcctgtcttcactcactaggtgaggcctctgctcacttctgtggctatacagctacctcctgagacttccaacaaggtggaaagaagagggaatgctagactctccagcagatcagaactttatgactctcacacaattatcactgtataaacaggcatcatcttggtgacagttttcttcttctttttagggatggagagaaagaaaaatggcatttttttcatgtgtctgttggctgcataaatgtcttcttttgagaagtgtctgttcatatccttcacccactttcacaatagcaaagacttggaaacaacccaaatgcctaaaaatgatagactggattgagaaaatatggcacatatacacaatggaatagtatgcaaccataaaaattgatgagttcatgtcttttgtagggacatggatgaagctggaaaccatcattctcagcaaactatggcaaagacaaaaaaccaaacaccacatgttctcactcataggtgggaattgaacaatgagaacacatggacacaggaaggggaacatcacactctggggcctgttgtggggtgtggggagggggcagggatagcattaggagatatacctaatgtaaatgacgagttaatgggtgcagcacaccaacatggcacatgtatacatatgtaacaaacctgcacgttgtgcacatgtaccctagaacttaacgtataataataataataataaaaaaataaattatatatatatatatatatatatatatatatatatatatatatagaaaaaaagaaaaatggcaaagagctttactctctgaggggtactccaggtgatggaagaatgccttacgaagcctgccctctacttttaaacacaggataaatgaaaagaataccaaaacatagggtagtcattcttttaagattataaaaatagttgtcaggattacttacatattaaattattatattatagtataatataatgtgtattccatattttataataataaaatattattattataatattagtgaggatgacaagctaaatagaaatttatgaaatgactttttatcatttcctgattttccagaaagagaaataagaagaagacatttatttaaatgacttggataaacaaatgaaattagtttcttctgccttcacttagcctttggaacacattccctcaaatggaagtagaaaaagcaaagtcatctacagctacagaaatacagatgaaaagaaaggaaaagtgttctaatatttgtcaatgcctgaaaataattattctctgaagtttcatgcactatatatctaagagtcaagaaattctggtgtagaaaaagttggggggaggggtgtgggagaggatgagaaaatacaaggcttattagggatcttacaaattcagatcactgcaatgtttacacatattgttacttcaaagagaagtgacaactcgaatggacattttaaagaaacaaaatgtaaaatttcctggttcttaaattttactttaagtttcaaaatacgttactttggagcaaatgttgtatatctatatatgtgaagagtaataactgaattaaatttgaaatttgtcattaagtcattgataagcaattttcctgatattggaatatttttatctaaaagtagacaaaatcttaagatatacatgcatatgcacgtttgtgtatacttatatgagtatgtaaaaccgaggaatgcacataacaggttgttaatttaaatgtgctggagtggggctcagggagagggtaacaagagtaataggaggtgatgtggggaatggaaggcaagaaaacgaacaaaaggagatttgaaacccatcatagtagacatgattctatgcatgcatttgtaaaatcatacgtgtgggtatatgtaaattttaaaaacatctttacaatagtacttgagataaagctctgaaaaagaacagccataaaactttggcaaaataaaagtctgattccttcaggtccaatagtaattgccactttttctcgctttttccgtgctactctttgagggaagtgttttcaaacagagaaaagaataacagctgctttgctttgttttgttttaattggctaatgttaaaaatgtattcctaggggtgattcccatcagctagatttcagaagtatatttgcataaatattattataaaataatacaattacttaatctcatcatttcagaagctaaaactttgatttcagtaaacaagggcaggaaaactttccatgtggaagtttggactgtttgcaaaatacattccattataatattttgacaattgttttaaaatatgtttaataattgttttaaagtattattcatgcttgttgaaagactgttaacaattgtttggaatttggtaaggtttagcaggttttaattccttcgcctcttgttacctgactttcacccagtgaaacgtgtctatctatactcagattcggtaccacaaattgacctaaccctgtttttctagcaaggatccttttctccattgcccaggttaacataattttagtaatatatcctataagacttttgctcagaaagtacattttctaataatagaagtatattattacttccattattctatgcagaagatgaacccatttcattgtttttattattttactttgtcatacgcgatggatacgtatttttgagagttaaaaggcagtaattccaagatgctctcttatgaataacagaaagttcttacaattgcatagtatggttttgctagagtcaagcaggatcagtaaactagcacagtcatctgcaggctggaaataagaacccagatctttagttctcccatgcatgctgccctgccgggctgtcaagggaaggtgcaactcactctcatagtggatgaggaagccgatgctggagcggctgttgtcagtggtgaacagcaggtacatgaagttcccggtgctgatgaggaactggggtgcctgggtgccgtggtactcgccgatcagtggggacgaactggctggcccatctctgacctccaaggtgtcataattgacctctgtctgaaatctgcaaatatatacatcccatcagaaaagacatgcagaactgccagcttacagacgtgctcctgacatcctcattccttaatcagaaacccatgtacgttaacatgaagaaaatagttgaaattacatatgcttaaaacttgggtacaaatataaggatagtatgttcttttcttgatgagacggcacagcttaaatccctttctcttatctaatattctgtcttacaatattacagacacaagaggaggcctttattcagcttaaacaaaaatactatgaaccagattagttttcttagatgatagattgatagatagatagatagacaaatagattattcccaaatagaaaaaactcaattatatatttttaaactatttttaccattccctatttaacataattatagacatcttaaaatgggtgcactagagtgaaatcatctcttaaacaaagaagatcattaaaaatgtgtgatgagtttaaacacctttcctgaaaaaaaaaatcctgtgcctttttaaattgcaataactctttcaagacattagaacaaccatgggtatgttgccatttcagacatgaaaggatactttaataacttgagaaagttacaacagcttccaaaaactgcttaagttttcttatgcttcccgagaatctagcctgagattttatatatatatataaagttgcagccacttggctcccctgtgatgcaatgtaggtaccactccaggcacggagataattttctaagtgggcctatctgatcctcgaagagctaacccggtttctgagtgcctgacttggctctcagggagcagcttaagcgtcataagactctgactcactcagtcactttgagccaaaggatcccacggaagcctgtgccattagctctgtgctggatgttgctgatgaattgggagaaaacttgggagaggggaagcaatcttagcctcatggcgtgtagcaacagaaaacgatgttgaaaccaaagggctgtgtcctgtatacattagatcatggatacactgattagtgcaaatgcacatgattacctattcctgcaactagtgaatgtggtaccctgggccccattcttccataaagaggaatttgaaccatttgtatatcacacatctggaccagaataaggccacaggctgccacatttgggattgcatagtgccaactttgtcttatgacactattctaaatctttttcttaaaactgatttctcagttgtttgagttcaaattcaagaagtctggctaagcgtgaaagcaatctcctttgacatagtcatgctgaagttgtcctatcctgtttctttagtaacagtgaggactgacaaagtgcctatttcaacagctggaagatttccaggatgacgttggaaacagaaacatctggatgttctttgctgttgggcagcctaacacacaccgcctggcaataccatcagcacagagctcagaatttgtgcgcacaatcccatcctttaaggtgtcagcccatcggtcatggtggaaatgaacatttccttatgcaattcatcttttaagagctgtgtactatgtctagagtacagatcacacatgtctaaaaatatcagaaatatcgggtatttccaaatggaatttagcaaaacatcacactgaaacaatactgaatgaatgagattgggaaaaatcaagcaaatatcttccttcaggcaactgaaaatagagggctaatagactggccagagaagaatataggatcactacttttactaaattacttaaatttgatacgctgctgggagtcagggcgtgcttcagctccgcctgccaataccagtaagtggagaaattagtaagaaacccaacgtaatcaactgaatacttacagagttagtattttttcaaatgattgattatacacagtaattcactttctaatatagatggatttataaacaacttttttctcttgttctaagagattgtgctattggggattattattattttgtcagaagcaagtgaaaaaataaaaataattatttcaaataaatacaattactgaaagttaacacaactcctgctgaaaaacctttcctgtgttgatgttagcattgatcatttgaaaacaaaaagataataatacaatgaagttcatctatcttgagacaccataatattccggatactgaaatccagaatgtagtctagtcaagaagaaggtcattgttagagaaagcccaatgttatgcagagaataaccttgaaactttcaacaaagatgcctccctagcctttggttcatgttgctcatgacaaaatctttttagtttttaatcatcaatttggtctcagtgttgagagaaatgggaaaacccttcttatatagaactccaatagcctgcttattttttaataaacaaatacctacgcagcccagcatgcttattttttagatcatgaaatgcattattaaatagctaagccaagcaacattctagtgataatgtcactcataggcgattagttggtgattgatctgctgtccgcaccccattgcccgctcagcatcactagctgccctcgagtgaccagcagccaccaccagaacaggagagctgatttcctctaccacagaagacacctaagggaccatgggacccagagtggtttccatgtgcaatcagacatcaagctgaattgattccagtgcaggtcccaaacccagagtcagatacaagggtcggacctcgggaatggtcctccaggactggcagttcccctactaacctccagagcattggctcactgtgggcttagaggataccactgaagaagaacaaaacttacaagtaagtgcctgtttctggtaaagtgtgctcctatgcgggaaccgaaaaaaactgccatctttttaaagtttaagatccatttactaaaactatggaagagacacacaccattgggtccaaatgaagactaatttttttcttacctgtcaaaagttattttgatagagtggcctggttttgcttcaattatccattcacaatgtaaagaatccttataatatcctggccatccaggaggcaaaatgactccgctggacgctgtcagatgtccaccacatggagctaaaacaagacgtagaatatctattagatccaatgagacagaaggatatgccataacaatacccggataaaagccagaatctgcttctgtgttcatagactgaatattttcaagtatcaaagcaaatcttattcccaaggaaactgtacatttattgaaagcagggtctatatatgctacctccatgtacttaccattaccttgaagcaaagttctttttctctagtaatggtaatgtatacgtgagttctctgtgctaactgaattatctcatttaactgctaaccatttcattacgtacatgcccggttatctatagtttacatgcatttggaatttaacaattatctatacataagcaaatgtaaaatgaccttacatctcaagatggatacatatacacacccttaggtgtgtgtatgcatgtgtttatttacttccattgtgtgcattttattaaaataaatagccacatgcaacatattatttgtgagtgtgaaacaaaacaaaatgttcaatcaaatttgataagtgtagaattagactgcattgaaccttttgcaaggttttgtgacagtgatttgtaattgcaaaggagaaataaagtttgaaagggtatataattactgctcagtgaaagtgattatgcatacctgtatcatctaaaggaattttaaatagcataccaatatttcataccgtaattaagaatatgtccctggccacatgttttctttcagattttatgtattctctctcaaaattatttgccattagcaatcatctttgtggatttatagatatcaaataaagtacgtgaaaatactccaaggtgaaaaaatccttttggaaaaaatatttattttatttaaaaatggccatatgtataatgtaaaaatgcaaaaagtttatatcattttagccatgttttgatgctagaaaaaatgtgaattagtgaaatttatggatttaccaatagtatcttaatttacgtcaggaaacaaatacagaaaaaataaaagcaaaaatttatggaaactgcatgaccatatattggaatgtggcaaatatatttgaagtaacgtttggaaattttgttgatatgggaaaatctttgcaatagaatgttaaacttgaaaagtggataaaaaattgtccatctgttataaatgtaataaaagaaaaattttattcagtgaacacggcagtggaaattaaaaacatgttaataatggatagcactgggattgctttatagatcatattttttgatatattatatatatatatttttcccaaataagttgcaattgttatttttatacctatgcattattctgtagtttaaaaatatgaaagcagggtaatttttattaacttgagctcctgaagaacacttgattttttgtgataatttttaaaacaaccaaaattatacttattaatattttaatttttcttgttaatttcttaaattcacatttgcagcctatgaatcacatatcgatatacataattatatgtaattcaattcttttgttttttaaagcaatgcaacacattcttttatgaatacaacataagcaaaattaaatatgttaaatatataacttttattttgtcatgtttaaccatccaaagatactatataagaaagacatatggcagatgcagaattccaaaaaaattatgatagttgagcaatttctaaaatctgcatgataagttatttctatgtgtgaatttccatataaatacataaccaaccaaaagtttcctttactttagtaattttattttgcatttttatgtttcttggaatatgtctaacttgccaaatattaattattttattatactcttacccatcactttgtaatttacagtgtatgttagaacctgaattgctttatcctgatgaaatagacactttaataataacactgccgatgagcaaaatttacactaaaataataatgatctcagtaagtagattgtaagtaagtaaatagtaagtaataagtttgtattagtcagtttggattagattacactgccgtaactaacagccctgcaactgtagtagctacagttggaagtgaatttctcacaaatgtggcatgtctaggtctgtgagacacaggtcccttcttcagttgctatggcaggtggaaaaaggtcttaggaaagcaatcaaagacgctgacccagaagttgagtacagcatttcctcatatacctaattgaccagaacccatgacaaggttcctttaatctacaagattcaagaaaagacattccacctgatggagaccaaaaatatttgatgaacatcatcaatcatgttcatactcacttagctgataacaaaaaaagcaaatataccaatgagccaatgaggtgtttagaaagcaatttcttctttgctttttttttttgatgatttaaattacagtgatgaattccctgatactgtatttctaaaatacacacacacacatacaccccttcttgattacatatgtgtattttcctatggctttatttttattagaacaatctcattggggttacattaatgctggcttgatgaaatgttatgaaggatgcagcctgtcttctccattatctgtgatagtgcacaacactaaggttctctagacttgaaagagaactcactcacacccctgtagggtacttgtgtctttttcaatgttcaatccttaatcttttttttcaattcttttctatgctactttacgcacattttatactttttatgtgagtcatttttggtattttatcttttgctaaaaaaatcacccgttttctacagactttaagctttgctgccacagagttggtgttttcatgtatagtcatttttccccaaaatagcttgagattttcatgatgccactgagctgcattgaggaatacgagcctgttagaagcagaagaaagagagaaagagaaaccttttgcccggaggccataaaatttatactcaacatgtgcctggcatccagaaaattctgccagaataaataaataacctacgcttttaaataaaaaaattgctctattgtgagcttttcactgtttacgtaaagttatattatttttatggtatggataatttctcttttatgttaccaaatatctataacatttttctttcctagttctttttatcagaatcataaacagtttgtctattttattgatattaacaactcactcttgctttaaattgtttataacacttgaattttattaataggatcctaatttatttttgttttttctaactttttaatcttattattaaatttctttattttttgatcattttgttctacgttagaggacttaaagatagacattttccttgaaacacaggttttgctgtctcacattgtttctcatagaaagtactgttctaatggtttccagatgggatagtataggcattaaggtttgagtttctctttaatgtaaaattatagtggactttttatggatagacatttgcttgtagttctatttttattacatgtttctactttaattggaatattacagggcatgagacctataacttattttaatttgttaaggttcactttgtggtcagttatataattgatttaaacaaaacacttttcaagaaaaacaataaataagagtattctgtaagggatgtgagcttcttcaaacatttcttaaatcaagtttgttatctgtattactcactgcttcattgctattttatttttttccctactagatgcatttacttctgaaagttggctttctatttgttttcagcagaggcagtgatcggggtacccgcctgttccatcggagcgtcccctaccttctctgaggctcagctgcactcagtcattaggtttctcaacgcaggtagacttttaacatcttttcctattaactttttctttctgccgagggcttcctttgttaacaacctatagctgggttttgcctttaacctcatcctgtttgtgctgtggtccacactcaccctgcaggttgtaacatatctgcaatcagcctattatggtaaaggacataaggcacagcttgacttgtggccaggacagaacagagatgagagtgtagtgttcactttaaacttctttctcctgaaaattcatgcttccaagtcagtgaaatatgcttggctagaatacgatttgcacctgtgactaactgtgccctatcattagtatcatatctttgagcaccacatgtgtatatatttactcatttataaaagatgaaaacctacccatttattaacattttgtacagcataaaacataaaaactgtacatttaccatatgtgatggaaatacatacaaatgaaatttcagctattaagagggttttgttgcccttctatttatcaatatttcacccatgggtggtgcttcttgtccacccacaaattgttttaacaatgtatgaaaagggtgaacatcagaataccctcctttacgtgtagtattaccagacgatactataaacaggacctggttagaagtttctacttctcctctgaggtcaggagtttgagaccagcctggccaacatgttgaaacgtcccctctactaaaaatacaaaaattagccaggcgtggtggcaggtgtctgtagtcccagttactcaggaaggctgaggcagaagaactgcttgaatctgggaggcggaggttgcagtgagctgagattgcaccactgcactccagcctgggtgacagagccagacgctatctcaaaaaaaaaaaaaaaaaaaaaattgcgtttctactttgagtaatggtgagtaacttctttggaggtgggaccagggcaggatgaggtggtgaaggatcatgcccccaccatactgtggttgtcatggaggagtttaatgctccacacctagaccccagctctgcttagagtccttgatagagatgatgggtctgagaatgttattccgaggtattttagatagggcagaaattctcaactgtttatgatatttaacatatattcctgttctattcacttattaaaaataaatacatgttgactaaagacaactgagaaaataaaaataaactaagagggaaaaatcacccataaccataattaacattttggtgtgtagcctttttttagtgttttacaaagttattatcatgagatatgtatgtatttatgacacatgtgcctgcatcctctgtttttcacatgctaaggacacctgagacgctttgagcttatgatctttgtattgatacctgttattcttcatgatttatctaatcagtcctctgctgtttgaagctgaatcatttccaactcttcactgctataaatagtcttgcagaaaacattcttgaaaaaaacctgtatagttgcttatttctttatgatattgatccaggaatataacttatgactcaaaggacaagaataattttaagagtcctactaagaatttacactacaataccatgattttatataatcaatagtatgattaggaaatgccagtttctacataaccttttcaataatacgtctcattcacctgtttaaatctatgctaacaagatagacaaaaatgatattttacttttcttcttaaatttgtacttctttgatatacactagaggtaagtttttaagttttttaaaaatattttcttagcttattgcgcactgactattctgatatggactgtgaacatatactctaagtaaacatttttaaaatgagtaattattagaggcaacatctttttccttaaaatattttcctctctatatttattagataagtaaccagaacagaaatatgaagaagaaaattaggtggtatttatgtcggctgtaacaagaacaacaaaatagttaaccataagcaacactgttataggttgaattctgtccccccaaaaaatcatacattgaggtcctaaccctcagcgcctcagatggtgactgtatttgaagattgggtacttgcagatgaatttagttaggataaggtgttgctggaagaaggggacccccaatccaatatgattgtgtccttttaacaaggagaatttagacacagggacagacacacacacagggagagctccttttgagtctggaggcagagatgagggtgaggcttctccagccatggaatgccagagattgccaaacaccgccaggagctggaggaccagcctgaggcagatcctccctcagagttccagaaggaccccaccctgccgatgacacctggatctcagacttccagcctccagaactgggagactgtacactcctgttggttaagtgactgtgtgtggtattttgttagggcagccctagcaagctaacacagtttgttggtttgtgtgtgtgcctgaagatagatgtgtgatttcaaaggagaagagcggggggtggcagggactgcaccttcacagcggggcacggtggagctccagaccacgttcccgtcttgcagtatgcaggtaatggactcggatccctgggtcttgacaaagccatcatcacagtggaaagaaaccgagctcccgagtagaaacctgtcaccaaaacgtcgtccgtttataggaatgccaggatcatggcactcattctgaccaaatgctgaaagaaaaagaagaagaaaaaaggaataaaaatacttgagtattaattacatgtattaaaaaagaagaaaacagaacaagcttataaagcattcatataatgtatataattatataaatttcagttgtatcattcatagatagataatacattaataaataggatatcagtgtctagtgagaaagagcgagcagggagatgaacaaatataactatcatttatgcagcaatttagggtttgaaaagcacttttcataggagcttagacaaagagagaactgatatggtgggtggtagaaagtgtctgggctcaagatttctctcgttagaatcctgactttttttcttactatgtcagaggactctgacattgggcatatgactctgacgctctaagcctagctatctttatttacagaatgagagactactaaatttatatcctctagttactataacactaaatgaaacaattattgtccaattctaagtattctgcctaagaaactaggcagttagcatatcataatgtagtattactcatattaatattctctcactttattccatctacagtgcatttaagtagatattcttacataaaataggttttaaaatgaggagcctaaagcaaagagaatgagctgtcattaaacttcactaattacatactagtgctgtattttaatccttggctcctgacatcatattacacagttgtttttactacactactttgttgcaagaaagatgcataagtggctgagtgggtgggtggatggttgtatagatgggaggaagaatagaaggaagaaaggaagaatggctggctggctggatgaatggagggatggaaagaaagatgaatggagggatggatggaaagatgaatggaaggatggatggatgaatgcatgcatgcatggatggatggacagatggaaggatggataatggaaggatatggatgaatggatggatgggtgaaataatagataaatggacaaaacgatggaagggaaggatgaatggaaggatatggattgatagatggatggaaggataaaaggaatgatagacggaataatggatgaatggatggacacatggatgaatgatgaatggatggatggaaagatggataaacaatggattgatggaacgatggatggatggaaggatgaatggatggaaggatggatggatagatggaaggatggatggaaagatggatggaagaaaggatggatagatgcatggatggatgaaatgatggatggatgaatgaaaggatacagatggacagatggatggatgaatggaagaatagatggaataatggtttggtgggtgcatggatggatagaatgatggatggatgaatggatggatggataaatggaaaaccggagagaaagagatgtaaggagatgaaagagagaggagatccagcttcttagtttaggagtgatgaagccacctatctaaatacagtgatacatttgtttttaagttttcaggataacactataattttactactgtcattttcataatgattataaaacctctgaagtatcaaccttgaaatgcaacttcacatacatataagcaaaatgggaacatgtaagtaaaatgagaacttggatgtgttgactgtgtgggcgtacttactggtgtaagtgatgttgaaccctctgccagtagtggaatggtcagactgaaattccaagcgaactatatgcccactgctggccagctgggaaggcacttcattgccagaaaaagtacccaggacagttatgtcagaaatgccatcatccttgaccgcgagaaagtcaaactgaggctcaacatcaaaatcattaaagattaggtgaattcgacttcctggctccgagataatcaaccagacacagttcatgttgttcccatattcctctggataatttggtgacagaataatcccagatgatgccgtaaagttgaagaaacatgaaactgtgaagatgcaaatatattttcaaacagttatgcacatatccaaagaattgccatgtgaaacagacagctaagaacctggaaaggcaattcatgcctgcaaatagctatgatgatccaactattttaatataagtaattctggaccataatgttttctcctttcctaatttgtaagtcgaatatttcattatcatatagagcacaaccagaacctatacataatcaagcacaagcgtggttcaaaaatgatcctttccagttgactgaaaacgtgtgccaaatattataatttctagttataattttctgccttcagaagagcaaatattaatatggaaaagtatattcctatatcataggaacaattcagcctgctctttcataacttttaaatttatattttatactttcctgtgagtgcattttctccagtaatttaaaatttttattagttacagggtaaacatgaataaataaataacttggaaacatcagatcatgttctagttggataatataaagtattttgaaaaatttacttttaagaatgtgtacttaaaatcatatatattatataaataattttttggagggagaaactgttggatttatctctagaatacatttttgcttcttattccatataattttgtacacacttttcagcctttgctatagttatttacaaataaaaaaaacctctcctttaaaatcgactgtgaagccttttctacttgttaaaatagtattcttaagaggaagtgggcagctcatcaactgaattccaaaccaataccaccacccatgctcgcactggtgaacaacttgtgtttaagtgttatacagcattattaagtcacaaaggactctgttgctgtactgatgtctgatacagcagatcatcactggcttttgatggaaacaacgatatatgtgatgaccctttctggtaggaaacgttcaagtacattttgtcgagtagatgtaatgaaactataaattagtttttactaaatgaagaaagcaggcaagttggtgttcgagaacgtccttgcacgtttccagtaaatgtggcaccccgagccattctgaaagctgccctccctaaatgggcggtctgtgtctttctccttttctccccttgcaagatccttgcaggacaggagggagtccaggtcaaggcataatactcacatacacagctgggcttgttgccagaccactgattgttctgctgacaggtgataactctctccccccaccagctcaaaggccgccgggcattcaaaggtgagtgtatctccatggaggaaactgctgcccgtccgcttcccataggcggggattccaggatccccacaccctcccttttcaatttctgaaaatggaaaaacaaatgaacccttaaaaaaacacacacaaggaatatttttatctctacaacttagaaagtaaatacgtggcttctttttgctgaactaaacatcatttttgtaaagtgtttctaaaggatattcaattgatcttaaatttaatttcaaataccagaaaaagaatgtcatttcaaatgaagggaaaggtatttaatttgctatcttttaagggatacacgtggctacacagatacgctgacaacacaaatgctgcaattaatcggtgcatcttctggatacctccgatcttttatctgcaattgctactactaaaatgcaaataccagtttaattttcaactatgtgctttttgctataaacaatacaaataatattcttcattccctactgagtatttaaataaatagaatctatttgaatattctttccctaaaatgaatgttaacactcacttatgaagcagaatgaataacagtttggtctacagaggaaaacaaaatattcagaatcaatctttcattaaaacatcactgtaataacatatgcgtccaaatacaccaaacctatatttcaaatgttgatctgtctcaaatgttaactacacagaatgttttcattaaaatattttatttatttattcatttaaaagactatttttgagagccactgtgtgtcaggtcctgttctaggtaagggcttagtgaataaatgagacaaaatcctcgcacacatggggctggatatgatttggctgtgtccccacctaattctcattttgaatcccacgtgttgtggcagggatctggtgggaggtaattgatcatgggggcaggtctttcctgtgctgttctcaggatagtgaataaggctcaggaggtctgatggttttctaagggggagttgccctgcacaagctttctctttgcctgctgccatcatgtaagacgtgacttgttccaccttgccttcgccatgattgtgaggcctctccagccatgtggaactgtaagtccattaaacctttttcttttataaattgcccagtcttgggtatgtctttatcagcagtgtaaaaacagactaatacaggggttatgttttatggaggaaaattttttaaaattattatttttttgagacaggatctcactctgttgtccaggccggagtgcagtgatgtgatcatagctcactgcaacttccaactctggggctcgagtgatcctcccacctgagactcccaaaaattaatgtgatttgatgatgggtaatttaacacaagatagaggggtatagagagatggatggaggaggaggcagtgaagaaaatgccctgaaggaagatggcaatcagcccttcgaaaaggagatgtgatcccagtgtgccgggcagggcagtgagggacaaatgggcagaggtggtttggagcagaagggaggccctgcctgttgggcttcctgtttgtgcagagtgatgcaggaagaaggcactgcagagctttggaggagacctggtgtcatctgactacagacttaaaagatctctctgcaactttggaagagcagaggcaggtgaaaagtgagtcccaggaaattcagggtggtttctctggacaccagtcccaaaagtgcattggttttacttttagaattcttcatgggcttgcactttattatcttgcaggggccaagagcaaattctttgtggggtattttttagtaacctaactacttcctttccttttctttatttccataggttttggggggaacccaagcagtatatgctgcgttcattttgtagtcttctattcctcatccccttcacaccctttccccgagtccccaaggtccattttatcattcttatgcctttgcatcctcatagcttagctcccacttatgagtgagaacatatgatgtttggctttgcattcctgggttacttcacttagaataatagtctccaatctcatccaggttgctgcgaatgccattaattcattccttattatcgttcagtagtagtccatcatatatatatatacgtgtatatatacgtgtatatatacacacgtatatatacacgtatatatacacgtacatatatacacgtgtatatatacacgtgtatatacgtgtatatacgtgtgtatatacctgtatatatacacgtatatatacacgtatatatacgtgtatatgtatatatgcacgtatatatgcacgtatatatgcacgtatatatgcacgtatatatacacgtatatatgcacgtatatatacacgtatatatgcacgtatatatacacgtatatatgcacgtatatatacacgtatatatgcacgtatatatacacgtatatatacgtgtatatacacgtatatatatacatatacacacgtatatatacacatatatacacgtatatatacacacgtatatatacatatatacatatatatacacacgtatatatacatatatacatatatacacacgtatatatacatatatacatatatatacacacgtatatatacatatatacatatatatacacacatatacatacatacacacacacacaccactgtttctttatccactcattgattgatgggcatttgggttggttccacatttttgcaattgcaaattgtgctgctataaatatgtgtgtgcaagtatctttttcataacctaaccactttctaatcaagctgtcagttttggcaatgtttgtagaagtgactcagaactgaatttccagatggtttgaaggtctgctgtgagggatatagaaacgttcagaggttgatccagagatgttatattgcattcaagaggagaaactttacttctaagtgtctgggaatatcaaagaagtgaagtttgatacattatcacactagcatgaagatgttgaatacataggatatcaccaacttctgtgaagcagaagagcacacacacaaaatgcagatatttggttgaggttcaaggtacactgctaacgtcacacctcaggctaccaaacaaagatgatccttacagagtcagctctacgaaagcaaaatgttcctaatgcaacacaagccaaatacatctatagagaacacctttgcttaaagatagttcttggagtttaggttgttgaacagagatgggaatggatttacttaaatttaatgcttgggatgccttgaatgagcgtctgtcactgaaaccgacagtgagttcaaaacgctgcatggtttataatagaaaagagctcttgtttgttgtgggctctccattgggaagctgggctgggcgcccagggtcctggcatagcacaaatctgtgcagtcaggagtccagacaccacatttggttttgaatcccccagtgtttgctgggccactgtgatcaatttagtctcatcaagcctcagttttcacattatgagcttcctacttcctacctcaaagggtggccatgagaattaaagaataagattcatggaaattacctggtatattgcactggaaatacaattattactatgattattagcaagccttaaatgtttcattctgcctctgtgatactaaagtttacaatttctccttagagtaaaataaattatggcattttggggatactatttttaatattaattaactcagggagctctactgtgcagaggtttcagaaattaaatgagggtgagggtctttctgctttccatgctgaggatcaagagagacctgtggttagctgatcccaccaaagaggctgatgtttgtttatcctgatgcatggctacggctggccgtggacagaacctgtgttggacaagtcccttatcaggcattaggggttgacaagtaactgtcaaagtagcacggtccaaactcagtaggtttgtgtgtttcacctagcttttgtcctttagttatagaagaaatgtaagcatgtttcatgattatgccagcgatgtttcatttgggggaactatcttggaatattttgcattcttgacttcttacacactgagtgtcactactgcctccaaattatggtgacaaaattcacacaagttttgcaattttatttgaggttcatatcaccttcaggtagagtagaagatgagtaagatactgttgacaatgatacagtatgtgtgtcaaacccccttctctctatgtcagagacgattttaacacattttcttagaaacaaacactacagccagatgcggtagctcacgcctgtaatcctagcactttggaaggccgaggtgggatgatcacttgagatcatgagttggagaccagcctggccaacatcatgaaaccctatctctactaaaaatacaaaaattagccgggaatggtggtgcacgcctggaatcccaactactggggaggctgaagcaggagaattacttgaaaccaggaggtggacgttgcagtgagccaagatcgcgacactgcagtccagcctgtgtgacagagcgagactccgttaaagaaaagaaaaaaaaaaaaaaaagaagcaaacactatgatttggtatcaattcaaagactgatgcacctaaagcaaaaaaaaaaaaaaaaaaaaaaaaaaatgctgtacaaactatctcttccaaattattgaactagatataagatttgataatgaaggggcctacggaaaatattgtttaaggatcattccgaagagcttacatagtccagttacaaatactgtcacacctccctctcttccccaaaatacatcacacagaaattttctctgttgctctagctatattcccaaacatgccatgttgtgcctcagttcaggttctcacccctcactgtctatcatcatttgccatcattgacgctcttggggtcctctcatcgctccccatgctgcatcccattttctgtgttgcagccaaactattttctcaaactccagtgctaaggataaccgtaccttgcttgaaatttttctggtgaccaactttgttcttagtccagatcctatccaggactcaggaaccatgtgtgatgtgaacatcgctgttttctcctaggacatatctcgttagttctttcccggtgtttcacaatccagacttgctacaatttcttttagtgcctgagggtgtctcccctcttcagccttcacacctgctgtaaatatttagtccattctttcctctgttgtcttatttaaccatgcactgttgatattctaattcagtctgcgcttgctcggggatggcctgtatcctacgtgtctctagcaccactctcttttctgcggcaagacctgtcactctgcattatatgtactttttgtgctttactgtaagccctggcagggtctatcttggtgattgttaaatctgtagcacctgttcagagtcaacacacaacagatgcttttctaaattattgttcttattaaacttgcaatttaatgatttttattcgcactcacatttacatactaaattgtattttaattgacaaatttaaattgtatatattgttcatctacagcatgttattttgaaatatgtgtacgtatcataatggctaagcaaagctaattaatatactaattaccttacatacttctgatttttttcttgagaacacctatactcttagcaattttcaagaatataatacattattattaaccatagtaccatgttgtataagagatcccttgaacttatttacatgttgcatttatttatttgaaatggagcctcgctctgtcacccaggctggagtgcagtggcacgatctcagctcactgtaacctctacctcccggattcaagagattctcttggctcagcctcctgcatatctgggattatacgcatgcatcatcacgcccaggtaatttttgtattttttagcagcgatggagtttcaccatgttggccacgctggtctccaactcctggcctcaagtgatctgccctcctctagcctcccaacaggctgcgattacaggcgtgagccattgtgcctggccttgtatgtcacatttataggtgtgtgtgtattatatgttgtatttatatgaagattttatatattctggagaatctgatgaagctcagtccctttttattctttatttcagactgagatctggaaaaatggaaaagtatacaagtaataaatggaagacaaaacttctttattggtaaaatggatctatgttgtttagaaacatatccccaagttttcatgagaataagtgagattttttaaattgccaaagaagattttgagttgcatatgatatttaatttttggcacttacaatgagtagccactagctacagtgacttttcacacttgtcaattctttttaaaaataagtgttcttggctgggcgcggcggctcacacctgtaatcctagcactttgggaggcggagacaggtggatcatgaggtcaggagatcgagaccatcctggataacatggtgaaaccccgtctctactaaaaatacaaaaaattagccgggcgtgttggggggcgcctgtaattcccagctactcgggaggctgaggcaggagaatggtgtgaacctagtaggctggagcttgcagtgaaccgggactgcgcaactgcactccagcctgagccacagagccagactccgtctcaaaaaaaaaaaaaaaaaaaaaaaagtgttctttagatatagtttagaaaactggccctttaacaaaacaaataacagaggaccaaacactacaagagaaatagagaaaaagaactctgaaggtagaaataaatgaatgtggactatgatggatttttaaacatccaatttccacataagaatgtattcggtgtatacttgaatttcaaaaagagctaagaaggcagaaaggaatgagacataactgtgccgtcagaagcatagttagcacgcttgcttgtttccttttgtgtagtcaaccatgggtgtcccaggagctacatggaaacacgtccagggagttgcctggtcctttagattctgctgtggccacatcccctgctaacaccatttctcatgttgatggcatgtcaggcaaggcagcactgtacatggacacaagacagctagtacagaactcactgagcctacactgctgtgtgttctttgttctctgtgacctgtctccacaagtagatgagaactccatgaatgacagctttatcaggttctttctcttcccttccaaaaccacttatgaaagttctttgtataaaaccgctcaatgaataaaactaaattctaaaattaggttcacccatagtcatgtatatgaacagcaatttctctaaatctcaatagatgactattggattatataagctgatatccctgaattttagtgagaatgatttaccaagagtttaaatcacaccacgttctgctcccacggttgtgcttgcattaccaaatttattctggatggggtaatacaatttctgtttgacatatgaaatatagcaggttgctgcagtctttgttaccatgaagagttgagattcttcaagttatcacaaaatagatgtactatgatgatgttccataaataagagggacctttaaattccatacggtttgctactggattgcaattaatattctgcagaaaacactctgctgtagctgttcaggaaatatttcttaaaaatagtggaaaacatttagatttcagacagctaactttttatctcccaaaatagcagaccaaaactcttattgcctgtgtaagatatttacacaacttcttatatgcttattcgtatgaaagcaatgttgtctagcttgtatgtctgccttttttctcatgtgctatttgactaccatctgtattctgaacttaaggcttaaaaactttaatcacaaactagaatagataaggtgtgttccagggctgccatagctactacatgcgggaagtgttaatgaacagattaaaatggcccagaaatcagtacatgcttccattttcgctgaagagagagtgagtaaaagcaacagtttcttgtgcaactgaccacactgtgcctgctcttagattctcattttttttccctgagactttcactcagaaatccctaaactaattgatatattttcatcaccttcggaaaacaagattgcagcacataaatggaagtctacagaccctgttttttggagacagtgtgagaacatgtccacgcggtatggacgtggcacatgctcccggcattactgaaaaccatatgacacagcacaacccagcacttggacagacatggagcctcccatgactctctccttgtccgtcaccatcagtgacataagcccagaaagtagcggattgctgttacagtggcctgtgcttgttaaaatgatgtgtgatcgtgcttaattatggtgctcagggaaaattcggttgtgtacatgaaataccatgtttgcttttcatacaaatgtgctttgtttgactgaaacaagaatgagatgattccaaaggtgtagtcaaaagctaagatggagcgggaactacacctgctgtgtttttccttcccttttgtggccccagtgtgaaatgctggactctggaaattcgggctataagtaaccacagaaatgaactgtctcagcagctcatctcgcttgtctcatggagaccatgagagtatagattttcaaacttgtttatagcactgtccaaattatttattagtgctgttggaattcagaactttgttggtgatcctgcccagaaaactaagagactggatgtcagagagcacttactgggaaagcaacaattttattcaagatattggtcagctataatcatggagtcatatttacttggccaaattccctgacggtcccgctgatctagtaacccgatttgggtatataaaagcattgattttgagctgaagattcagatccaacaatgtcctgtgtctcagctcaacaggtctgtctgccataacctgcaacgtaatgagaagcaggttttccagtgatcccactgccctgcaccagagcaagagaaatctacattaacatcacaggacatctccattgaatttccaaattggtgatcatgcagacacacgggattgcacaaactaatgtcagaccatagtaggaaatgagaaggaagaatgagtcattttaaaggatagaatttttcctttttaatattatagatttcttttaaagacatagaaaacgaatacaacagccaaggtagtaatgagaagcacctcagaatacatgaaaggtatgcataatgcaattttactttccagaattaattagtagaaatttagtcctgaaaaatcatcttgctatagtgttcctttcacttacattatactcgaggcatacaaatagttaatgctctgctgtgtctgttgccattgtttaaggctgaaacgccagctaggaacctcatggaggtcgaggcttctcaatgacgcaagctgcgctgttctctaattcttaactcagcaggaactgaactttttgccttatcaagtaacacatttctgagcacctaagtggtcatcctcacagaaggatactatcaggcttacaatctgcaccaaccagatgctcctggttgattcttgagttcaggttcactgtaaacttcaaaaataaaactaactccactgccgtttccaaaatgaataattgaaaatgaaggatgaaggtgctgatcaccagatgaagccagatgaacaaaataggaataaaaatttactattctagaatttctgtttttcaagtaataaaaatacacacatatttgtatttttaaataagcatatacactgatttttaataaaaactctatgtatttgtgtttgcctgtcaggaggaggatattcaagtaaccctcagctaactaggaaattctgaaacctggaaaatcccacgtctggccaattgctatagattcgtaaccccttttatcaacaggattgagaagcaaataaataggaaaaaaaaagtggagaaataattcagattactttcgtcacctacaacgttctaatcaaataccaaatagccaacatgtcaagaaaaaaatctgcatatctagattcattaaaagaaataatcttcatcaatacagttttgcataaattaattgctttattttcctgctacttctagaccacagtctggaagcaggatagcaaagtgagtagaaatatagactcttggaatagatcctgttttagatggaatctcagcaacatcaattatctgtgtgacttcctgtgagttgctagaagtacctgtttacctaattgtggataataatcgttcgcatctccttaaagatccaatgcatgagaagccaatgcacagtgcctaaatagagcccagggtatattaagttctatctctttgctattattattaacatcatcattgatattacttttaatttcaatagttgggaagtcattcaacttaagaaaagccaagctaagtcctcaaaattatttgataaaagtccttaaaagatacaactactttatgatattcctggaaaacgtataaccccagtctaaccacaagaaaagcatcagataaatacaacctgaggaatagtctacacaataccaaccaggactcctcaaaatacccaagatcatcaaaccaaggaaaggcagtaacaattcagagggaccagatgaggcaagacaattaactcagggtggatctgggtggttcctgggacaggaagaggacactaggaaaaaaaaaaaaaagccatggaaatctgaataaaatacgaccttcagttaataacgtttccatgttgtgatgcatgtacctaacgatataaagtattaaatatagggaaactggctgtggggtggacagaaatgctctgtactatctttgcaacttttctttaaacctaaaactactttaaaatcaaaaatgttaatttgaaaaaagaaatcagtgttgtttttaaatgtgtactactgttctggttaaaaattagtcaaattctaaacttttgggtcttaatacctttgtcacgcttgcaatgattccttttaggcataggttatggaatactaagactttgaacattctattactttcaccattctgcgcatggattgaaaacattccttaaacacataaagatggtacttgttcacgctccaatatattaaaaataataagtaaaatgcttcccatgattgagaaaaatcactctttcctgtttctcttggtccagttatctaataatcagaatttattatatattaaagagactaatactgcctatttatagttttcctctgtgctgtagattattaaaaaaaagacactaaaagctgtgtaaagttttactgtggtggtggtcattttattacaataactgaagacgaagcttcatttgctgattctatgctcattttcagtatgaaaaaatgaaaattacatctttaacattctattaaattgatgggcaatttcttttcttaaactcatactacaagacagttgaaaccaagtctggaggaaaatgcagagtcattaaagtataaaaggtggtggtcttcagagactggatccagggattggccctgagtaggtcctccacaaggaaacagttggatataggacgagaaggactgctctgagcccacattcctgagggagccacacattgaatgggcagagataaaggaatgaccaaatgcaaatgagagttactatatacaatcccaggttgtgattaagaaaagagaaacatcattctctaccttatcaaagacttcattttatttacacaaaacaaagaatagaggagttctcactatgaaaataacaattttgtagactttagtaacatcagccaattcaagataatatttagcctgtttgattatgtgttaaaccccaagataaaaaaaatccccagatttctaaattataaattctacagatgtctttttcttttttttgagacagtgtcttgctctgttgcccagactgcagtgcactgctgtaatcttggctcgctacaacctccacctcccaggttcaagcaattgtcctgtctcagcctccagagtagctgggactgcaggtgcatgacaccatgcccaggtaattcttgtatttttcgtacagacagggtttcaccatattggtcaatctggtttctaacttctaacttcaggcgatccacccaccttggccgcccaaagtgctgggattacaggcgtgagccacggcgcccggccccacagatggcttagagtattagccaccacaaccggccccacagatggcttagagcgtgagccaccgcgcccggccccacagatgtcttagagcgtgagccaccatgtccagccctgatgtcctagcgtggattctatcatctacacctatctacccttcccatgactagatgatcaatgaaatctccaaggtcactctactctgcaccagtgtttcattcctttgaaacttagtttcacttattttcagtcttgttgcctctcaccatgaaggggctgctgtttcctcaagggctggactcacacttagccactcagcattcttgatggcatacaattctgggtacctgatcaatgctcagccaataatttggggtttgttgagggagttggaaaaaatgagccagaagttaaacctgaaagaggaaccaagaatcttggatttggggccactttccacattgttcttccactcacttttcccaaaatgcctattgaaagaatctttcaaaaatatcatgtgcatttcagtaattcttataattgagtctgtctgaaagcattttaaaaggtatactactgaagaaatctattgtaagacacaaacagaagacagaagacaaaacagtaaattttgaaaaagagcatgttacaatagggctagaccatgatctgtcttttgggaatcaagtgggaaataaattaaatatttcaaatctattttcgatgcatttttctgatgccagtgattttatgtatttttcatcgtcttagtccccttgtgctgcgataacagaaaaacatagactgggtaatgtatgaagagcagaaatgtatttctcatggttcaagaggctaggaagatcaagataaaggcactgggaaggttggtgtctgatgacaactgctctctgcttcgaaaacagtgccatgaattctgtgtcctccagagggaggaacactgtcctcacatggcagaaggaaaagggcaaaaggggtagattctctttgttaagctctttattaagggtcacagctcttactgctaccaaattggcaacacctgaattttacaggagacaccttcaaacaccagcaccagctagtcgagttgtacagtcctatgtatttaaaaaataattaaacagattaaattattttggggtcacttattattactcatcatagttcaatgatatttttaaataatcagtttaattaaggaatgaattaggtaccacaaattttaccacgtctaaatgaacaatttaaggagtcttaatttaatttgacgaatttgactaaaggttatagtcatgtatccaacaccaaaatcatggtatggaggcttctcattcctccacaatttcctccatatccattttcagtccattttttctccctttcccttgctcctggcaaccagtgatctgatttctgtcaccatagctttctctcttccagaatttcatataaatggaatcatagggtacacacatttttgtctctggtttctttcactgagtgtaatgattctgagattcatccatttggttccctgtatcagtagttatgaactttttgttgctcaatggtcctccactgtgtggctttggcaccatttgtctatcttatcaccagctgactcaatggtcctccactctgtggctttggcaccatttgtctatcttgtcaccagctgatgggcatttgggttgtttccagtttggggctattatgaagaaagtcttacgaatgttccatcccaggtctttgtgtggaaatgtgtttttatttcactcgggtgaacacttaggggtggaattgttggatcacagaataggcacatactttttggtgaatgggtactccctcagcgaccttgtctctcctcacaactgggatggtggaagtcacctccaccagtcctacggcacgagctgcttgtgtttagacaaattaatggcgaccctcaaataaacacacacctcaattatttaactatttttggctacttacaaaatcagaaaagattcacagtaccagttttctttgttggtgaaaaagtggtctctccaagctcttccgtaccattttaaaaaaatttacctccttttaaaaattatttgttttatgttcaatgcacccattattcaattataagtatgaacacaaatttatcagtataggaagctcatttgtatctaagagcataatgaaatatatcatgattcaattagagtttatgatatttgtttagtacaggaagctcatttgtatctaagagcataatgaaatacaccatgattcaattagagtttatcatatttctttgcaaaagccaggtattgcctagtttagtctattaattttgagtacaatctgacttaataatctctgattagcaaacttgggaagctattgaatagttcgcacattgcccagttactgcattcattgagagtgtaccaagcaaaacataccacaaggtagcacgtctagtctgtgtatttattcactgtttgtatgcgaatatgtgtaacttaatgattgtcccttaggtcatatagagaaaaaaagttaaaaaattacttggctattgttcttgtagtttttgtaattacacttagtaaaacaatatgacttcaaaaatgtaaccctagtatcacaatttgaacacaaaatctttcttattcattcaaataaagaaaaaaatgtgtgtttctgtgattacacaatgatcttacttcctttgccatttctatcaggaaggaattgtccttcttgattatcaggtcaactgtcaaggaaccacagtgtttgtgttcaaggaacccttatttgacttaacaattgcccaagagtaatgaaattggcatattgttatcatcattctatttttttaaatattattttatttgagacagggtcttactctgttttccaggctgggagccatcatggctgactcactatgatctcaggctcctgggctcaagtgatctttcgacctcagcccctggagtggctgggacaacaggtacatgccaccacacccagataatgattttattttacttttgtagagacaggggtctcactatgttgaccagcctggttccaagtccctgggctcaagcaatcctcctgtcccagcatcccaaagcgccaccatgcttgtcctattttatcattagtcattgttgtgaatctcttactgtgtctagcctgtcaattaaactttatcaggagtatgtacgcatagagaaagcataatacatatggcttggtttcaggcatccactgggggacttagagcttatctccttgggacaagggaaactcctgtatgttgaaaatgccctgtcccagctgggcaaggtggctcacgcctgtaatcccagcactttgggaggctgaggtgcgtggatcacgaggtcaagagatccagaccatcgtggccaacatggtgaaaccctgtctctactaaaaatacaaaaattagctgggcgtggtggcacctgcctgtaatctcagctacttgggaggctgaggcaggagaaccgcttgaacccaggaggtggaggttgcagtgatctgagattgcgccactgcactctggcctgggagagagagcaagattcggtctcaaaaaaaaaaaaaaaaagaagaaagaaaaaaggaaaaaaaaggaaatgccctgtcccagcagcagggagcccagagagttttcattactcttctgttgttgttagtgcattctgccctgaagaaaaacatcaaagaaaatctggctaggttcggataccctttttctctctttttattcaatagacagcaaatttaaccaaggtaaatttcagcaccttgattcacgtatattgacattgaggtgaagaactatgacctgttagaataaaactgatcaaagatgaccacaaaagattttagtgtctaccatctctaaaaggtgagtaatggaatctgcattgtatttcccactagaataaaaggggttttatctcaagtaaaatgtgtctctgtgaacaaaaaagctgggtctatgtagaatcagaaagaattatttaaaaaaaatctgtgccaatctgaaaatattcttgataatctgtgaaaatgtaaaaaagcagaacagactattgcatgaattatacttggtaacgttttccaaatttgtattgtcctatccctaatactttcctttcaataacagtagatacaaaagcagagcatgtgaggagctgtattagaatcaggatttcattctcagtaatatacacactactcctaaacgttccatcctgcacatcacatgagttaaattatttcttgatcatcaatttttttaagtaccagaggttattttgttccgtaggttacgtatcagacagtgatcatgagactcatagatacttggaactccccttttggatctaatttagctcgacttctctaactttgcttttttattaaaaaataggaacatcacttttcaaatcaattaatggaaaaggaagctggagactgtccacctgctctttccctcaattgcctcctctcctccttcaatgtcatcttaagtgacttctccttattaaacaccaggacagatgaagatacaaggcaatataattttttatttatgtttttatttcttgacactgccactttcaaggtgagatgccataattaactttttaaaaacttgtcaacttactttatttttcttacattacaaaccactaagtcaaattattgtgctaaactttatagtttactaaaatgtaggcctgacataaactaattggtgctaagttatatttaatgggttgtgcccagttagtttcctcatgttccaaatcactggatgtattagtccatatttgtactactataaggaactgctcaagactgggtagtttataaaggaaagaggtttaattgactcacagttcagctggggaggcctcaggaaacttacaatcgtggtggaaggtaaaggggaagcaaagtgccttcttcacaaggcggcatgaaggagaggaatgcagggggaattaccaaacacttataaaaccaacacatctcatgagaactcactcactatcacgacagcagcatagtggaaaccatccccatgattcgatcactctacttggcctctcctttgacacaagaagattatggggatcatagggactaaaaatcaagatgagattttgggtgcagactcagccaaactatatcactgaataagcataacaagaactggtcagattttattttgctttgagattttcaaggccagcctacttcatcgcaaaccacaaaatgacacaaataaaatcagaagtgcaaactgaagtcctggaaatgaatcagtactgatttttcttcaagtcaaaacttctcataaaaagatggtccctgtctcctatttaataataactaatcataaaaatttaacaatatgtaatgattccacaattcctatatatatatttttgaaacctttaaaatgaagattttcacagtcaaatgatgaaaatatttaataaggatgaagtaaaaagaaccttcttcatcaatataggtgtatggaaataatcatatttcaaatctatgagatatgaaacaatctatttgaccatactctgcaaatctagtgttcatagagtgatcccacaaaaataatgatatttattaaacttctgttaactcactttatcccttttatcaactttttttcaaattccatggaaatgtaaaagtaactatttaatttaatcaggctaataataacctatcttaatgaaattcagagaggaaacaagagactactttaaaaaccctctctagaggaccaattgcttccagcagaggaggcgtatgcctgtcaaatcgattactgtcaatgtgtaatgttagcatcagtttatgagctcaactgataattcacagggctgacaagcgcccttgcagaatcaggaattaataaggtaaaggaattttgaattttagaaaatggaattaagccttaattccatgaagaacatagtaactttgtcaaattgcattatctgcttcgttgcgtctaccattacttatatctgaaggtaattacaaaatagctattattcttacagcacctgaaatttgaaattaaatagatgttaaattattatataggttttagaagttctaatttcaactatatggttggggacctaaaagtgatatgtgagctacgtagaatgaatttccttgactgttaaacactcgaggaaggggggaccttaaaagtcactttagaaaacaaacaaacggctctgcagccagaactgcttccttattcagagacgaatggccaggcctcaagagaagcataactcttgcagcttatgccaatattcaaattacagtacaaatcttgacagaagctgggctttaaagaaatggcacgagaaacgaaactgtcaagaatattaaatcaccccaaactgtttatactgagcatattttaccaaagaaggtattcaaataaaaatgatggggaaaaaaaagactttcatagcaacccttaaaagactgaccataccaaatgtcagcaaacatttagaaaaactgtgtgtaagagttcaccgttagtgagggtggaacttagtacagccaccatggaaaacagtatgcagctttcttataaaagtaaaaaagaactatcatatgatccagtcatcctactagtgggcatatacccaacagaaatgaaatcagtacatggaagagatagctgcactcccctgttcactgcagaatcattcacaatagccaagatacggaaagaaccgaggtgtcaatcaatggatgaataatggtaaaaatgtggaatactatttggtcataaaaaagaaagaaatcctgtcatttgcagcaacacggatgagcctgaaggacactttgttaagtaaagtgagccagtgacagaaagacaagcacatcatcatctcacttttacggagaacctcagaaaactgatctcattggagcagaggatggaatggtggttaccagagactgggggaggcaggaggacaggaatggggagagatgagttaacaggtgcagggtctcaggtagaagtaagaagttcttgtgtgctattgtacagaagggtgattacacttaacaatattgcatggtatatttcaaaatagctagaagagaggattttcaatgtttttaccgtaaagaaacgctgaacgttggagatgatgcaaatgctacgaaccttgatttgaccatttcacaatgtaaatatgtactgaagcataaataaacagaaatgataataaaatgctgaaggaaatataaaatgcaaaaattattttgggaaacaatttggtaactttttaaaaagttaaacatgtagttaatatatgacatggcccttccacacagaggtagtgacccaagggaaatggaagccatgtccaaagcaacacttgtacacagatgttcactgaccttcattcttaaacgcccctgcagggaaaaaggcatgaagacactttgggggctgtcaggaacgttcaatatctttcactatgaggtattcgcactctgggaggggtcaacaatgttcaatatcttgacgaggggtggtgaaaacaagggttgatgtttatcaaaactcatcgaattgcacacttttgaatatctgcatttcttgtgcataaagtataacttaatgaaatggttaaattgttaggtttttcagcgtaaaattttctatgaaataaagtctatggttgttgttttctatggtttgtaatttataccttacctataataaattacagatagtcccacctcccccacaaaaatacatccacagcaacagccagcactactgagtttggtcacataaactgtgcaccagatcacaccaggggcactggccacactgtctatttcttatatttgtcaatctcgatatgtattaatcgatatctgtatgtatgtatgtatgtatgtgtgtatgggtatacatgtacaaatttaattataaaagaggataaatcagaacaaaaatataattgccaagtatgtatatatacacacatgcatatatacatatatacacacatgcacatatacatatatacacacatacatatacatacaaacatatgaatatacacacaactatactgggaattctaatatctcatcttccctctttgatacatcttccactgatatgtaggactatctgctataagggagatgttattacatcattattatcaatatgaatacttacaggtgacatttaataactgcttactatgtgctgagaaatgtagaaatcattttgtatgtgttgtatagattttaaactagattataaacaccatgagagtggaagctgtatctgtcttctgtttatttttttaatgctgaacaaattgtctgacatatgtagtaggtatttaattaatgtttatcaagtagatgatggttatgaagtccctttatttcatcattacaacatgttaaagcatttttctgctaggcacagtggcttacaactgtaatctcagcaccttgggaagctgaagcgggtggatcatttgaggtcaggagtttgagaccagcctgtccaaaatggtgaaaccacatctccactaaaaatacaaaaagtagccaggtgtgatggcaggtgcctgtaatcccagctactcaggaggctgaggcaagaggatcacctgaaccctggaggtggaggttgcagtgagcagcgatcatggccctgaactgcagcctgggtaacagaacgagactccatttcaacaacaacaacaaaaaaattcaaagaagctctttgtaaatatataagataggttctattgtttaccttattttacagataaaataattgaagaaaattggataatattctaagcattgaatagttgcatgactagtaaactggagggttcagttcggtcttttctcactgcattgtctgagcccttaaatctctcttcttggttttagttccttagcaagatcaggaaccctgctagtaatggattctgggaaatgcagtttccaggcttccagactttctgttctagacagtaaggagcccatgagaaaatgaatatggttaaaacaccaacagagctagcaactctatggactctctatggaagagggatgatggagattaggatttcccagttccactaagacacaggtccatgcaacagctgaaactccccatccctcaccttccctcccatgtgcagatgtcacacctgggccatcactaatcttgtctaaccctgcatactctcctctgctctacagaaaggcagtaacttggagagtgaaaattttcccatctcattttcccactaggcagttgctttagtgtgccgcttttgtattcccagtttgtcttttcccggaagtcagcatgtcactttcagttttaaaaggctatttaactggtattcatcttgccgcctccctgacccatcccatccccatgccttttttccagtagtgcatgcctctcttccatcccttgtatgagagttaaattatactttacttgaattttcttctatctctacttgatttacctcatttccaccaataaacaactgacaaaacttgtttattaatgttctcccttcatgtttccggtaacatatgacccatagtcttgctaaaattaagaggaaacacatcacatctctcactttacttttgctctatctacaacgataacttgttcaatgactttgaaaatttgctcctatttattcataacattggagaaaacaaatattttattccatacaattgtcatttcctaccagcctgccaccacgcccacagtgagataagatatcggctgctcttctgcagcacctcttacttcctgccttgacatgactttactgtgtcacacttctttcaaatgttagtagatgcttgatagtatcacagactcgaatgtgatcatgtaagagatcactgtgtgaattccatgttctgctaaatttttgaagttcctactctgaaaattataacataataatagggtctgaggaaaagtcccagaacccagttggtagttatcaaccaacaacttaccagaaagatgactcagtagattgcttggtaatacctgaacttcttaatctgggcattataatcaggaagaggcatgggtagagaactgaatatgactatggaaaaataaaacaccttttaaataaatagatttttaaataaaatatttgggattgagaaactatgcaaatgaaagatagacggttaaaagaaaaaaaatcatttaaagtgtttactccttagcattgtcaagtgatgaaatgtatttataccacgacagttcctgcttagcttttgcaggtaatggttgccaagtctttggtgcaaaaatagaaatgataatttttagaaaagttgttactccttcccattactgaaagttaaaaattgttttcaatatgggcttttttttttttttttttttgagatggagtctcactttgtcaccaggctggagtgcagtggtgcgatcttggctcactgcaacctcaacttctgcctcccgggatcaagagattctcctgcctcagcttcctgagtagctgggactacaggcgtgtgccaccacacccagctaatttttgtatttttagtacagatggggtttcaccatgttggccaggatggtcttgctctcttgacctcgtgatcttcccaccttggcctcccaaagtcctgggattacaggcatgagccactacacatggccaacatgggcttatttttattctacattgtttatgtgaaatggatctgcttaaatatagtcatcagagtaatgcctaaacacacagacacacacagttacatttcttctaatcattgaagaacataccttatcaataaatgggggggttacagtcaggttcttccagtagcagatggcatacaaaattcagtttaagatgtgcaaacaagtcattgaaaaaataaatttacttgaaaactgtgtcatagcaacctagtttttaaaagttataatccaagaaatacgttttatacagagattggaaggttagaaagttgcattttgataaacatggtgggattctgaagaaacaatgaatgaaatagaaataaactttattagacaacttttgtggaactacagttgttgacatagagatgtagttacttttctgtttcttcaaaattcttctaacttatctccaggtcttctgaccatatagctttattttgatttccttgacagggacttccactgcctgactgtttttctgcaaatattttcaatgagaatcccttctgcctttcaaaatgggcattaagtgaactacccactttcttaatatcccctttgctcctaaattaaatattttattttttctttatttgtggttggtgttgtgtggtgtgggcggattgcttcttggttcatttttcaagatctccttattatgtaatgaccatggttctttcggacagtctaaattattttctcattaaagccatgcacacgtgccacactctagtgctgacgagggcatcttctttatgtcttggcccatcagatggccatttagcgcccaacattggtgagatgcttctctcttagtggaaagtgacagaatgcctgcaaccccatattcttattttctaatctgaagttaaattcaggcttgtgttgacttttatttccctacgtaagacttcagagcagattcaccagtgcacagttctaggactgaaaaacgggctcccgtggcagctcagccattctctgttgcactggaaattgcttcctgcttcaacttctggttaagtcagctagaaagttccctggactaaggtgctcaaccctgcaaaatctcagatggctcccaggcaagactcccctctggaagtctaacgatttccttttaggtggcaaagcactgagtgatttctctgctttctcatgaactacaacaatcgcatcattcctggcattctttgattatgagacctgaggtcttagtagcatctgatgctttccagagtaaccttagaattatataagaatacctttgaggttctctggcagtaaatgtttagataaggccatcatagtaaatattccttagaacatttcccatttatgccagcgtcctttcagaatattacctctgtaaggtacgactaaatcgttttttaaaactgtgtttcattttcaggttgatataatctctaatgcaaaactcatctaattaccagtagatgttcctatatgtaataccaaaattaaagatcaaggtgattttatgacttttccatttaatttcttctgagcatttgtaaagagttccagttaattcaatatttgcttattccatacaagcctatattaaagaaaatagtatccctgacagttaatatgtgttttcactgcattttgttatagacagttcaaaaatgttctgccttgattatgaagtacaaatatttccttctaaatagtgaacataatttagattatattacttctccagcctaaaatcatgaggaaatcccatttattagtgttaaatctcaacctaattgtttgatctgatctctccaccttttctccatatccccctcattcctgccccatagacttcattttgctgctgaataaaatcactaatttaacatccgcagatagcttgtctgctcccatcttgtattcatctcctggaacagacagttccttacacttctcgcctatatttctatgagtcagagtgctggcaggaagtggcacactcaaatcggaaaattaaaaaaagttaatgcaggaaatatcgggaatacttgtgattggtttaagtcaactatcacgggctagtcagcacagttcccatgtgctgttcacagtggatccatttatccccccagggagctggtagcagacaggacagggagctggtagcagacaggactgggagctggtagcagagaggacagaagcccctggtgggagctgctacctttggcaatccatggaagagagacggagagacagcacacccctacttcactcactctgtggcctcagtcactcccctttggtgaatcccaatgagaagtcagagggcaaaaaagccccttgatatgttcagtcctcagagcacagagctccctgggaaagaaaatagtatccctgacagttaatatgtgttttcactgcacatatttcactgcacatatttcactgggaaagatgaagcatggggcagaggggctgaaacagatgccctgagtggttcttctccatcagcccagccacccagtcccgccacctctctggagacctcatagaaatgcctgaaacatcacctgtggatgcctattgaacacatcccactcttagaccaccacattctgtccaatcctttcaggcttttgggcattcctgaagcccactctgtccacctctccactctgtccacctctccgcctgcatggagacttcgaatcagcacatctcgtcatgtctgtcttctaaccacacctccaacctagcgaccttgatgactatgagctgttacatgaggcaactcctctcacctgcacggtgccacccaccttccgtcctacctcctgccttcacccagacctccttcccatcccaacaccctacacgtcactcaatcaggttcttcctcgaacaatgtgtgtcaggtcaggcaactgccctgcacaaaacttccatggcttctgattgcagagtgacaagagaaacatggcagggggctgatgccttgattcctcctgactttgcttctgccccactggaaagatcttccccttggatgagtcttcccctatagcttagtctggtcttcctgcaattaaccagatgcaatccatgccatttcactttgcaactttgtatttgcaaatgctctcttctgggacacatcccagctacccaggtgggcagctccccactcccttcaccagcactcccttccagagactcacactgctggttccaccctaaggagcagaggctccctcactctccagccctctgaccattcccctacatttttctttattgaatttattaccacctgggagaacatcaaggctaagataccatcattataagatgcttaattacttcatacactattgaaaaagaaaattaaaatgtgacatgagtctctcttaccaacgcgatagtaagatacatcccatatcagaggtacaaaaaggtgagaaagtccatgccttagaagccatgagacaggttatatattactattattgttattattttcactgcaaaactgtctgattagaatgtaaaatctgtgagagctggtcttttgcccagttgctacttacgtaatcccagccctcaaaatagtgcctggcacacaatattcagtgaatatgcataaaattaattatgtaaattaagtgtaatgtttagtggctttaactatatcattgtttcattttcttttctaccttctatatcttataaatcttacgtatgttttattattgatcataataaacatcacaccaacatagtgattacatgtatttcaaaacaagaaaagtgtgagtcttgtattgttctatatacgcgacaccttagaaacgctttctgagtaaaaggcagtcttttcaacacattggcaatgagcatttttaggagtaaggcttaaaaaaagatattttcttcttctcttctcaaaacaaacactgtccatggctatagatttttgtcagtatgctaatatgttatgattcgggattattagagatgaaaacattaaggtaatgccaattattattttctcagccactttatgtatggcttctccaaaaaaaagagtgtgaagctaaaaaaaagagagaaaaaagcatgcaagaagcagacagggacttaaacaagacagcttgaaaacctggcttattgctcatttaaagtgtggagcttaattcttatctctggctatggttctcatgcatcgaaaaacttcaaagactgaagtgcaaactcattttctttgcttgatcctcctggtagggagggaaaaaaatcaaatgcaattgtgtgaatttatcataatactgttcaaggggaaaactcataaaaatcctgtctgttgctcacttgatttgatgtatccttgtctaataccaccattcactgaagacaacacaggcatcccaaatgacggagcggctctcaacacgtcaaccccactccattattattggcctcaactcgggaaatcttatctatgaggtatagtttgcattcatataaaaccctctttggcaattcatacagttctgacttatcctaaaggctgaattaaatgggctgtgtaatttgtaaacagaattcacatttattctaatgggacagcgggaaataagatcaacactggcagcttctccagccctgctcaaagaaacttcaacagaggccaacgtatccagggaaaaactggactgcaggagcccatcctcaatgaatgttatttatccttcagagtagattctcttctttacatagaagatggttgtgattataatttattattaacattaatgttttccctttctaatcacagtcaaaaggaagacagaacaccctgttcccaccaaagccactatagatgcagctaattgatatcttttctttttttttttgtttcagagtcttgctctgttgcccaggctggagtgcagtggcacaatctcggctcactgcaacctcagcctcctgtgttcaagcaattctcttgtttcagccacccgagtagctgggattacaggtgtgtgtcaccaggcctggctaattctttagtagagacagggtttcatcatgttggccaggctcatctcgaactgctgacctcagatgatccgctcacctcagcctcccaaagtactgatacctatttctaaaatagaggtttttgtacaaataagaattaagtatccatagaatttacccagtagaaaagcttcagacttagctattaaaattatttgaatattcaggtccatctgtgatttggtaaataattaccatggggttttattatttttaacaaatttttgaattttgagataattatagatccatatgcagttgtaagaggtaatacaaagttctcatgtaagttttaggcagttacaaagatcttgtgtaaccttcgtgcagctttccccaatggcagaattttgcaaaactgtattataacatcaccaccagtatactgacgttgaaacaggtgagatacagaacatgtccagcaacacagacatccctcccgttgacccttgatagctacacttactttggcccatcaacacctccctccttaactcctggccactactaatctcttctctcttcctataagaatgttgtagaaatgcatgtgaccttctgggattgacttttttggtcagcaccactctctggagagtcatcaagttggtgcttgtatcaatagtttattcctttttattgctgagtgggatttcatggtctagatgaattaatttgtttaactgtttgcatcttcaatgacatttgggtgatttcctgtctttgactattatgactaaagctgctacacatattcctgctactattacttattattatgttatgtgaacagaagccttcacttctctgagataaatgattggaagtgcaattgtcgggtcatatgataattgcatgtttagctcttataagaaattgctggccaggtgtggtggcttgcacctgtaatcccagcactttgggaggccaaggcaggtggatcacctgaggttaggagttcaagatgagtctggccaacctggtgaaacctcatctctactaaaaatacaaaattagccgggcatggtagtgggcacctgtaatcccaaatcccagctacccaggaggctgaggcagggagaattgcttcaatctgggaggtggaggttgcagtgagccaagatcgtgccactgcactccagcctgggtgacagagcaagactccatctcaaaaaaaaaaaaaaaaaaaaaaaaaaaaaaccaagaaaaaaaaaagaaaaagaaaaaaattgccaaactgtttaaaaatgtggctgtaccattacacattcccatcagcaatgtttgagtgactcaacttctctatttgagagcatttggcaatgtcagtatatatatatatatatatatatatatatttttttttttaatatgtatttttaattttggacattttgatagctgtgtataatagctcatttttgtcttaaatttccctgatagctaaaggtgttacacagtgttctatgtgtttatggtacatgttctttggtgaaaggtcttctgaacatatcctaactctgtgactctgtgtgtgtatctgtgtgtgtgtgtctgtgtgtgtgtgtgtaattgtagagtcttaagagttctttatgagttcttatcagatacgtggtttgaaaatgttatcttccagtctacagcttatcttttcaagttctttatatgatttttctccgagatgtttttcattttgataaggtaataatcaattatttggtaaataattccaattgatgaattatgttttgggggacaagtctaagaaatatttgcctagtctcagattgcaaatatttcctcatatcttttactaaaacttttatatgtttacatttacatttaagtctattatccattttgagtagatttttgtaaaagatgtgagattcacatggaggcacatttttggcctatgtatgtccagttgtcctggagccattcactgaaaagactattcttcctccattgaattgctttggcccctttaccaaaaaccaggagggcatcttctgtgggtttattcctgggctttctattccattccattaatctctgtgtctgcccttccaccaacaccacatggtcttgattactggagctatataatatgcagtgaaattgggtaaggtgcttttcccactcaattttgttcttcaaaattactttagctattccagttcctctacattttcatacacattttagaataatcttgttcatatctacaaaacatatttgctgagattcttataacaggtgcattaaactgtatatcaatttgggagatttgagatctttactctgagtgtcccaatacatgaacatactatatctctctacttattttgatctttggtttctttcaatagcattgtatagttttcagtctatgagtcctatacatatacagttttctttagatttccacatattacattgttttgagtgattataaattgtattttaaagaaattgggtgttcacgtgttcatattattatatagaaatacagtagattttgttgttgttgttcatcctgtatcctgtgaagtcaccaaactgggttcttggctctaagagtttatctgtgaattctttgggaaattctatctagacgatcacgttacttgcaagtagagtcaggtttactgtttttctttgcaatctgtatgccctgtttctcttatccttgcaattttgaatggacttgagcttccagcactatactgaatgggaagagtggatatccttggtgggttcttactcttagggggtaacatccagtctttcatcagtaaggttaattctaagtgtttttttgttttgttttgttgttttgtaagtgctctttatcacaaactgaggacgacccatttcctcctgccttgctgagacgttgtcatgaacagacgttacagcaggcttgatggtggcccccgataacgacatgtccactcccttgtccccagacgtggtgactgtgattttatttggaaaatgggtctttgcagatggaatgtagttaaacatcctgagattagatcatcctggattatgttggtgtccccacatccaaaatacgaatgcctttgtatgaaacacatagaggagaaaacagacaccaagagaaacatgtgatatgaagacagaggtaggagttccagcggtgccactgttagctgaggagcataggagacactgtaagctgtaaaaggctgggaatggtttctctccccgggagatctggcagggagcatggctttgctgacaccttgattttggacttgtggcctccagagctttgagagactgaatttgtattgttttcaaacagtacatttgtggtggttagtttccttaggaaactaataggggtgttgaatttgtcaaatgctttttgtgcatcgactgatataaacatgtgatttttcttctttatcctgttaatttaataaatgacattgattttgaaatattgaacagtctttcattcctacaaggaaaacacttcatttgcttatggcatataatttcatatatatatatatatatacacacacacacacaaaatcctgtaccacgtaaggacatttcaatcaatgatggatcatgtatacaatggtcccataagattataatgtagttaaaaacctcctatcacctaatgacatagtagccattgatcatagcacaatgcattgcgcatgtgttcctggtgatgctggtgtaaataaacctactgtgctgccagccatgtgaaagcggagcagtgcaactgtacacagcaggtaacacttgataataataagtgactatgacattgctttatatatttactatgctatactatccatcactgttttagactatgctccttatacttacattaaaaaaaaatcactgtaaacagccttaggcaggtccgtcaggaggtatccagaagaaggcattgagatcactgaacatgagagcttcattcatgtgtggtattgccccgaagactttccagtgggacaagatgtggaggcggaagacagtgtgtaggcctaagctatgttttgtgtgtttgtgtattagttttaaacaaaaattttaaacaaaaaattttaaaaagtaaaaaaaaaaatacaaaattaaaataaaaaatgtttacagaagaagactataaaaatatttttgtgcaactgtacaatgtgttttaggctaaatgttatagcaaaacaataaaaaattttaaaaaatgaaaaggtttataaagtaaaaaagttacagtaagctaaggttaatttattattgaagaaataaattttataaataaatgtactgtagcctaagttcacagtgtttataagtctacagcagtgtatggtaatgtcctaggccttcaatttcagccatcactcactcactgactcacccagaacaacttcccatcctgcaagctctattcatggtaagtaccttatacagatgtcccacttttttatctcttatacagtgtttttactgtaccttttgtatgtttacatatgttcgatacacaaatgttacttcttgttacaattgcctgtagtattacagtcacatgctgtacaggtttggagcctaggaacaataggctgtaccatatatcccaggtgggtagcaggctatacaatctgggtttgtgtaagtgcactccacgatgtttgcatactgttgaaatcatctaacaacacatctcagaacgtatccctgttgttgttaagcaatgcatgactgcatatgcatgtatatatacacacacatacacacgtacatatatatttgaattctatttgctaccattaagaatttttgtgtctatatttatgagagatattagtacatagattttttttttgttatgtctgtacctggttttggcctcagaatattataacttcacacattacttgtgaagtattcccccatctattttctgagtatgtgtagaattgctgtcaatttttctttaaacatggttttattaatttaaatcattaaaattgtcctctttctataggaacttgcatatttctgtttaaaatgataattacaatgaatatgagtttgtatatgtgactaattatcaaatcaaggccatggacttgcatttgtacttatgatgccttttctagcagacatccactagtgagcagtgtacactgcacaccacgtgtcaccttctgctgcaaaaaaatgtgagaggatacacgcacaaggctattcatgtcagactatttcttatagcaaagaactggaaagagctcatcaatagatgggttggaagactgattgaataaactgtggcctctccatctactctgtggagtgctgtacagccagagaaagaggagagagagagaaagagaaagagagcaagctactatagaatgagctccagaattcattagatagaaaaaaaatagagcctaaaacacattactgcttacccaatttgggaggcgggttgacacaaacatctaatatctatatatagagatatctacatatgtgtgcgtctgtttcttaaaagcaagaatgaaccagaacaattctacaaattagtatttacagggggaaagtgaaacagtttagaagagaaggaagcagaagtgagaccttcaaattatacctacctttgcagagttgactgtggaatatcaaagtatgcaaatctttgtatatcacaataaaacaaaattattttaaagcaatctaaaatgtttaaagaagtaaatctaattgtgaatctagcaatggacagctttaaaggaccttgaaatacagtaatttgattgggagacatgaagtgtaaacatgaatgcaaaaccattttagattgttttcagcactactgatgcatatggaaatgttggtattgctttcaaatttttcacgtctgtgttgtaagatacagcaactgagaaattatgagatattctaattccacctttatcagagttactgagagcggggacactgggtgaggaaaggactacagatatacaatggaagacatgagaaaaaaccttgcagtgctgaatgtgaatcaggcgtatcagcatgaaatcttgtctctttgttctatacacacacacacgcacatacacactcactccctatcgagtgaaagggcccagaaagaacaagaaatcaagcagtgattaatattgtaagtgtccagatcataatgttgaaatatcatttgccattcaaggaagccaagaatcactgggctggatgactaatttcaggtttgaagcagaaattacacaagataaatttggaatggtttatcccactggatggcaaagaagctatcatcgactcaggagtcaagaacacactaaaaggcaaaattagcacaattttagcatcaacaaagataatacattccatagattgaaaatcatcagactgttttaaattcatgagttctttcctaacaatacaaaacaataaaagaaattactgtagagcagtagtgctcaaccagtagaacttttgctaccatcttctctcccctcattgggacatttggcaatgtctggaggcattggtatttgcacactgagggtgaggatgctactggtatctggtgggtcaaggccaatgatgctcctaaaaacctacagtcacaggaccgtccctgccttaacacccaaacaaaagtatgcagtggaaatggtgataggcctgaggctgaggaggctatgaaaacttcctattctgaatgtaatatataaatgtaatgtaataaactgaaaaggccacatttatcctgtcttgcctatcaactttgccaccagacaaccaaataatatgcttcttttataggagaacctcagcaagtaaatacaaaaagaagcaacagaatcagaatactatcgatttgtggcatttagtcaataaacacagctggtcagtgcacgtcagtcaccccgtctcctgatgggagaaaacaccactagctatgaagtcctcatgtcagaaaaactcaaactcgaacctgtccaagcctctttatccagtgccaagtcacagaaactttcttaaacactctggagatgcaatcggcaaaatgtctactatggcaaattcaacagggaaaaagaaaaacagaaaataggagcaacatataaactaatatacttacaacctacatcaaacaatcacaatcataacacagtacacttttaataattcttttatcacctcatcatgaaggaaaaggaagccattttcagtagtctgggttacgttctctgggtttcactggtggaagaagaagttataattttggggacgtcactaaggtaagggtactaatatatcctgggtacctatcacattctgcagattgacgtgtatacatatatgttaccatcttattttcacaaacactcaagaggcagatatgactgtgcctacttgcagatagttctcagaaagagaaagtgaattacaaagtgaggtcaacttaaacacacagctcgagcagatggaaccaagcctctatagctgcaatgtgcacaactcttttcattacacatttttttttaatagaacagacttcttatgaaagtgcggatgatgaatcagtgcatcacagaccacaataaagaaggccagaagagaggccattcacttgggagacagctgtaataaccaaggtagaaatacgtcggaactagaggggacgagaggaaacaaggccatgtagcaaatgaggagttctgatttattcgaataaagtccacaagaacaagaacaaagccatgtaaacagtaagaggataaaactttgagaaaagacaaaacataacacccaaaggcaactgagggattatatccttgaaagaaagagtataattcaagatggtatgttatagaaatagcaaaagcgtaaaattgagatctatcatcttgactccaaagaagattgtacagagagacagagaggcaacgatgaaatgactgcttgttctgggcacaacagagggagaagggaatgtaatggaaagtcaaaaatactgtcccgggcccggattgataattacatttttgacaagaaggtgaacagtctggaaagataacagtaaagttgaaatggactaaaaactaatttgagaagtttgttgtaatagaattgactgcaagaaaggaaattgccatggccccagggagaaaaagaaaagaggatgagggagaaaaaaatcgtgaatgcactttctgaagcactcctagtccttggaagagggacagactctcagaaatcggaaacgtgtgctgcatgggctattgtaaaattagttttctttaccttttcagatcattttccatcaggcaagtcacaaatttacatagactgtttgcaaaatacacaaatgtaaatatggctttcaactgaggatctgtcctctctgttttaatacaatgtatcctgacaaaaactcagttatgattcctactttgtagataatgaaactgatgatcagagaattaattactgagtagttcatggtcatgctagaaacaaaaagcaaactcaaggatagagtgcaggtagtgacaggataaaccacagcttcctctccacgggtaaacagattctcctaacaaaggtttcactctgtgtagacaaaagaaacgctgtttggggaatctagttaggaaaaaaatctggtaaaaagtaaaaggtaaataggaacacatgccattcttgaaaactattttacttataaagtgcaaaaatgcataggatgaggttatctagacttcggaatcctgacgtcgatgaaatggaacctgttggaaatataaatatgtatgggtggtgctcaagttattatttttgacttctagctggtttcattagcatttctttttctaactttaagaacttgtaagagaaattaaagcactaattgagttgggggaagaaaggaaataattagcatgttgtctgctcacacatagtgacttgttaacaaaggagttgaagatgtaaagaataaaggaattggtgaaatgttatttcattttcaggaagacagaaaattcttaataaaattaaaacacagcgtaacatcagttgttatattttgagtacctcattaataaaaggattaagaaaacatcaaaagcacaacagacatgatcaaagagccacgggcactgatgaaaagatgaaaagaactctatggcaaagaaaaatgatgaaccagcatgcgtctgcatctatcaaacacaaattaacagaaaatagcagcacacttttttatgacacaatttcaatagaattaaatattttaatgaaataaaaatcctaattcagtttagcagtggagatcagtaactgagtctcagaaaaagggaaaggaatgaataaaagaagaaaaaaaaagatggcttaggttttacccaaagataaaccactttaggaggtatttttagataaagtggaaaatgaaaagtatttagggtaagagcgatgcatattgcagaggaatgggaagtgcaggcagtgtactttgtgcggctggtgtgggacaggtggcacccggaaccactgttcacagagggcgacaggaagggtcagaggttccgtaggattagcccctgcacatgtgatcatttggcttcttttaaagcagtgtgtgcattctttgctgctttatttctcctggttggaagggctctgctcccacttcctgggggtttgcttcagccctgttgcagggatggacaggtcacttggagtggccagtcaggttctccgtgttcctggatgtggcagtggatggagggtgcagaattgagcaggaccacttggggccatttttgggtttgagatggaggccatcggaggtgtctttactcttcgttcctcaaggccatgaactgtaagagcaatgtaaccccagaggagctggaagctattttctctgtcatttacagacaccccacatgggacagagcctcaagaaaagaaagcagagctgaggaaatgagagtcctgataccactgggacctcctaaccctggatacaaacaagcctcttgtgtcatacacaggatttctaataacagagatataatcctaaaaataagatagaagggtaagagaatattagcatgatgctgtcaatccaagtgagggatacagggagcctgaattgggggagtagatagtgaagacagaacaaataaaaagcctgtctgtgtttcctgatggggccaactctcaaaagggagaagaggattgatctcaagaccatccttggacaaaagagggacacacatctttctgaaactggtgggaaggaaggaaggaaggaagggagcaagggagggagggagggaggaaggaagaaggaagaagggaggaagggagggggaggagggaggaggaagggaaggaaggaaggaaggaagggaaggaagaaggagcaatgaagatgactgtggaggagcaaagaagagatgttcttgctgtacaaaaaaggtgactttttccctgaaaacttggagagaggctgctgtgggtttattaatgaaggtttaaagaaaagtgaaggtttgtaggagttgctgtaagtccatgagtactaataaaaggaccacatgccatgcaaaggtgagagtgtggggcaaggagcggggcagcatgagtggaggccaagtgggcatgacccatgaccttcaggaactgcagcatcgagagtcctctaggctgagctcactcctgcacaccacagagggatgcattacagagaaaagctttagacacttcaggcaatagtgagtgacttattctcagttatatgtctaaatgacacaacttcatggataattgtctccactctccactaattttggaaaacttacgcaggcataattctattccagaagaagcacctccctatgtatgaatgagccaccttcccccaagagtaaatgtaggaaagaaggtgacagccaatcgcaatggatgtaaacaatcacatataaacagaaatcaaacacgtattagtaggaggcagaaaagtttacttcaaaggaaatgggaaaggatcacatgaaaacttgttgcctgtcttccaatccatgagttctacacagcacaaagcaacatgcaaagcacttgtaatacacttaatctttgagtttgcgtcttgaaattagttggtggggggaatcagttcttaaattatttgcatcaaaatagcataaacctgaagaattgtagagggaagttaaaattaaacaggcttattctgaaaaatatctgagagactaaactcagcttctttgcttttaaaaatgtgaatccaaatcagcacaaactcaatataatcttgttttctctacccctctgttatgtgacaatgtctcatgggttggctttgccaagtcagaggaaaccccaggctcccaccatgcctaaggatgtcctggactcggaaagtgaattttttcttatgctatattttctctgtggtgaagaacaaaatgaacatacctctcatgacagcaattttttttttttttaagatggagtttctctcttgttgcccaggctggagtgcaatggcacaatattggctcactgcaaactctgcctcttgggttcaagcaatactcctgcctcagcctcccaagtagctgagattacaggtgactgcaaccatgcctggctaatttttgtatttttagtagagacagggtttcaccatgttggtcaggcctgtctcaaactcttgacctcaggtgatcctcccaccttggcctcccaaagtgccagcattacaggcatgagccactgcacctagccgagagcaacatttatatccatataaattcatgtaaagttttaagcctcacgttgtaaagtttctaattatttcagacatttaaacattaggacatttaagaaaaactattgctccagtcttaagactcacacagcttgccataatcaagcgttttaaagtggaaaagccagacgggagagagggtcaccagctcctcctcatcgatgtggtcctcaggagcctctccttccctggttgagacacatacgaaattcggaaaatcatctggtttgctgactgtttcactttcatgtatgtgtcctgcacatcaggatttgcttcgatgacgaacgttgactgtgggtctcttacactcaggcggcctccagcctctgataagatgggccttaacatctccgttgaccaactgacttcatggtctttctctgtcatgacctaatcaggagtttcagatcttcctacccatacacatggttgcatacaagcctctcctatttttttttttattatgctttcagttttagggtacatgttcacaacgtgcaggtttgttacatatgtatacatgtgccatgttggtgtgctgcacccattaactcgtcatttagcattaggtatatctcctaaagctatccctcccccctccccacaccccacaacaggccctggtgtgtgatgttccccttcctgtgtccatgtgttctcattgttcaattcccacctatcaatgagaacatgcagtgtttgttttttttttgtctttgtgatagtttcctgagaatcatggtttccagcttcatccatgtccctataaaggacatgaactcatcatttttcatggctgcgtagtattccatggtgtatatgtgccgcattttcttaatccagtctatcattgttggacatttgggttggttccaagtctttgctattgtgaatagtgccacagtaaacatacgtgtgcatgtgtctttatagcagcatgatttataatcctttgggtatatacccagtaatgggatggctgggtcaaatggtaattctagttctagatccctgaggaatcgccacactgacttccacaatggttgaactagtttacagtctcaccaacagtgtaaaagtgttcctatttcaccacatcctctccagcacctgttgtttcctgactttctaatgactgccattctaactggtgtgagatggtgtctcattgtggttttgatttgcatttctctgatggccagtgatgacgagcattttttcacgtctcttttggctgcataaatgtcttcttttgagaagtgtctgttcatatccttcgcccactttttgatggggttgcttgttttcttcttgtaaatttgtttgagttcattgtagattctggatattagccctttgtcagatgagtacattgcaaaacatttctgccactctgtaggatgcctgttcactctgatggtagtttcttttgctgcacagaagctctttagtttaattagatcccatgtgtcaattttggcttttgttgccattgcttttggtgttttagacatgaagtccttgcccatggctatgtcctgaatggtattgcctaggtgttcttctagggtttttatggttttagggctaacatttaagtgtccaattcatcttgaattaatttttgtataaggtgtaaggaagggattcagtttcgtctttctacatatagctagccagttttcccagcaccatttattaaatagggaatcctttccccatttcctgtttttgtcaggtttgtcaaagagcagatacttgtagatatatggcattatttctgagggctctgttctgttccattggtctatatctctgttttggaaccagtaccatgctgttttggttacggtagccttgtaatatagtttgaagtcaggtagcatgacgcctccagctttgttcttttggcttaggattgacttgtcgatgcgggctcttttttggttccatatgaactttaaagtagttttttccaattacgtgaagaaagtcattggtagcttgatggggatggcattgaatctataaattaccttgggcagtatggccattttcacgacattgattcttcctacccatgaacatggaatgttcttccatttgtttgtctcctcttttatttcattgagcagtggtttgtagttctcctcgaagaggtccttcacatcccttgtaagttggattcctaggtattttattctctttgaagcaattgtgaatgggagttcactcatgatttggctctctgtttgtctgttattgttttataagaatgcttgtgatttttgcacactgattttgtatcctgagactttgctaaagttgcttatcagcttaaggagattttgggctgagacaatggggttttctaaatatacaatcatgtcatctggaaaaagggacaatttgacttcctcttttcctaattgaataccctttatttccttctcctgcctgattgccctggccagaacatccaactctatgttgaatagcagtggtgagagagggcactcctgtcttgtgccagttttgaaagggaatgcttccagtttttgccccttcagtatgatattggctgtgggtttgtcatagataggttttattattttgacatacatcccatcaatacctaatttactgagagtttttagcatgaagtgttgttgaattttgtcaaaggccttttctgcatctattgagataatcatgtggtttttgtcattggttctgtttatatgctggattatgttaattgatttgggtatgttgaatcagccttgcatcccagggatgaaacccacttgatcatggtggataaggtttttgatgtgcttcttgatttggtgtgccagtattttattgaggatttttgcatcgatgttcatcagggatattggtctaaaattctctttttttgttgtgtctctgccaggctttggtatcaggatgatgttggcctcataaaatgagttagggaggattccctctttttctattgattggaatagtttcagaaggaatggtaccagctcctccttgtatctctggtagaattcggctgtgaatccatccgtttctggactttttttggttggtaagctattaattattgcctctatttcagagcctgttattggtctattcagagattcaacttcttcctggtttagtcttgggagagtgtatgtgtcgaggaatttatccatttcttctagattttctagttcttttgcatagaggtggttatagtattctctgatggtagtttgtatttccatgggattggtggtgatatccccttcattttttattgcttctatttgattcttttctcttttcttctttatagtcttgctagcagtctatcaattttgttgatcttttcaaaaaaccagctcctggattcattttttttgaagggttttttgtgtctctatttcgttcacttctgctctgatcttagttatttctcaccttctgctggcttttgaatgtgtttgctcttgcttctctggtttttttaattgtgatgttaggatgtcaattttagatcttgcctgctttctcttgtgggcatttagtgctataaatttccctctacacactgctttgaatgtgtcccagagattctggtatgttgtgtctttgttctcattggtttcaaagaacatctttatttctaccttcatttcgttatgtaccaagtagtcattgaggagcaggttgttcagtttccatgtaactgagtagttttgagagactttcttaatcctgaattgtagttttattgcactgtggtctgagagacagtttgttataatttctgtacttttacatttgctgaggagagctttacttacaactatgtggtcaattttggaataggtgtggtatggtgctgaaaagaatatatattctattgatttgggggggatagttctgtagatgtctattagatctgcttggtgcagagctgacttcaattcctggatatccttgttaactttctgtcttgttgaaatgtctgatgttgacagtagggtgttaaagtctcccattattattgtgtgggactctaagtctctttgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatctttctccacctctttattttgagcctatgtgtgtctctgcacgttagatgggtctcctgaatatagcacactgatgggtcttgactctttatccaatttgccagtctgtgtcttttaattggagcatttggcccatttacatttaaggttaatattgttatgtgtgaatttgattcagttattatgatgttagctggttattttgcttgttagttgaggcagtttcttcctagcatcaatggtcttcacaatttggcatgtttttgcagtggctggtaccggttgttcctttccatgttttgtgcttccttcaggagctcttttagggcaggactggtggtgacagaatctctcagcatttgcttgtctgtaaaggattttatttctccttcacttaagaaacttagtttggctggatatgaaattctggactgaaacttgttttctttaggaatgttgaatattggcccccactctcttctggcttgtagagtttctgcggagagatcagctgttagtctgatgggcttccccttgtgggtaacccgacctttctctctgcctgccctttaaattttttcttcatctctactttgctgaatctgacaattatgtgtctttgagttgctcttctcgaggagtatctttgtggcattctctgtatttcctgaatttgaatgttggcctgcctggctagattggggaagttctcctggataacatcctgcagagtgttttccaacttggttccattctccccgtcactttcaggtacaccaatcagatgtagatttggtcttttcacatagtcccatatttcttggaggctttgtttgtttctttttattcttttttctctaaacttctcctctcgcttcatttcattcatttgatcttccatcactgataccctttctttctatcgatcgaatcggctactgaggcttgtgcattcatcaggtagttctcctgccatggttttcagttccattaggtcctttaaggacttctctgcattggttattctagttagccagtcgtctaattttttttcaaggtttttaacttctttgccatgggttcaaacttcctcctttagctcggagtagtgtgatcatctgaagccttcttctctcaactcatcaaagtcattctctgtccaacgttgctccattgctggtgaggagctgctttcctttggaggaggagaggcactctgatttttagagtctccagtttttctgctctgttttttccccatctttgtggttttatcttcctttggtctttgatgatggtgatgtacagatggggttttggtgtggatgtcctttctgtttgttagttttccttctaacagtcaggaccctcagctgcaggtctgttggaatttgctggaggtccactccagaccttgtgtgcctgggtatcagcagcagaggctgcagaacagtggatattgctgaacagcaaatgctgctgcctgatccttcctctggaaattttgtctcagaggagtacctggccatctgaggtgtcagactgcccctactggggatgcgtcccagttacgctactcaggggtcagggacccacttgaggaggcagtctgtctgttctcagatctcaagctgcatgctgggagaaccactactctcttcaaagatgtcagacagggacatttaagtctgcagaggtttctgctgtcttttgtttggctatgccctgcccccagaggtggagtctacagaggcaggcaggcctccttgagctgaggtgggctccacccagttcgagcttccgggctgctttgtttacctactcaagcctgggcaatggtgggtgcccctcccccagcctcgccgccgccttgctatttgatctgagactgctgtctcagcaatgagcaagccttcatgggcgtaggaccctcaaagccaggtgcaggatataatctcctggtgtgccatttgctaagacctttagaaaagcacagtattagggtgggagtgacccaattttccaggtgccgtctgtcacccctttctttgactaggaaagggaattccctgaccgcttgctcttcataggtggggcgatgccttgccctgcttcagctcatgctttgtgtgctgcacccactgtccgacactccccagtgacatgaacgaggtacctcagttagaaatgcagaaatcacccaccttctgcatccctcacgctgggagctgtagactggagctgttcctctttggccatcttggctccaccccttactctcctattttctaatacaatttagaaaatgcataacactgaaggccttgtgaatgatgtcaccatgtgctttgtggttatctaagttggcgcagtttttcacttagcatcattgcattacttcctactatgccaaaacctagttgcgttctctcctatcctatttagcattgaaatagtcctagtggacgtgtttcagtatcagaggtggcaatcacatcttcagcttgctaatcattccaggaatgagcttcccataaagacgaaatatttggagctgttgatttctctctttcagaagtgggaggaaagcctgcagatgacccatccccattgcccattatagatgaggctactaaaggccaggggtattcagaacaaactggatgcagaactgaaacccgagcccaggtctcttggctaagctctagcactgcactatcctgccccccttgtattctacacttcatgctggagccctcctgctgcactgtctcaccctacacaccctcatcctgcacttcctcatcccatagcccctcattttgtactccttcccttgcacatctcatcctggaccccttcacctgtacccctcattctgtactcctcacctgtatccctcattctgcacctctcttcctggacccctccctctgaatccctcacccaggcctctcctcccgtactcgtcactgaacacctcatcctgtacctctcttcctggactcctcatcgtggactcctaacctggaccccctcatcctgccctcctcactgcacctctcatcctggactcgtgaacctgtttcccttgccctgtacccctcatcttcacccctcatcctacactccctgaccttcagctcacatcacaacctttttgccaaagtctgaagctgcctaacttcttcagtttctctcattctcagtctcagatggcacaaactttctttctgctcactccctttcccaagagaaaagcagaagaaacggagctccacatgctcacatgttaaagcaagaggtgatctaaaagaaacgcattggagctgagtcatcaaaaccgcatgccacgcctggccgttcctggcttagaggcaagaggatatgtacgcggtttaaaaaacacaggatgaatttcaagaatagaatagtcccatctataacttttaaatcagtaatgcaaaatatcatccatttctaagacaacacaattcagaaattttaacaaagactcttgttgagatcataaaaactcgtaaaggaaacagaaataccaaagaaaaataataaaggtaatgagaaaattgaaagcaacaaattccaattgaaaggaaaaaacctgtttgtaaaagtgggtccttgttgtatccgatgcagggatcccagtggtaaagatgtgggagaatgttatcacattcacacactcatggaacacatgagaaatgaggaaggcagccatatggctggaaaaaaataggaagctcattccaattacagagcctaaaatatcacctagaagtacaccttgttaatttcacaagctctttcataattcgcaaatatcattatcagaactttcattcttacctgagactaaaatacagattggagaacgtctcccaggaagtttgctctaacgtgagccccgcagcgcttaacctccgtgtcatttccactacatcttatctcagtttactttgacatgtaatctgtgaggatacatgttgggaagggagagtgcaatgtagctggagctaacgggccactaacactggaatttaaatgtcaaatttctgcgttagaatttaatgttctccggcaccacctgctctcctggctcatatgtgctgatatatttaaatatttaataatggcttatctcacattattaagaggaatctgtgcttataattcattcatgcaatataactcagaaaaaaatggaaatcaagagtcaatgggtcttctgatatttttcttaaagttaagactgtcctgaatgtcagcatatcttcatacaaactctccaaccctgtcaacaaaaaagggtgatgactggaaactcaatatctttctaatatatagtttgttgttattacttgtttgttttaatatcgtttcagtaaaatcctatgttcatcttattcgtcttgcgttaagacaacggaacgctagttggcctagctggtaattcacctaaagaaaacaatagcaacaatgaacacatataatctattaatttcagcttcaaacacttaattattaatatatttggtttgtaaatggctcttaatatctttggttactaaatggctcaccaagatgaagacattgtgtgctctgcaatggtctggagaaacaggattgaataaaatggggctctttctcaaggactcgaggacacacaaaacactctaggaaaactgttaccttagctaaaaaggagctgctgctggtagccacagggaaacattggaaggaatttccatcccagtgagctgtccaggagagaggtgcagctctcaagctgggccttggggaagggaagggttgtttcctacccgcaagggtaggaaggacccgcccggagagaagggaagcggcatgagcgccagtgtgggggagaacgatggatgggcacaggatggcaagcacacagcatgctacactgtgctacagcaccctgtggctcttgagaggacacgtgatctggaagaggggcagaaattcagtgacttgctctgtggtggctgcaccgtggtggggcacacgggagccacaggtgcacgaagaggctgactcatggaccagagtgagcagggtgaggcgaggagagacaggccggtgtgtccctcaccctgctggctgacgtggggcacagggtacacaacacagcggccgtaatatgacgggaatcgcacggtggatccttctcatacaacttccttgcaatgcagcaccagtgccacaggaatatgcacttttaagcccaccctgacctgaatctccgtctatgaagacccctgggtgatctccacgcatgcggcagtcggagacacggatgagagcagagaacatgataaatgcaggtacatgggagatctgtgcagaaatgcatccctttgccaacaggggaattcaaccaatagcagcagagcacccaccactgaagggtaactcccggacggtccaggggaggtggactcagagaaccagagagggcaccggatatacttcaggaattgggttccgaaaggtcatcattcagggacccaagcactcaagaatgaggctgccggcacatgaacagatttgggtccaggaatcagagcagcatcaacaaccagaaacagtctgtgttgactcattggctactgggctataattcctcaaacgtataaaaactcaactaagacttaaaaaaaaactggagtggtcctaagattattgataagggttaaatggcccatgataatgctacaaaaatctaaacagtccagaaactggctaagacactcactcacattttgcacatctctaaggatgcagctatacaacctgcagcttctgcacagctgcacaggtgtggggcataaagaggtccttgcattcccagagcttctgtctcctgggaagaaaggcaattaaacaattgttgggatggaggcagctcagggtggtataggattgtgtagcagcaaatcacataatctaggatgtgaggcttattggggaaagtaaactctgagatgagacgggaagatcagcaaatgatctacatggtgagtccatagaagaatgatccttgttggggagatacgtgtgcaaaggtaaaagagaggaaaaaaggaagatttgaagatcaggaagttccatgggacaaacatcaagtgtatgtgagtggtggtgagagatgaagatggaatctggaaaccactttacagaatattctgtggaccctgggaaggctccaaccaatttgaaacagtgtaggaacactctctatgttcatttttttaaaaaagataattctgactggacccctgtgtgtgagcaaaatagaagagtttagtagcggggagaaatgaagtttcgaccactacagaggccgcctagaggggacactgtggaagccgactaagggtaagagaatgaagataaacaggagggatgggatagaaggatatttactagacggaactgaccgaaattcgtggagaaaaagagaacaggatcataaaccaccaatgtcgctaagaagaaataacacaaaaacaataattataaatctgttgtccaaattctcaaagaatatagggagattattttccccggctgctagacaatgatgccgcactctgggtaagaacagacaatgctgtgatgtgagtcccaggtcaggaagcttgttctagaagcaaagagctaagcaccaggaaggcagacatgaccacttgtggtcccaagaatagaagggctagttttgtttcaagggatgtggagggcagtaacaataagtttgttctttagcatattaaatggaatggcagtcctcaggaaagcccgttgagaggatatttgaatttacagcacatgagttcatgtgacacgactctttcccttgcatgggcctcaccgcagactcaggtcccaccatcagatgcggccctcatcgctctgcggaactgaggctgctagagagggctcatagctgcacacctctcagggaagtgctcaaacaaaggccttaatttagaataaagaagaagatgcaagggctactgaccccgagacctggcattcctgccacagactgcaagtccagaaggcttttgctggatagaatgagggaatgcgcttctgaaggcatggctgaggagccagcttggagagtatgctgggaaggatgtgctgctgtcctctggatgtggtcttcaccctaaatccacggccataatgctgtgtcagtccccagaggctggaatacatggggccaggaactgaggaggggaagcaggagtagctgtctcacctccaccccaggagctgattgagatctctgctccccgatctctcaaattaggcaatgtggttgtagagaacctgcttctcagaggggagctgtctccatcagcaggaagaggaagggccccatgaaactgtaagctatccctgtggcccagcatcttccagatcctcatgcccaaggcctcaccagtaatggaagcagccatcatccttgcaggaggactggccctaatcaggagaaaaagctggggccattgtccccaatgagacaatacagatgagtgggacgatttatccatggggactctcttacgtgtgatagaacacggacaagtctagcagccacacctgagcagtgcactgtgagcagagaccgaggccctgtgaggacttgggtcagcatcgccctgctgcagaagccaactagcccagctgagaggccagctaaggaggcagatcctcacatgggccggacaggagggtggcggtgaggtgagtgtgtgttacacgtgttcctaggaaacgaggccagtcagaatcctagagaagctgtttccagatggagaatactgaccagtgctagtgctgggctgtatttgatcccaagggcaccatttgggtgctctcttcagaatccaggcccccccccccacctcccagctgctcgggacccacactgcatttcttttcaggaatcatcccaagcagtgttctggtccctccctgggggccacccatgtcaatggtcaatggcaccaagcctggcccaattgcttcagtttggaagactatacagtgccatcctagctccagacctccctgtagcatcatttaaggcaagggttcccaacccccaggccagggaccagtactcgtccatggcctgctaggaactgggccacacagcaggaggtgagcagcaggcaacggagcattaccacctgagctctgcctcccagcagatcagcagcaacattacattctcctaggagtgtgaaccctattgtgaactgcacatgcgagggatctaggctgcatgccctttatgagaatctaatacctgatgatctgtcactgtctcccatcacccagatgggactgtctagttgcaggaaaacaagctcagggctcccaatgattctacattatggagagttgtataattattttattacacattacattgtaataatagaaataaagtgcacagtaaatgcaatgcacttcagtcaccctgaaatcatcacctctcccagtccatggaaaaactgtctaccttaaaaccggtcccttgtgccaaaaaggctggggactcttatctaagaacctgatgtggtctgactgtttgtgtccctccaaattcctaagttgaaacctaacctcaaatttgatggttttcagagatgggccagcctttagagcgtgatgacatgatgagggtggagcccctgtgaacaggattagtgcccttgtgaaggatgtccaggcttgtggccttgcgctgtccaccacgtgaggacacagtgagaaggcgccatctatgaaccaggaaacggtcctcaccagacaccaaatctgccactgccttgatcgtggacttcccagaactgtgagagatacaattccattgtcgccaagccaactctatctccatattctgttacggcaacctgaatgaactaactgtgcacctgtcgtgactgggcactgttcaacctctccctccacccaactccacttccttctctgccttacagacgattccaagcacactcccaatacctcctgctacacaagtcaccaactcaggctctgcttccaagaaaaaggataatttgtcatagacttaagtcaagcccttggaaaaaaatgttaaatccaccttagatataaggctgtatgtgctgtgaaaaaggaggtacacattataaacgctttgtgacagtcaactgagcattcccacaacatgtaaacaaaaggttatttgaagccacgtcctgcagcttcaccttctctttagggttttagaagtcactactattctggcaggcactgtcttgtctgactatgaatagcgtattggcttcatgctcacaaggacaggggcatgagctcactttctacaaggaccagtgagctgtcctcggttcagggacagcaccctgtgccgtcattgcacttggacgctgttcaatgtgcataattgctcacctagagaagacgggcgagactgggctgggtaactcatgccagtacaaccacgcaagacgagaagcaccttcaagattacataacatcaatgctgtctcaaaagttccgtctgccaagaatggtaaagatgctggtttttgaaccatctcctacattcctgtattcagtacaacacacagcctcacttcccccatacaccctaggagcacagacccttggccacagactgagatgcctacacaaatttccattctcttattatcactgtattcatcggacgaaggagacaattccgtttcttgtatgaaatggtgatgctgaagtcaaataattttactggaatcactcttagtattagcccaaaataggtcttgttttgactatacagcagcacatcacaggaaacagttcctttaattcaccccctgctggaatgtaaatagctacggcaaattacatgaaacatgatttctggagatgcagttcatcaactagtgtgatgaactcgaaccgaatttttttttgtaaccaaaaatgcttcagagtcaactcactttactatagacagagaagccataaaaacgtgggaccactacaatagcaaacatgtaattgcttataaaaatatccagggatcaagtttgcttcttgttaacttcctcatggctagaagctgcagtggttatgagggaacccaactttcaattgagcatagggatttttctttattttctgtggactaacaatcagttgctatgagatatatattttattttcaaatataaaatggagaaactatgccccggactcacattatcttttcttatatagtattctgagatttactatttatatggattctatctattataaatatgatttataaatatataaataaatgatttttaagtatataaattatacaattatatataggtagaatctatatatatagcaaatttatatataaattgtatatgtaaaatttgttttaaaaatatatactagtcatatagagtttgcttatgaatggtcagtgttgctttatatggctctatcataattaatttacatcctgcttcttagcatttgggcttttgaacagattatttttaattcagtattttcatttgtaaaatggttttaaacaaagcttacctctctcccattactttctgacacttaacatgatctccctcaagagctctctttgttttttaaactttgcatttttttccccataatttgcttaggggaaattatcaattcacactctctctctctcgttctgtgtataatagctatagataatacacatgctcataagtatgaacaggcttatatactagggaatatgtataacacatactgtataacatacacatgccaactgaagtctagcaagagcgtttgtttctgtgaattgttcttctgtgtttgctgctggggcctcaccagcagggatccctgttgtttttcagtctctgagctcctccctgcctatcctccactcactgtgattttcaggggatgcacaggccctggttttcatttctccaccctacttgctttctgaaaaatgctcctaaaagggtccattaactgagtagaccctccaggcatcttgaggggatggaggagagaggattgtctttggggagttagagacagcacaaatggagaaatctcacatatgcccaagcctacgagcccgggaatgatggaggccacaggtgggtagagtggacccaaggtcctcctggtccacgtgtcctgaggcagccccctcaccattactgtgtgtgctggcagggggtagtgggggtgccaggaaagcatcctccagggagattttctcagagacaacagtgcccaaggtagcagagaccgtgaacatcttagggttagaagtgtgatccgaagatttgagggtccccgaaatattttacactactcaggctattcctgatttcttgtcaaggttggagtaggtaggtcagtaagggttgacatgggtggcctttggtaatgagtgaggttacaatgatagctactttcttaggatggagtctcagaaattcaagtcgatgttaaaataagatgatgtggcatttcttgcatagcagtttgtctagggtttgtagtctgagggactgactgtgactccaggtatgagagggcacacactgaaaatttctggggaaactatgagaaaatgtcgagagctgttgcctcagaggaagttaactggctcagctagaagctggagagaaggggtgcttacaattcatctaaacacccctcagttgggtttacatgtcttactgtgcacactattatttatataatgaaaacatcatgtttgtagaaaaaatctcaaaattaaaatgaaaatgcaaacagaaataagagctcgcatttcttaagttcttactccatgtgttatgagccttacatgttttactcagttgatttttcaataaaattatgaagcagttgtgattactaggacttttttttttaatgacgagtctgatacacaaagggtttaaataacttacactaaggttcagttactgggcagcagaaccagtattcaggggagtacagctccagagcctgtgttcctaacactagatgttagtgaaaatcaggcaacatcaaaacgtagaacatttaactctatgtgaatatatgctgtatatattttctgataatttttttttctttttttaagatggagtctcactctgttgcctaggctggagtgcagtggcacgatcttggctcactgcaagctccactacccgggttcaagcgattcttctgccccagcctcctgtgtatctgggattacaggtacccaccctccacaatcagctaattttttttttttttttttttttgtattctgaggagagataggggtttcaccatgttggccaggctggtctggaactcctgaccttaagtgatccgcctgccttggtctcccaaagcactatgattaaaggtgtcagcccccctgcccgggctgttttctgataatataatttatgaataactttgctttgagtcaaataatataaaattatgtatacgcataaaggtcacttttataagtgatttgcactttgtcttcaactgttagcttaatatagtactctggaaatatgcatttttagaatgtcttctactgttataatctcttaattttttaaaatcctcaaatgttgtattggttaatggttttaattacctttttgcctttggactattcttttgtcaaagataacacatgacattgaattggccatctctcaaggactgatggccattcacgtttttatgacatctcatgaaaagccatctcagggtggctactgagactcttaccacagcactaattagggtaaaatgtaattataattaatgtggtgtggtcattcactgtgaaatatgacacatagaagaatgtttaccttttattgggactacttatgtctcttcatagtcaaggatgcagtttgggcacgaggttcctctcctattcctggtaccataaacctcatgatgtgtatctcaatgctgctgagatgaatttactgcaatttgccctgttgggaagtgtctggtatttcactgatgatttcagattctaccaaaggcagcagcaaatgcaggtcatgtggaaaatatgatatctccaccatactttcctgaataactgcacagtcacataaaagttcaattgaaggtcaggtctaaaaattcaaacgtcaggaggtattcagcagttgcctctgcattctagttttagtcattgaaagggatgtaaatatacattttttgtcgtagtatttcttattcacaagggtcattaagtccccaacacaccccgtgtgtcagcaaggagggaccctattttatgctttgtagatgaggatactccggggtgggcccacacaccaagagaccctttaatattgtgaccctttatcccacacagagagagagagcagccaaggtgtggcgtgttcactcacatggactcatgacaatgtcccttaccatgcttgttgatttaggattggtggatgcttttttattatctccttcattgatttcatgggtaataacttcttgttacatttttcagctcctaaaactattcctatggtatacacttgggaaataagaacatactgcctatttactcaaattcaaaaagtagaataaaatacagttccaacagctccagataaatattctcatttttacctaaacacatacacatctatcggttcaaatactttaaggaactcagttaccaatgaaggaaccaataagatattttaaaaactatttcaaaggagaatccaaagatcacaactatatagacaatcagaaatactgaaataaacttgctaatccatttaaaagtaatcaatatccacaggacaataattaatgggatctttttcacaggaaattcatttgcatttcaatggttcagaaattgtttgcattgctatcagttttctataacttgtaaagttgtaaactagctcaaaaacaatgacaggcacagggctttcatttcaaatatttgaatttggctcataaaaatttataattgtaagtattttcagattcactatattgtcttttctatgtttgctcacataaaagaaggttttcagagacaccagccaatatgatatggtcaaaagatccccacatatgcccacacttcctagcttacacctaatacttcacctcactctttattttgggataatcagagcacatatcatggcaagccgagttttcagaagttaaacattctcattcacgaaagcgagtgttagtagactttaaggaagttcccgtcatgattcctatttatcagcattgtttgacttgttgattttacttctacctaaccaacacagaatgctctctgccctctcttggaatgctaacttccaaccctgtgaagtgtaatctcatcataccttggtaaacagctttaaacccaggtgagccaatgctatcatccgactgcagatgtagccacatctggttgctcatgctcacaatgaggtcaggaacactggatcccgtgagcctgcaagaaagagaaatgtcaaagcttttaggtaaggcaacaagtacatcgacttccacctgaaaggagggtcttgctgctttaaacagccaaaccctagatatataggtagcaagaccctctttcaaagactgtacagcctctggtccattatattaatattcaaacatcactatcactggtgctttacagaaattactctattctatggctgccaattcgtgaattttcttttaaaaaatcaatttagggcaatcaaccatcccattttcctggaaccgagaggcttccccaggtgcaggaattacaatgttacaactgggacagtcctggaaaaaatatggcacagttgttcatgtgaggtgactagagatgtgcacagttgctgtaggattgcacaacaccagccatgaaagacaaagcatctctatcacaacaaattgtatgggttcattcacaaaaggttttcattgtctagaactagtatgtaactttatcacaaactctccttttaaaatatattataggtaattatacattaagagaattttgaaaagaacaacatgcatagctgaaatagatttggcagcatttattgaacactccccccgcatattaatgtctgggtcacaccaaatgtgagtttcaatgaagcattcattgtgcattaacaaaacagtcacataggggctgctgtcagccagtgaaaagaaacactaaatccattgattgaactcaacatgctgacagaaaagcatgttgaaatagaaaaagtgtaagaagaaaatcaattcaaccaaaacaaatgtccctaatcaaataggaagcttgactttcagcaaagtagtttcaggaatatgagcatatgatttgccccatcaatcatatcatctgtctatcaaccctacatcctcaccttaggcagtacagagcaccggattcttcaaaggaagaagaacaactgtcattatatgtgaagtaactcatgcaatgttacacacaaattgaaaagaggaaactatttctgtgaatgctgtgtggttaactaaatatgtatttctttctgaagatttgtcttcgttggcaacattgttctttttcatttgcttgttttgttggcttgtttgaagagagatttttttctttctttcttattcatacatttattgaagtgtaacaagccaaaaagcgcacagatcgtgaatgtctaactctatgaatttttacaaagtgaaccgccacacagatcaacacttagacaattaccaacaccccaaagccttcttgtaccttctcccagtcaccatcctctcctcccatcttgccaaactatcagttttacatcttctttaaagtttttttgtaaatgaaatcatactatatataacattttgttcaacatgattttggtgaaatgtattcatgttattgtttgtagtattgtttcatttacttcaatttctacatagaatttatagtgtataaacacaagtaggggatgattaacatttctaaattcttgaaatttttattaagataattgtggatacacatgtggtaggtagtacaaaataatataaagagattacatgtattatttacctagtttccccgagtggtaacatcttgcaaaactataacaatcaggacattgacatggatacaacctaccagcctcgttaaaactttccctgttttattcgtattttgtatgtacatttgtgcatgtagctctgcacaaatacgtcacatgtctcggctcctgaatccaccgccatagtcaatgcagggcagctccattccttccaaattctctggtgctcttcccttaaaatcacactcatgcccctcttgctacacccccttcactgtccctaacccctggcaaccactaatcagtatccatctctaaattatttatttaaaaaaatcatacaaatgaaatcacagtgtttaacaacctgggattggattttacttagcttaattcctggaagatttatcccagttgttgtttataccaatagtttgttcccttttatcgctgggtagtatgtcatgttgtggatataccacagcttgcttaattaaccacctggtaaagggtatttggactgatactagttttggcagatgacacctaaagctgctttgaatatgtgtgtgcaggtttctgtgtgagcataaatcttcatttacctgagataaaagcgcaagagggcaatagctgcattgtgaaatcatgttgagtatttaaagaaactaccaaatttttccccagactgtttgtacattcccaccagcagtgtgtgagcaccccagattctttgtattctcaataggcattcggtgttgtcggcatttttccacactttaacagctacgtgcatttaactaatgggtaatgatgtacaacattgtctcatgggtttatttgccatttatacgtcttcttgaatgagaggtctctcttttcctccttttaaatactgaaaactctcttgatatattgtagtacagataccagtccttgtcagaaattagcagttttgatttaaatatagtcaattttggttccacatgcaattacaacaaattatattccataagtattagttgcagggctttctatatatcaagtttggaatctggcttagttccttccttctttccttccttccttcattccttccttccttcgttccttccttccttcatccctccctcctctccctccctccttccttcttcctctctccttccttccctccctccttcttcctctctccttccttccctccctctctccctcccttcttcctctctccttccttcctttccctccctccctcccttccttccttccttcttcctttcttctttccttccttccttccttgctttctgttatcattccctaagataagtgaatatataaaagaaaaatatgtatcttaagtcaaattcatggttttgggtagaagaaggaagaggaaagtaaacatactgttttaatattacacagttaaagaagaatgtgggcatagccgttagtttttccctacatgttaatacacacatggcacttggttcacatgcaaaacgagtcgaggagagtgttttcccttctccctttgggattacaggtgatgtcagcaccctactcatctgtgttccccactttacacccctttcactttgagacttatgccaccatgcaacatgactctactgctgtccatcatcgtcctctcccttcgtgtagcccctggcttgttgtcattgctccctgtgggcaatctgataatgcttgtaaagtgactcaagggttcttggctcttttaacccaataacttttctctccactctactgcaaggtataacatcaaggtgcaaggtatgaaatcactggtcataccttgcaccttcctactctttatcataacaaacttaagcacctaacccctcttgctgaccacactgcaacatcttttaactattgtaagtgtgtactttctgaaacacacttcccaattcttggggacctctactaatgattttgtcacatttttacccagcctggacaacatgattggtactctgctattctgtctttccagcaccttaactgtgttaaagtctactaccaatctgtcccatctctgacaaaactccaacttgagatcaatccaaccatccactctctatcttcctgtatgtgtgcacaagaaagatgatgaagaacttgctgatttatactgacatatatatatataaaatttccagactcacactagacacatggtgccacatttttttcctgaattatagtcagtgtatttttcctattgccatttgttattgccctaagtcgtcatcatttttctcaagcccattcccagcccttatttcttctgttctcagcagataactttactcataagtataagggggaaaacatttagggcagtcaaaacatgaaatacctgcctcttaaaatctcctaagttttttttttattcttttcatgtcaccagtcatcggccactagaagtaactgttgggggagtttattttcctcgtacttctttgatgtttttcacaccactgttttctccccatttccaacctctcagctgaacactgattatctcacacccaccccaccaaagtaggctcctaactctgtctcctggttctggcatttcatctcccctagacattcgacttgattttaacttactaaaaacgtaattgtcatgtaaaaaattcttacacattgaaaagacttatactgtctattcaactactttagacatacctctcagtcgatatatttaatttcttaagttctatactgaactttgctttaatttaatcttatattactttgttcatttgcatgaaacagtcagcaagcacactgccatattccacacaaagttcttcaatcaaatgtcaaatcaggtttatgtttattactcattttggaatttaagcctgctatgtgacagttatatttatgagaagaactgtaattacagcttattatagttattttaaagctgattaacttacaaaaatttcatacagtaaaagcactttttatttttaaatttttatgttattttataattatttaaaacaaaagaacttttgttcctctttctggtttttagaactattttggcttgctaacactgagatattatttctttaaaacaaagaagcaagcaatattgttgccctttgcaactggttatctgtttgaaacaggattttcaaaataataatacctgaaaaataaaatagatactggctttgattaaatacagtaggtgctcaaatgaagtcattttgttgaatgtcatttcattataacaatgatgaagaagatagattcctagcaggggtggtgtctgtatgggtgtatcagtctactctcacactgctatgaagatattatccaagacctagagactgggtaatttataaagaaaggagatttaactgactcgtatttccacatggcttgggaggcctcaggaaacttacaatcatggtagagggtgaaagggaagcaaggcacgtcttacatggcaggaggagagagcatgtgagggaggaaatgtcaaacataaaaccatcagatctagtaaaaactccttcaccattatgagaacagcatgggggaaactgcccccatgatccaaacacctccctcaacacatggggattatagagattacaattagagatgagatttgagtggggacacagagccaagtcatatcaatcaggttggcatgctccccatgtctgcctggacttgctcccaggttttctcccacatcccaaagctgtgcatgtgaggtttattggcattagctaatgagctggttggaaaaggaatgaatgaatgaatataaatcgtcaaataaaaatgtttcaagtatatgataatcatacaaatgcaggacaataaacaatgcaatagcaaagtgctcagggagctgtcacatgtgtaaatgtttttgacctctctcgggggaagaggttttcctgacaatgttttcttggcaaacaaacatttatttatcccttgatgtaaccaacctgcacccctatgaatgtcactcatccatccaccaaaaatttggtaaacagtaatctttcttgtcttcattaatctttcttaaaagtgtgtatagttcacatttacttaaatgtttaatattaggagtgttttggtctttatgcagaagtttggtcttgctttttgtgagcagaaatatgcttaggaacttaactcttgtttatatcaattagcctaaggggaaattggttttggtatacagagttttacttgaagtcacagtttccaaagacctattaatgatgttaagtgggaacttactatactttaacattcatcaaaacatatagttacacaactagtcttgctttctttaacacagctcaatttttccccaagttgactctatagtacatattgttctgatttaaacttaaaaataatgttatcctaatgaaacactaaataaatctatttttgatagaggaaaatataattttattttggagaaataagccatcatattgtagctgcctgccttttttgcccccaagccctgcagtgtaaaactctgtcatctcccaggcgtgttcagctccagccatatttatttttccccattctccagaatgatggcatttctccgttcccagggctttgcaaaccctgaaatccttgtatggactgtcaactcttcctgctaagctaagagtctttgaagactctgaggattctcgctgggcatttcttagcctcttgaagccagattaggatttttgcctctaggtcatcacagaatccttcacgcaattcagtttcacagaaaactgcttcaacctccaccttctttcaaattctgagctctctgggtgcaattttatgtctcttggccactttatccctagtctctagtaaataacataaacatttttaaaataaatcaataaataaaaatataaattaacctacactgtattcattatacagctacatgtttaaattttataggaatatttccaaataatgatgtaaatcttagtgttatgttaggcagcataccaagggcttaacatttggagttctgtgatggctctgtcattaattcacgtgtgattttagctaaatcattttatctgtattccaggttcctcatctatgaaacaagagaattgtattaatccaacctgaaggaactcttcagacctaaaattctgtgatcttttgcacagatttcagtgaagatactgctgtctcacattgatatgtctggttgcagtcagtatcgatgttgaactgaaatcaacagtgattatttctccaatttcaagtatgtgaagcggttaacccaaaatgaaggaaatgatatgtgattatgtatttgttcctgccttacaactagggcactttgtgagtacctttaactctttgagagtgtaactaaactctttccaatgcaaatgtgtcagtgttcttgaaagcttaatgacaaccataagatacagtaactttatgatgttttggttacttgtcattttactgtgtagacaagaacaatttcatctctgatcaaatcttccctttgcaccttgctaaatggttcaatagttctattctaatctacgtgaaatacatgtgttaagggctggaggtgatggctcatgcctgtaatcccagcactttcggaggctgaggtgggaagactatttgagtccaggagttcaagactagcctgcgcaacatagcgaggccttggctcaaccaaaatacaaatgcaaaaacaaaacaagagatggataacacctatctctgactctgaaatctttcatcaacataacccactgaaattcccatgttgttgtgtgtatcagtagtttgtttttgggagtaatgattttagttctcttataaaaatatacatgtgtttttccaattccctgtcaaagaatattcacaatgtttctattttggcaattatgaatagagttactataaacattcacatggtataaaatttttctagggtaaatacttaggaggtggatttctgggccatatgattgatgtatatttactatcatatgaaactaccaacctatcttccagaatggcggtaccacttggcttttccgcttgcaatctcaaaggttacacagaacatacatccattggtgtgacattctcacaccccaaaattacaaggataaataatgaatcagccaggcttggtggcttactcctgtaatgccagcacttttttgaggccaaggcgggcagattacttgaggtcaggagttcgagaccagcctggccaacatgatcaaactccatctctactaaaaatatgaacattagccaggcttggtggcagacatctgtaatcccagctacttgggaggctgaggcaagggaatggcttgaacctgggaagcagaggtcgcagtgagccaagaccgtgtcactgcaccctgagcaacagagcgaaactccgcctcaaaaaaaaaaaaaaaaaaaatgtgaatcagtaagtagttcagggtttaagttgggggagcctgtcaacacaaagggatactacagtattttgaagtgaagggaatgttctgtgttctgattttgctggtggttacacagatctatacatgtatttacagtcatagatctgtacacacagaaagttctactttactgtatatcacttaaaaataatttgttcagacctgaagaaaaattctgcatgtgtcacgaagctgtcaaaatacaacactaataaaatgtagcacctgcaatatgagatgcctggattttatgggtatgtacctgaattttaaaaaagggggagatgtgctaaacctttaatatactcattacagttgaaaatttgacaatggaaacgtaaagcctgcccttcagataaaaacttgcctaaaactgaactgctttgtagtctttatgttcctttaatgtccacgaatggcataaattgttcagaatgtggagaaagcagagttacttaattgtatgatttaagtgactacttgccttaattgggtagacacagggtgagctggagattaataaggataagtaaagacaaggtactatcttttcaggcacctgggtacctgggcagactcattcctcttgaggatggagtaaaataccagtaatgagtttcagacatgtgttgataaatatctctggtacaaattggcagctgcaaagcagccaggggcagaggaagaagtcaactcagttatttgataagccaaaccagaaggaatttaagctctggaaggccatatttgcactcttgggtctctcacatatcttcagatacagtattgaggaggtactgagagcaagtaaagtgagttacacgttctccacctacccagcacctagccgggttcccaggacatggtagttacagattccatgtttatttatatgatgtgtaccactgcagagggccagggcaggtggaaaagagcaggaatctgatttataaatcaagctgactgaaaaataagtcaagggagtgctttcattgaataaataatcatattattaaatacaatgttaaaactgaagataattcatacatatactgaagttactatcatttccccactggcatcaacatgaaattagaacaagctttagatttcatttactttgactcatgcacacgcctcactcaagtatggcagactttatttactgtgctgaaatccattacagccaggtggcacagaagatgatgtgacttaacatcaatcatttacaatcgctattttaaattcactaaacattatctgaattataaattgttcacgtgcggaactgcgtgaaaaagatgtaatccaaacctcttgatcttgcagatctaaggggaaaataaaagttgactaaagcccaacgtgatgctactttacagatttcctttactgagtgcagcccacactacttaaaagtatatggactgccagtcctcatgacatgcagatccttttttccttccccctctgtgtaaaacacaaatatcaggcctgataatggcacaagaagctaccagaagacactgctaaaatgtgataggagaaagacaagctggcctgggaccgaagaccagagaaacagcagagcatggggtgacttgtggccgatcacaaacagaaggccactccgacttgctgttttccacccctgaacaggcaacagaaggaccccagcaagcccgttccttctccagatgcaactgtgacccgtctgactaccagactacgcagcaccacagcaaataaaatggatgtaagagccacaccaacaacaaacatccaaggaagtcttcatgttccttgtggtcccagggctgccttgtcgaagaaaaaatatctaagaaggcagaacctgcaagagggatgcagctatataaatgatctcacctggggaggcccttcgtcccagtaggtgtgagactgagtctcttccccacccagacacagcggtagagtgggcggaataggtgacggggcactgcaaagagtggtccctccgacctccctcatcgcctcaccaacatctccccaagcccacccaaccccatgcactccaagcctgggaaatccttctgccccctcagccagcaccagcagaaagcagtggagactccttgggcactaaaggcactgagcagataaaagtaaacccttgaagcctccaatagtcaaattatcattggaacctcctccccagcccacaaaataggctgagacccacatgccaagcctaaacaaggtacttgcttgctaaaatattaggtgggtacaaaagcaattgcagtttttgccattatttttatttatttatttattttttagactaagtttcactcttgtcacccaggctggagtgcagtggcatgatcttggctcaccgcaacctccgcctcctgggttcaagtgattctcctgcctcagcctcccaagtggctgggattacaggcatgcaccaccatgcccagctaattttgtacttttagtacatatggggtttctccgtattggtcatgctagtcttgaactcccgaccttaggtgatctgcccacctcggccccccaaagtgctgggattacaggtgtgagccaccgcgcccagcctgccatttctttcaatggcataaatgccattactttcagtggcaaaaaaccacagttgctttttcatcaatctcataaaaaatataaatagtacctagcaatacctaacatgacacacaaaagagctgggacacaatcatcacaccaagagccaaggaaatcacggcttgaatgatgaaagacaatcaaccaaccccaacagaaatgaatcagagggtggattttaaagccaggtcgcttaaaaatgcttcagtgatcatttacaaattatctgcaaacagatgaaaaaaaacgataaatctaagtaaagaaataagttataaaaatgaactaaaaggaaattatggaactaaaaataacagaagagaaaactaaaaatagctagatttgcttaatattaaaattgaaatgagcaataatagaatcagtgaacttgagatcaatggaattctcctacactaaacaacagagacaaaacagactacaaatggaaaaggggccgggagtggtgactcacatctgtaatctcagcactttgggaggcctaggtggatggattgcctgagctcaggagttcaagaccagcctgggcaacacggtgaaaccccatctttattaaaatacaaaaaaaaattagctgggtgtggtggcacacacctgtagtccctactactcaggaggttgaggcagaagaattgcttgaacccaggaggcggaggatgcattgagcacagatcgtgccactgcactccagccccctggagcaatggagaaagactctgtctcaaaaataaaaaattaaaaggaaaaacgaataaagcttcagaggcctgtgggacaaaacaaaacaaaacaaatacacatagaaaaaagaatccaactattttttatcattagaattccaaaaggagacgagctagatgatggtgttgaaattatttaaaaaaataattgctgaaaacttaccaaatttggcaaaacacgtgaatttatagacccaaaaaaatctaagttaacctctcaaaaataaacctaaacaaatccattccaagacacatctaatccaagttttaaaaactaaagacagaaaaaacaaccaaaaagaaacaaaatgttacctacaggataaaactacttcaatgacaatgattttcccatttgggatcatggaggccagaaggaagaactgacaaccacaaattctatattcagtgaatctatccttcagaaataaagggaacttaaaaaaattatcaggcgtataatttgtttttgcaaattaagagtaggtggtaggctgggggcaatggctcacgcctgtaatcccagcactttgggaggccgaggtgagcggatcacaaggtcaggagatcgagactatcctggctaacatagtgaaaccctgtctgaactaaaaatacaaaaaattagccaggcgtggtggcaggcacctgtagtcccagctactagggaggctgaggcaggagagtgctttgaacccagaaggcggagcttgcagtgagcccagattagccactgcactccagcctgggcaacagagcgagactccatctcaaaaaaaaaaaaaaaaaaaaaaaaaccagagtagttggtagacctgcccttaatggttggctcaagaacattcttcttgaaaagaaatgaaggagaaaagaaaagaaacttttacctgtgttttcaaaagagaaaaaacaagaggaatctatacaatataaactggactattttgcttaccatgagttccataaatcttacttaatgattgaaacaacaattagaacagcgtctggtacttcagataataatttcaaaaagttgaaggggtaaagggccctaaatgcaagtgcagtttccatacttcaggtggtaaatgttcgcattagttgtagtaagataaataatggcctcactcctgtccaatcctgctctcactctaatccctcaaatctgtgaaacttacttttcagatgaaagattttgcaaatgtgattaagttaaggatcgaaatgtgggggattgtcctgaatgatgtaggtgggccctaaatgccaccactagtatccatataagagagaggcagagggagatttcaggcagagaagatggtctcgtgactctgaattcagagagtgggttgatgtggccacaagccaaggaacgccagcagctgccctaagctggaagaagaaagggatgaattcttccccagggcctttggagtgattacagctctgcccacatgttgatgctggcctagaaaacctgacttggacttctggtttccagaactgagagtacaaatttctgctgttttgagccaccaagtttgtggaatattctatagtaacagtaggaaataaatgtatcagtagactgttataagtcacatatgtttattgtaatgcccagaacaaccactttgaaaactacaaagaaatacatgaaatataccacaaacaggttaagataaaattaaaaaacaaaacttaataacccttaggaaggcaagaaaagcagtaaaaggggaatgagaaccagaaataaagaaataataaaatgccagacaaagcactaaacatatcaataattaccttaaatataaatggtctagatatgccactgaaatatcagagagaggcagaatgtattaaaaaattacccaaataatgaggcttaaaatatatgtcaaaatcaatgacccaggcatattgatagtaaaagaaacaaaagacataccatgtaaatattaataataaaaagcaggagtgcctatgttaatatctgacaaagtagacttaaggcaaataaaagtatcagagacaaagagggacaccacaaaataataaaaggattgacccaccagaaatatgtaacactcctaaatgtgtacaaaccaaatatcagagcttcacgacaagaagcaaaaactgataaagctaagagaaaaatagcaacctccacaagtatagttgaaaactttagcacccttagcaaacaggcagaaaatatcacaaaggatattcaatcaaccaacaggatctaactgacgaatatggaactctcaactcaatacacatgtttttcaaagccctatgaaaagctgacaaaagataaatcacaccctgggccagataatagatcttgacatattcaaatgaactgaaatcatagagaatttgttctctgatcacaaaggaatcaaactagaaatcagttattaaaaggcagtagaaaaatctctaaacatatggaagttaaataacacatttctaaataatccatgattcaaagggaaagtctcaagtgaaataaagaaatacatagaatgaagttaaaataaaaacacaacatataaaaatatgtgggaagcagataaaacagtgccaagaggaaaatttataacagtaaatgactacattagatagaaaagaatgaaaaaaattacttaagttcctacctcaagattctagcataagtaatgcaaaatagactcaaagaaactaggaggaagagtgcgatagaggtctaaattaatgaaatagaaatagataaacagtagaaaaaataacgaaacaaatattctctttcaaaaataatataattgatgaagctataagaacacttgcagaaagtcagaaaaagagaaagggagagagagatagaagggaacaattacaaataccagaaataaaatagaggctattactacagattcatcagccatcacaaagataataaggaaatattataaataactgtaaattcataaattcaacatattattagatataaactgatttgtcaaaaactattaactaccaaaactcaaccaagataaaacagacaatctaaatagtcctttattatagaaattaatggtataacatgttcaccaaaaataaaatcctcagacccagatggtttcaatagaaaattctactaatttataagtaacaattaacgtcaagatttcataaactcttgcagaaaataacaaaagagaaaatattttatagccattataatcttataatgaagatagtattcaactgataccaaagtcagacaaaggcagtacaaaaaagaaagagaaaactatagaccgatatcttttatgaatgtagttgcaaatatcctcaacaaaatattagaaaactgaatgcaacaatgtacaaatcaattatactcaatcatgaagtagaatttattccattttatgaaaggctgagtcaacttttaaaaaaatcaatcaatgtcatccaccattagaagaggctaaagaaagaacatgatatatcagctaatgccaaaaaagaaacatttgacgattcacaggacacatagtgttcatgagctgaaagatttaacatagtaaatatgtcaattttctccaaatttatcaatagctttaatgtaattcctatcacaatcccagcaatgtttttatacattgctgggagtatacatgcatatatgtttatggtactctcaaacttatatagattggcacctgccctagaatagttaagtctcttgacaaagaacaataaagtgagaaacatcactccgcctgatattaacatttactaaacagttatagtaattagtaatgtgtggcattggtagaagactagacacacatcagtgtaacagaacagagagctcagaaatagacccacacaaatacatctaactagtttttgatgaaggcagaaaagcagttcaatggagaaaggcgagtcctttcaacaaatgctactgaacagttggatacacgaactgccaggcaaaccgtgaacctcaacctctgtctcatgccatatacaaaaactaactcaaaagggataagagacttaaatgtaatatgtaaaactgtaaaacttttaggaatatgtatagaaggactcctctgtaaagtacagctaggcaaagaatccttagagttgacagcaaaagcactggcctttatgggaaagcccataaactagacttcatcaaaattaaaagcttttgccatgtgttgaaacccacatgaagaaagtgaaaagacaagccgcagactgagaaaaaatagctgcaaaccatgtattctacaaagcactaatatcttgactacacaaagaattctccaaacttagtaagaaacatccgcttagaaaatgggaaaaagacttagacattttgccaaagaggatgtcagatagtaaataagcatctgacaaaatgttcagtatcattagccatcaggaaaatgcaaatttaaaccacaacgaggtgtcattacacaacttttggagcagaaaaagtggtgataaaaccaattgtggggacggcgtgagcatgaggaccacttaacatcatgggctgtgatgttggagaaccatgctggaaaacagctgagcagtttcctacaaaactaaacatacaaccaacatacaactcaagcaattacactcctaagtaatttccaagagaaataaaaactcatgtttacataacaacctatacacaaatgtcatagtagctttcttcataatagtcaaatactagaagcaatccaggtgtccatctgtgggtgaatataaactgtggaacattcataccttgaaataccagccagcaaaaaacgggaggaaacgattgcagtacacaaagtccagggaattttgctgagtgagaagcaatcatagaaggtaacacactacgtgcttctaattatataacattcttgcaatgacaaatttttagagctggagtgcagataatgtttggcaggggtcagctttaagtgtagaaaacagggagttggctatgattattaaggaaaatatgagggaactttggggtattagaaattacctgtcttgactgtggcggatacaggaacttaaacaggtagtgaaattgtatagaacttcataacaatacacacacacacagagagagagagagagagagagagagggagagagagaaacacaaatgaatacaaataaaacaggaaattaaatgagctgggtgtggtggcgcatgctggttatcccagctactcctgagactgaggcatgagaatcccttgaacttgagaggcagcagttgcagtgagttgagattgtgccactgcactacagcctgggtgacagagcgagactcagcctcaaaaaaataaaataaaataaaataaaataaaataaaataaaataaaataaaataaaataaaataaaataaaataaaacaggaaatctgaataagatcagtggatcatatcaaggtgaatatcctggttgtgacattttactgtagatttgcaaaacatttccactggagatccggacgaagtctataaagatcccttcgtattaacaccaggggttcaatgagcgattaggcagcatttttttcctcagtgactatcgattcgagttctccttgtcttcacttggcagatagaaatgatatctttgtcacaattttgtcaagaaacaatactggtgcattaaatgacagttcaatctcctctttccttgtttctttctgttatatttcattttcaaatttgattctgaacatggcagaactctggatgttttattatattaagacagcgatgataactatagtaatacaatattaccttctccttgtactgtacttttaatctttttaaaactattttttatctaccattctatttgatgcaacaatccattgagggtaaaaggcacaagagagggagtcagggatggtgcactgtaaatgcatgcatctattgttttaatggacttatctccccaaaatagtagcatccttcgatgtttatttgagatgaaaaacaaacaataaaaatctttaaatgcttttgactgatgaattctggaagagattcctgggtcttttgggtctgtaaaaacaggcatgcattttttggctcctcagagaaaatagccacagtgagtctacacctgtgatagaacagccagaacaactggaaatgactcctgctgttcactcagctgcctggagcccagattagctgaaatggagcaccaccttatttgcagcagcagctgccctcgggctccgattcctgtgggacctatggcttcttcttccctgtaggaaggttgccctcaagacacatccaatgggtccccaaggtccctgactctgctggctttcccagatagctccactgcagctgctagcccaaatccaaaatgctgaagcccagtggtttgtttatccccctaccaacagggttcttggaagaggaaacccaaaccacacagggtgtccagagagatctggcaatgtctgaactgtccagtactaatgacgaaggttgggcagccctagccatcctgaagcttgctactcaatcctccttgatcctggggagttgatcctgaacctctcacacacagaaggtgacacaaaagcacttacctggcataacaacattctactaaccaggccaagtaaccattactacaggagaaggctaagagtgtactagcattatacagaaatgacttggttattccagtaactgggccgctctcttcagacaacagtgattgatgtattatcagcatacttttttatttatttagtttttgagacagagtctagctctgtctcccaggctggagtgcagtggcgcgatcttggctctctgcaagctccacctcctgggttcacgccattctcctgcctcagcctcccaagtagatgggactacaggcgcccgccaccacgcccggctaattttttgtatttttagtagagacagggtttcaccatgttagccaggatggtctcgttctcctgacctcgtgatctgcccgcctcggcctccccaagtgttgggattacaggcatgagccaccatgcccggcctatcagtataaatttaaggcagattttaggaatagcatatataaatcgatacatctagtcacaaggagggtattctacatccaccaaagtatcgggtaaatttggtgtataaatatttagaattcttaacgtttatctacttagaataatggaattgccagatagaattttcaaaggaggtgcctacaaacacattgtcaagaaggcgggtccctttttaatgctgaaattagctgtgaatgtttttaagagttcctggaagcttacaaattacactaagtgctaaaagaatcccatggaatattttgtgatttcccagaaatcgtaaaaatcctcaaggcattgctgaaacctcacttagtaacattaccaattttttctaacaagatcccatcaacattttgatattaatggttttgtttttaaacttgtttgcatcccattagagatgtgtattttatgagtaatttactttccagacacagaagactaaaaaaaagaccctacaaacgcaatcaaaatatacttagaagaggtgactttttttttctaaactcaaaccaaataaatgtttagaaactcatagtattattattattattattattatttttctttttgaaatagtgtcttgctctgttgctcaggctggagtgcagtggggtcatcatagctcactgcagccttgatctcctgggcacaatcgaccctttcaccttagcctcctgagtagctgggactgcaggcatgcaccaccacacccggctaatttttgtctttgtttttttgtagagacggagtttcatcctgttgcccaggttggtctcaaacttttggcctcaagtatttctccctcctcggcttcccaaagttccgggattataggcgtataccagcatgcctggccaataacatgtcttttgaccttttacattcaaggctaaaaccgatagataaatgtatctggaagatagtatgcttcttgcagtataaaatgtaatacaaaatttatagcagtattagcactcttactattaataatgtagattcatactgctaattatatgaaatgtatatcagtaggctaattcctcctcaaggctaggacaatggcttattctctctctgcctcctcgctgagtcctagcataatatttggcattcaataaataattatttaaagaatcaagcaagaacgcttccagataagaggccgggaaagaaaagctaacaatggatagacttcaagtcaagaacagggttcaaacagttgagtctgtctatactgtcactggcattcaggctcaaaggcagtgccattatgtgaaagataatatacagaaaaataattgggatcatgtgattccagagttttaagaatcttatttctatttggtttgatttctaatcatgttttctgatttttttaaaaccgaaaatgtatttaagtcaatatctttatatctttattaccaacatcaattgtttatgctttcccccaaggcactacatgtttagtgattaactctgtgataacattaaagatatataaagatacacacacaaatacacacgtctgtgcatagtgtctgctttttaatggctcttcagcagtcttttaataaaaagagaatgataccctttgactcaggatcagcagaaaacaacagggagaaatgacgtctcagccatgccaggcagtgtctgggagcaagaagtagattcagcaaaaatggattaatccagccctaagaaagaaccagtatcctgatttgttaatccacacatctggttaggcagaggctaccctacttgctcacagatgtccctaataatattgactattcattctcatagagggacgggcattttaaaactgtaacctgtgcctgccacccacagaacgtcctgaattaatgaaatcccctggttaccaatggctaatagctgcaaaggccagagggaatccagggaaggccatagctctccatgcagttcctccacaaatcaaattcgagaacagtctcaatagatgtacttggaaagaactcaacagacatttgcaaagaaagttacttaactttcttttaagcctgacattctataaatatgacccaagttccttcaaccacctctcagggaaggtggattacagaaggagtcccttcatgtttttattcttttatattgtgccataaaaattaacaaaatgagaagtcattgccagaaataagaatttttaaaaccgtatttagggtgagctatatagttttaggctatttcattttccaaatttctcttaaaatcgagatgtaactagaattccatatttcccacaaaatggaaacccacaaaatattgagtttgaagtagtgaatgccagtctgccatgaagaggttttaaactgctgctttatgtaaaatgtgtgtcatgtgatcctctgacttcgtatactgactagtatttaaactattccagtctatctgtcatttctccaattagatgatagactccatgctgggaagaatgtttgcatataagtactcaaaagtatttgtcgatgtatcgcctaaaattatctgtttattcaaagagactagctgtgattctctgtgttcggttatttttctgtgatctggtacactaaggacatatatcagtggcttttctttcctcttctgcagctgattaaatgcccagctgatcccggctgcattatgtttcccaaagggcatctcagtttgattcagttggctgtttagtttttcatttacagattcaagctattgagagaaggcgctaataacacttctgtcaatgtaatacatagtttgcaattgctttcttaacaacaaatagcattaaaaaatgagtgtatgattttagatctttaataataacctaagggatttcataaggcattacctgcctgcatttatattttaaattttgcagttatttaacaatttttctcatttattttagtgacatcctctcttaaattaggtgttttggtaataataatacgtgtgggttacatttttcagctctccggagtgtttgcatgcattatttcatttttctatttcccacaggctggaaaagtttattatacatattttatagccaggaaaagacaggcagagagaaggaaaatgacttccctcagggtcatggggatagcaaatagctggagccagaaactctatctttgacttgcaggcccctttctatccactgtagtgctgttcccaaccctgtcccaggtcaaaggcaggcagtgtgtgcgacgatcgccttagaagcttgcccaaaatatagatatctgggccctcagatgtaggactctgtttttaaaaataaaaagaaaaaaatttttttttacctagtaatttgtcaacaaaaaagagtcattatttggcaagggtgcagaaaaataggatccttcatgttccactgaggtttatataaattttcaggggggataattggagaaacgtaacaatgtaaatgaagatgcctcttcatccccaaattcctcaatggaaatgttcctgaaggtatagcaaaaaagtatgccaatgtctacatacaaagatattcacttcacagctgcttatagaagtgaaagaatgcggtgagagcgtgagtgtcagatgcaaaagactgtcaaagggaaccaggtaaaaagcatggtaggtccacaggcgataaagactcaagatcctggagcagtatcacatcactgagttggaatccctgcctcaatgtacactaggtttgtgaactggggtaaatcctttaacctatcaaaacttcagcttcatcaatgataaagcaatgatattattagacccaaattcccaggattatagtaaagatcaaataaggtaaaatgtattatgcatttaacacagtgcatggtgcgtaaaagatacataaaagttagctaggacattactagtgttattctcatcattattataataagttgtggtccagcaacatgatttcaattatgcttattagtaatagttggaatgggccagcaggaagataagctagagggaggtgttctcttgcaaaatgtccaagattcgacgaatgaaggagtcgtgtccctggtggagtcctcttctgggtccatcgatttttaagggaatatacagaacagttggctagtgctttttcaatgtgtgaattatctcataagtaatcaataaataaggggataaggtgagtataacagactgcatctttttactagcatggaaatatgggatgctacccggggcaagattcctcacaaatgaagagtgttagggaaaccagccccacaccacccggcgggtaccccgagtccagcggagacaaaggagttagaaagagacagaatgagagtttaaaaggcgggtccaggggacctgaggatccggaggcttgctcacagcccagaggtcccggcctccacccaatttattggtttacaagctctttgttctcagggcaaatgggaggggtaggaagggatgaggaaaaggattaatcagtgaaggagaacttgtgagtcattcaacaaggtgtatgtgaatttcctccagcaaaggcgtgtgtctgaactacttaagatctttaacctattgggactgaaacgggtgggcgtgggtttcaggagaagccaagatgtttgattattctccattgcttcagtggagtgttatttccccaagcaaccagtggcatgccgctgagctcttctgctctcagagcataaagacatgaaggaaataaggagacttttctcctcagaagccgcccatggctccccatgggtgtctcacatagggcagaccagctcatctggcaccacagaaactctctttcccacaaagaggcatcctcagtagtatataagtagacaaagaaagcaaggtgaacacctgcagaacactttccattaatgaaagacgcttctggtttagtggtttcaagatctacaacatgaagagaagctatctgtggagttgcaaaggcagataagagcaggtatttcctttctcttaaaaacagagaggaagtacaccctcaaatcattttcctaattttcataaaccaggtgtgataaaatggacaaaaactgtctttgaggccctctctctggaagtagctgaagcagatgcccaggtcataaggctgcagaacagtctgtgatcctggtgaaaactgagaagtgggatcagtctgcaaatattcacagcaaggctgtcaccgtgtttgctaagactctggaatcagagttcttcaaaggtacactgagtcacccccaacacttttcccccccatgtctgttactttattacgcagttttacaggaagtctggaaaggtgtatggcattattccaaaaaagacctgtatttcccagactagaaagcatctgtacctctttaaaaaccctgataatataacatcacagggaagcagaggagagaggttaaaaaagaggtgttggctgggtgcggtggttcacacctgtaatccccaacactttgggaggctgaagtgggcaaatcaccagaggtcaggagttcgagaccaaccgggccaacatggcaaacgcctgtctctaataataatacaaaaattagcctggcatgatggcacacacctgtaatcccagctactcaggagggtgaggcaggtgaattgcttgaacccgggaggcggaggttgcagtgagccgagatctgaccactgcactgcagcctgggtgatagagtaagaacctgtctcaaaaaaaaaaaaaaaaaaagggggggcggaggggttgatttgaaaaatttattgttttttgctacctcatgagtatactaattttttgccataaacatatatgtttttaataattgaagaaaaacagtcgaaacagataacacatactcctaaattatactcataatgtgttctcatacaaaatgagattgcaggccactacattagccatagatggcactaagcaaacacctgaggccgaattacaagcctgtagcagaatctcatctccacccaccgtgccccgcactgcatgcataagagaagaagaagctcaaggacatactcacacgtacaagaccgatctggtgtctcccaccttcccagcatcaccaaccgtcagggtgtcatagcctcgctccagctcaaactcttcaaaggcaagcttgatgacctaaatacaaggtacgaaacagtgacttagaacaacaggtacttcccatgacttttaataggtattgcaaatatctagttatactgttaaattttgctccttaatgccaatgtcaaatgatcccagagctgctttaagtagttacatggataattatatatatttgatagcctggcattatagaattttatgaaattcagaattgctattactcccaacttatgtattttcacctctaaaaatgaaatttaacctctgcaacactttaagccaaatatctactaaatgtttactttaacattctcagtgcttaactaaatcaatattagcaaaagaaatgttggttatagttaatgacatatatttttaccatatccagaatgctctgcaataaatatttttaaagttctatatgcatacttcatggaattatccatattagcaccccaaaagactttatgaggatacaaagctctcctctatatttagtcttgcaaagcctgtaagttttttgtttgtttttttacaaagaatactttgtcatgatgagcagcaccaagacatctgtacaacaatggtttatgtttgatgtgccagtatattataatctattaacttctttctgtagagcacaagatctttttctcctgaaagaagaaatgcttcctttggtggccaatactatgaggaagaaaaagttaggctagaaccctgggtagtaaggagaaaaaggaaagaagataaatacatgatgataattagaggaatgatagatagatgatagattagatggatggtagaagattagcagatacagacagattagatgatagatagatagatagatagatagatagatagatagatagatagatagatagatgacagatagtagatagatgacagactggatggatggatgggtggatggaaaaatgacagacgatacacagatacatgaatatataaatgagagagagagagatgtaacaagagagacgcagagggtgtgagaaaggaaggcggaagagagaagggacaggaggaacagaaaccataatactggaagtacattttaataaactgtgttttagaatgaaacagaaattctgaaatagcgtagaaaagtatcaaatgcctgtttgttaagcttgaaagaaaagagtaagtggtagcatagagaagacagacttcccactaatacccaagtccatgtccaccattccaacaggctctaaacaggtgcttttccaagcaatgccaaaaaggaatacattacatttgctacttgaaattcttactaaaattattaatatagccattataatttatttaaaaaacctactatttcaaattgcagtatttgtatgaatacattattttagcaatctcatttgaaataggtgtcgaggttgatagctgttgcaaaccagtataaatactgcatgttaaacgtagcacctgatatttttatttctactttttgtttctcatgaaccaatttataagtgaccatcatctgataatcagacaattttaaaactgaaagaatcatcactgagacctgctggtttcctttccgacatgttaactcagtcctgacttgtttaaagttctggtgggaagcgatgataattcattaaggtttgtgtgtcatgtttggctgatttgcaatgtgtacagataggggtcacactatatgaatgggctctcattaggggtggaaaaagggccattctgtaattatttcaagccaaggcaaaggtagacagagaaagtctttgtcagtatttcatctcaacaatcagcaggtcctgttgtcaaacaccaatctttactccacgctgctgatgctcagtaaaaacagaaaatgcagccttggtcttgcatagacagcttttagtttgtcatatggcattttacaaatatatgcagctgtaaaatagaagtatgtgtattttaaccacatataccatcctttcagagtaaaagaaccagagatgcaaatgaaaactgaagacaaaaggataatacatttcaagttgtgagcaactttaatgacattgagccaaaatggttttagttcctacagcatatgcaccctccttatgtcttgcatggactccctcagctgtcctggagctggatgctccatatttctttttttacatataattatcttatctttccttaagttccggggtacatgggcaggatgtgcaggtttgggacataggtaaacacgtgccatggtggtttgctgcacctgtcaacccatcacctaggtattaagcccagcatgcattagctcttttccctgaagctttccccaaccaatgttcccgaaataggctccgatgtgtgttgttcctctccctgtgttcatgtgttctcattgttcagctcccctttgtaagtgagaacatgcggtgtttggttttctactcctgccatttttcttaagtgcctgcttaatgttcctccctcagctatggctccactgccgactctgtccaagaaagccagtctctttgccaaaatcctgcctatccccttcataacattccctgtgttggcagttttggttggtttgctgttctgcctgccctgcagagctccctgtaaggattgagggcagacaccatgtggcttgctcgtggagggaagcactggcctcaacctacaagaactcactgaacatcaactcctccaggccacagagctaggagtgtttatttgaaatctttctacttttttgatataggtgtttaatgctataaactaccctcttagcactgcttttactatatctcataggttttggtatgttgtatttctattttcatttcccagcactttgggaggccgaggagggtgggtcatgaggtcaggaattcgagaccagcttggcaaacagagtgaaaccctgtctccactaaaaatacaaaaattagcctggcatggtggcgtgtgcctatagccccagctactcgggaagctgaggcaggagaatcacttgaacctgggaggtggaggttgcagtgacctgagatcaccaccgccactgcactccaacctgggcaacagagtgagactccgtctcaaaaaaaaaattatgtttaaattttgttcttaatttctttatagacccattggcctatttcttcatagacccattggacactcaggaacatgtttaatttccatgtattcgtacaattttgaaagtttctcttgttatttatttctaattttatctgttacagtcaaaaaatatacttgatatgatttagatttttaaaaaatttgttgacccttgttttgtgggataacatacgatcagtcctgaagaatattcataccatgtactgatgagaaaaatgtgtattatgcagctgttggatgaaatgttctgtaaatgtccgttaggtccatttggtctacactatagtttaagtttaacacttctttattaattttctgtctagataatctgttccatgctgagagtagcaggatgttcaagtccacatctattattatattggagtctatctctcccatcaataatgtttgctttatatatctggggtctctggtgttgggtgcatatatgtttacaattgttatacattatttttgtctttgtctcattttacatttgtttcactttccatttatttatttatttatttatttagacacagtcttgctctgtcacccaggctggagtgcagtggtgcaatctcagctcactgcaacctgtctcctgggtttaagcaattctcatgtctcacccttctaggtatctgggattacagggtcaatatacccagccatttcacattttttcacttaaagtccatgttatctgataaaagtatggctattcctgctagtttttggtttctgtttgcatggactatctcttgtaatgtcttcagtttagtctatgcctttacaggtgcagtgagtttcttataggcagtatgcacttagatattgctttttaaattatattgtcacttggttatttctgttctggttgttttgcacatcctctattccattctcattctcttcttggttatttttgtggtttggtggttttctgtagtgatatggttttacttctttctcatttatttgtctgctctaccagtgaatattactcttttgtgtgtcttcacaatggtggttatcaccctttcactttcagatgaagggctcccataagcatttcttgtaggaccattccagtagtgataaatttttattagcttttcctcatccgggaataattttattcttacaactctaatgtatagctttgctgggtatagtattcttggctgacatttcttcttcttttttctttcagcattttcattatatcaccctgttctcccctagcctgtaacggttctgctgagaaatctaatgttagtctgggagcttcttgcttatatttgacttgactgttttgtcttgctgtttttagacttctctttgtctttgaagttttttattatgtatttatattgctatatcaaggtgtggatattttggaggtatatgtggtactttgatacatgtatacaaagtttaacgatcaaatcaggagaactgtgatatccatcacctcaaataattttttcttttttctttttcttgggaaaattacaaaatcaccaggagagaaggaagaattgtctttgacttttgatagtttgattataatgctctttggagagcatctttggcattagatctgtttggtgatctttgagcttcctggatctgaatgcacatatttctccaaaaatttgagaagttttcagctgttattttattatatagatatcctacacctttctgatctcttctccttctagaactcccataatgggaatatttgtcccctgcattttgttccacacattttgtaggcattccttattcttacttattcttttttgtctgactggcttattccgaaaatcctgtctccaggttcagaaattcttttttcatcttgatctagtctgttgttgaagctcttgattttattttttaaattgtattcattttattattcagtttcaagacttctgcttagttctttttgtgtaatatctctgttgaatttctcattcagatcatgaattgttttcctactttttgaattgtctatttttattctactgattctcacggcgtatctttaacatcattattttaaaaatcatataggcattttgtagctgtccttttctttgggatatggaattagaaaatgattttgttcccttgggggtgtcatgtttcttgctttttagacatttcttgtgttcctacattagtatctatacatctgacaaaacaatttctcctaatattagaatgtagttttagtaggaaaaaactttttcctgtagatgtgtctcatagtgtcagttgggtagggtgctttggtttgtattctgcatgagtacagtagtgcagtcttcatgatatttatttggttgtaatcaatgtctgcatgtttgtagctgtctgagtagccttggctgcaggtgtttgtggaagtgttggttcagctctaatgcagatggagactttggggtggccttgttttggggatatagaaggtcacatgagccatctctgcttctcagtggaatgagttttctggcagtggttggcctcaggtgggctggtccttgggtccctggggagcatgtgtgagcattcagcaactccactgcttggagtggggggagtgttcactgctggcagcagtacccaaaaggccagtccttggtctcctgcaagaggcatatatccagggtgcttgttggtagtgtgcctcaagaattcagctctcagggtcttgggagcatgcactttggctccccctgtcttgagagtggcctcccgactctgcttgacgacttgtggtatagggtacttcatggtcttgagtgctgggttcaggtttgtgtcactgagtgcagctggggtcatagtcctgcatccttctccttggctgtggtgggatgatggctgcgttctcaagatgtggagatgctactggccctgtgggcaggatgtactctgatagttcttctgtcctgaaaatggcaccatgctgcagcagcctgaggcccagagaacaagagaggaacccggtgtgagttctctccccggagcaaaacagtcatgtgggctgcaggtagctccctacccttggctcagggcctatgaggcctgtgggggcttttctgaagccctgaatacaggcatctggggtgggagtgtgacctgctggggatctcccacttaccttctccctacaatcgggagtccttttttggcactgaacggatcctacctgcgcacttcacgttcatctttatgctgccatcttgagtttccatgccttagagggtcttctttactctgttgcttcagtacagtgttctcccctagacactgcacttgacatgtgcttacctacttgtcattttggttcctctttgtgaaggaggaaagtgctgggcactctagctagacatctcgatgtctgctaagctttgcatgacttttagacatttctagatggtacgtcaagccactgtggccagtgagcatttagaaaaaaacagtatggagcttgggagaggttcacgaccagacacacagaaatgggggtccctaaccacagatgccacctaaaatactaagactctgtcagagtatcaaaggaaggcacgtgaaaagaagaggaatgaggatgagctgcagtctctttcatatttagaggtcaaggaattgaggaagaaatgacaaagaaaaaagaatctgtggtagggaggacaccaagaatatggtgttttgtgaaaaatccataaaactaaagatcttaaggaggagggagtgatcacatgtgttgaatgctactaagaatgtgaattagatgagctctaagatgagacgtgtgggcttgactggatggaggacatggataaccatggcaagaaagaacagcagagttgtaggcatggaagaagcgctaaagtggattggcagaatgggatgtgaggaagcggagtaagtggttctgcagatctctcaggtatcttaactaacatggatgaagagaagtaagaatgtgtcagagaggattttttcttttaatggagaatattgcaagagaataagaatgattcaataagtatataaatgattttgcaggaaagaaatattgttgctactttgattcaaataatatgtattttccttgacaaaatattaatttataaacaaaatgaaaagatttcccaaaaatcaaaaataaaatatactatatagtttcaatttactgaaaaaaattcatttgatatgggtccattcaaatagagagaccacttctcctgattcagttaaaccaaaagaatccaaatatatcaactgatctctatgatctttgcctctgtgcatgtgcatacacacatgctcacacacacaggcacagaaacacacatgcacacacatacacacacaccccaagaaaaatgtatgcatcattgggtttcttccttgatagcactatttttaagtttttccttttgatgttcttccgtaaactacatttgtttttctgaataacatgtttgtgtcagaaactgtgatggcaggcaaatgaataggaaaaatattttataattttccaagatttagaactgacagcacaatataaatcagtaccaagaccctacatcttggaataagataatttataaatgctttaattaataactgtaggtttgaaattaatgggttagaaatgacaactcagaacacactggaaggaacactggaaaactgacgctataatgtatctgattcattccacttcaaattatgtatcagaagaaaggcctttcaaacagtgaatttcctcataaaaaacatgataacaagtttatgtctggaaattattaacacggttgcaagaagaacgattacacattttaaaagaaaatgcacactttcttagaaaataaatattatcaaataattttacttgttttcacctgaggttgtaagggccaatcataaaacaactaaaaatgtaattaatgataaggagacaaactgaccaaatatatctaccatagatactggataaatatacgtttaaatttcctacaaaagaacacatacaacaatcattgctgatgggaatgcaaaatggtacagtcactttggaagatactttggaagcttcttacataaccaactatatgcttatcaaataatgaaataatcatatatcttggaatttaacaccaacagctaaaaacgtatgtccacacaaatcccagcactttggaaggctgaggctggcagatcacgaggtcaggagatcgagaccatactggctaacgtggtgaaaccccgtctctactaaaaatataaaaaaattagccgggcatggtggtgggcgcctgtagtcccagctactcgggaggctgaggcaggagactgacgcgaacccaggaggaggagcttgcagtgagctgagatcgcgccactgcactgcagcctgggggacagaccgagacttcatctcaaaaaaaaaaaaaaaaagaagtatttccacacaacaaacaactgcacatgtacgtttatagcaactttattcataatcgccaaaattaggaagcaaccaatatgtccttcagcaggtgaatggataaactgtggtatatccagacagtggaatattattcagggctaaaaggaaatgagctgtcaagccatgagaaaacatgggggaaaactaaatatattttaccaagtgaaacaagccaattttagaaggtgacgtgttgcaacatttcaactgcatgacatttcggagaaggcagaactatggagacagtaaaaagattagtgattgttaggggttagaagagggagggatgaagagcaggagcacagaggatttttaggacagtgaaactctctgtgtgatgttataatggtggacactgactttatacagttgcccaaatccacagagtaaatagcagccggagtgagccctaacgtgcactatggactttggtaattcagcatgaatcaatgttcatcatgcatgaacagcatgaatgcatgttcatcaaatgtaacaaacacaccatgctgaaagcatctggtgaggatgcttacagtggggaggttgtgcatgtgtgggggcagggggtacggggaaactatgtcttctgatcaattttgctgtgcaaactgctctaaaaataaaacctaataaattaacaaaaattacacatataagcttttatatctgtatgcaacacataccaatagcccacagtatacagtgtgaaattacaaagactgaatttcaacctagaaaaaagtactttgaacacacacacccacacacaaagaaagggagttagaaaaatatgtcattaattctgggatatccttgctttatctgagatgtttagccccacatataaacactaggagtctcttataaactacaattcaatgcactgctatgaagaagaggattcacacattatttcaaatgtaactatatgactattagcctatgctacaaaaagtcaaagctgctagtgattcagggtgggaaataaagtttgcacaggcagtgaaaagcgcaattcctctaaaacacagcagtcttgggacggcggcatcagctggcaggaagccaagaaacttggtatttcatgctaaaatctcccagatggttctctggacctttaagtattactgacatccccgccctcagggccctgccaagtcccttttgtcagctttaaatggtacataaattaccgtaattctctttgtgctgccctgctacagagagaattagtctcagctcaagacagctaaagaagctggatgtcccccatccactggaaaggattcctgagaagacctggcttagttttccctgtctcagcccacctgtggtttcaaaatggcctaaaaagcagcccccctctttccttgccctccatctccccccatccccccttgcccccccccaacccccacactcttcctagcccctggtagccactgttcaactctcgacttggatgagatcaactttttaaacttccacatgagtgagaatatggaggcgggggttagggcgtggacaagaagtggttgattttggggtatgaaagtccagctagataggtgcaatcagttccagtgttcgacagcactgcagggtgactgtcatgaacaacaatttgctgtgtatttcaaaatagcaagaaaacaggaatttaaatgtctccaacacaaagaaatgatgaatgtttgaagtgatgaatatgttaattcccatgatttgatcaatgacacactgtataccagtattgaaacactgcatgtaccccataaacaggtacaattattatgtattaattaacaatttctttaaaaaaacattttttttaagtgaacaagtacaatcacactgacaaaagagagagtctgggctttgctgcttactcaacgagagtcttgaaagaattgtttaacctttcttctgtcttatccgtaaaatgagaatgatgccgatttccctgggggatttctgggattcaagaatgcagtgcaagcaaggtgtgtacttcttcttggcatccagcagacacttgatcaatggcagttgtgttcattattatcctcatggcaacccttcataaaaaccttgtcatgtctgccagacccaggcacattctgccaccatttgaagtattctgttatttcaaatctcacgagtctttataaccaagaaaaactcatctgtcttctctctgactctgcaatttctaactccaattttatctaaaatgacctcttatcttttgaattcccggcaaattttatcacctgcacccttccttctctattgcagtagtggtattttgcttctcttaagtgtggttttcacaaactacttagatgaagaaattgtggatgcttgaggagtaaggtgagattcattaaatttcaagagagtagcaagttgagagtcatgtgaaaatgatagtggcaaatgtggcaaggaaaatttctgaagcagaacccgtcaaaatgccagtgaaatgggcagagatagaaaatgcttaagcacaacaacaaagattaaccagtgcaccagggaaagtaagcaaacaaaacagtgatggagaaacagttaaaaaaaaaaaaagttttgctgcataagatgggagaataagctagtgagaatttcaggagaatttctgtaacccctgaaataaagtaacccaagcatcacaggcagatttcagtaaattattgaaatctgccctcagatgtatgaaagagggtagagtaagtattaaaaaatgagagactgggaatgtaaaagtcgcaatgcaataatggatatagaataaaccagaacactgttagatgcgataaaatgcagaattaacatttacatcaatcaaccaaagatgtgtggagtgaccgctgaaactttgaaggagcaaaagatgaaaagaagatgagagaaaattatagatcactacatgaaagcaaaagatattgaagtttcttgagaaataattatgggcgcagaatcaataattagaaaaataatggaagatacactttcacgactgattaaagagttgagaaggaagataaaagtgcttcattatggcccctgtaaatgaaataaagctgtatgacaataataggaatacgtcacctcacagaattcacactaacaacaccagaagaattctgtacacaaacccagaagaacaagcagattatatttgaggaaatacaaatcaaagttagttttgtctttttttggtagcataacaaaaccgtagaggtactggaccaacaacactatgagcactggatagaagggaaaacgatgttctgcttagtatgtctacttagcaaacaggctattttatgtgagaaggaagagaaaatatttacagatttttaaatgtctcaggtatcgtatcaacacactccttatcaccaacttggctgaaaggtgaacttcaaataataagattaatttaaaaaacagttacttaaggaggttctttacaaatacactaaaaagaatgatctccaaaaagttatgtaaaccagaaaggaagagggttgagtggataaaaatacacgtatgtatatttattcttacatattaaacaatataatttaacaaatgtagaaagggcaaccaagttcctcctggggttgagccctggggctgtgttctcataaggaggtgtctcatcggaggccaggtgataggtgcggcggccagcagaggaagtgccagggaggcagctgaaactcaaggactctgaacacccccagccccaggacgagctgtcagggagacggccctgggggagagggtgcaggtgagccaggctctatgtctggcatcatctgtcacagacactacttaagtgcctcagattcctactacccgctatttctagacatccaaagagacaaggaggcttgccggagtttgcatgctaacaagaacactggaggtaggggagtaaacacgtttttacacatgtgtagagaggagaaggtgccgaatgggtaagtactcacattctcaccactggtcatggccagaaagggggaataagttacttccagtcactcttccaataatgctctatggagcagcagttacacagatactttacgtttcattcattccctcatctttcattcatcttcaaccacgcctctaaatatctctatgtctcccaaaaaagcatgctaatatttttcttaggaaaacttacatctgcatattcagtaagtttctggaataaataaactccgaatttggggtgtcatgaagataaaagaaaggaggcaatgattgactgtataggagatttcgagataattcaacaaggttgctcatggttggcagtgatttacttcctccacacctggattttttaaatgcttttcaaggtcttaaattttaaaaacaccataaaactaaaataaatataaaagtgtaatgacactatttgatgtcggataatttgaaaataaatattggcaacatcacttaataaatgtgttgatgttcacacttaactaatttaggaagttttgcttatctttgatatagagtttctaatatacattttcatacaagatgttgtaagaattgaacaaacgtatataccaagtgcctaacatagagcttggtgtcatggttacagttttacaaatgataattactattattataaaaatcatagaaattgaataaacagaatttacatagtggaaaagtggtgatttaagtggtttagaggggaactcaattgtgaatcatcatgaaatctattttgtaacattaggtaacctatacaatattttttttgtagaagtaaaaaggaaaacttctgcctttactcatctcattactaagaatattttttagcttcatccatgtccctaaaaaggacatgaactcatcattttttatggcagcacagtattacatgatgtatttgtgccacattttcctaatccagtctatcattgttggacatttgggttggttccaagtctttgctattgtgaatagtgccacagtaaacatacgtgtgcatgtgtctttatagcagcatgatttataatcctttgggtatatacctagtaatgggattgctgggtcaaatggtatttctagttctagatccctgaggaatcgccacactgacttccacaatggttgaactagtttacattcccaccaacagtgtaaaagtgttcctatctctccacatccttttcagcacctgttgtttcctgactttttaatgattgccattctaactggtatgagatggtatctcactggggttttgatttgcatttctctgatggccagtgatgatgagcattttttcatgtgtttttttggctgcataaatgtcttcttttgagaaatatctgttcatatcctttgcccactttttgatggggttgtttgttttttttcttgcaaatttgtttgagttcattgtagattctggatattagccctttgtcagatgagtaggttgcaaaaagtttctcccattctgtaggttgcctgttcactctgatgttggtttcttttgctgtgcagaggctcttgagttttattagatcccatttgtcaattttggcttttgttgccattgcttttggtgttttagacatgaggtccttgcccatgcctatgtcctgaatggtattgcctaggtttccttctagacaaaaaaccaaacaccacatgttctcactcataggtgggaattgaacaatgaccaacctccttgtctctttggttgtctagaaatagcaggtagtaggaatttgaggcacttaagtggtgtctgtgacagatgatgcaagacatagatcctggctcacctgcgccccctcccccagggcaggtgagaacacttggacacaggaaggggaacatcacacacgggggcctgttatggggcagggggaggggggagggatagcattaggagatatacctaatgtaagtgacgagttaatgggtgcagcacaccaacatggcacatgtatacatatgtaacaaacctgcatgttgtgcacatgtaccctagaacttaaagtataataaaaaaaaaagaaaaaatagaatattttttaaagaaatactaaacactaagaatgaaaagattcagatgaatgaactgagacacttattttagcgatgtgtgagaaaattttaaaatcactgatttattcaatcactccttcagtcggttttattgtacttccagcttatctattatggaaaattttctgcgagttttatgtcatgaatattttaaaatttaaaacaaataaaattatcattctatttagaccgaatagaggacagaacgcctccgtaatgctccaccacctacgcttttcccattatggaaagagacacatcagctgtcactctcctacactgggaaacggtgacaaaagtgaccagttagagccatgagacaggaatgatccatggacccttgcacataaatttttaaaagtctgagaacttaaagtcctcatgcttagtatttctgagctcagacttaagtgagaatatctcagtgcaaatcccagctttgtctcttgcaagctatctgaccttgggcaagacactgtatcagcggtccatgtgccagtttcctcctctttacctggggacaaaattaatgcgtgctcagtaggattcttatgagaatttactctaagtattcagtagataaggtcaactcaaaagtttctatgtcaagaaagtgattggtttcggaaatctgggcaattagagaaacaatattatctggacccctttacaaacacagagatgaaaggagattaaagcatggacaatgactaaaaaatatatttaagcctttcccccacccatagttatagtaaatcattttacgttcactgtttctttagccaagtcaactttgtcataagaaaaaataatccattgctattaaatacaattttagacaattttctcaggacaatgttttggtgattctgccttctataggcaaggagtcttgcacaagtcgttgaactatttttcatttcagcttcctcatctttaaaatgaagaaggtaggctattctaccaagattgcctctaaattttattcaattccaattttctataactgtttctatgttagaagctatatctagtggatataacagatctaatctgggaaagggaagaagctataagatatcatcaacctaacaaaaagaaaacaaaagatgcttaatcatcttcaactgcagggctatttgcttcctattaattaacagaataatcagagtgatattttgttctagaatccaaggggtctgcttgatgccttctgtcctggagcacacgtctgtcagcccaccagccaggtgtgaggctagctgttcaggaagcaattatcaggttggacccaactctgtggccatggtaaaggggaactcatgccccagtgaagcgatgagggcaacgcttaagttgctggcatttcagcctctcccatgtgcagtttcttacttggtaagtgtgtcaaaaaattgcaaatgcatctctccaattgacgtatacaagtcgcgtatccacttctcccctctacatcagtgaaacaccggtaaggataaagaaaatgaattcattaggagaaagtaaatgattccagcctgaacataaggacatgaattgacagagaatacatatctgtgtatatgcttttgtgaaaacactgaggcaagtagggtgtgctgtactgtggggctggacatcagggagtcggcaggagaagtggccgactcctgccttctgcgccgcgtcccttgcctgcagcccaggcttctcactccacatggcctgcctctgtcttcccattcccgtcacaggaaagagcaacacagccggagcttgggggaggacagtagagaaagcacatgggtacttgaagtccaaatgtcttttgagcgcaggctctgttgctgatttggcctggcatggggtaagttactcagcccagtcccctcaccctcaatatcatcttacagggtctctgaaaatgaggtcttaggaaagaaaatcttagaaggtctttaaagaggtcaaatgaagcaacatttgtcacttgcttaacacattacgtggcacaaaataatgcctcaaaaaatgctggtgactctcttgcagaagaataacatacgataaaaaaatcacatttcagattatgtaagatatagaggcaggattactttttaatgattgccattctaactggtgtgagatggtatctcattgtggttttgatttgcatttctgtaatgaccagtgaggatgagcttttttgcctatgtttattagccgcataaatgtcttcttttgagaagtatctgttcatatccttcccccactttttgatggggttgttttttccttgtaaatttgtttaagttccttgtaggttctggatattagcccttcgtcagagatacatgcacacgtatgtttactgcagcactattcacaatagcaaagacttggaatgaacccaaaggcccatcaatgatagaccaaacaaagaaaacgtggcacttatacaccatggaatactatgcagcaataaaaaaggatgacttgatgtcctttgcagggacatggatgaagctggaaaccatcactgtcagcaaactaacaaaggaacagaaaaccaaacactgcatgttctcagtaataagtgggagttgaacaatgaggacacaagggcacaggaaggggaatatcatacaccagggcctgttggggggtgagaggctagggaatgaatagcattaggagaaatacctaatgtagatgacaggttgatggatacagcaaaccacaatggcatgtgtatacctatgtaacaaacctgcacgttctgcacatgtatcccagaacttaaagtattaaaaaaaaaaattccttaactggcatgttatagatttggaaatgatctgtacctatcctccaaaagaagagaaggtttactcaaaatctgtggccagccaggcacgttggctcacggctgtaatccctgcactttgggaggccgaggcaggtagatcacttgaggtcaggaatttgagatcagcccggccaaaatggtgaaacccctctctactaaaaatatgaaaaaagattagctgggcatggtagcagatgtctgtgatcccagctactcaggaggcaaaggcaggagaatcccttgaactggggcggtggaggttgtggtgagatgagatcactattgccctccagcaggggtgacagagtgagactccatctctaaaaaaataacataacataacataacataacataacataacataacataacataacataacataacaataaataaaataaaataaaaatataataaatgtaatatgcaatttatcgccacagaatttgcgtttttgttagaaagtcaaattaaaaaaaaaaaaacggttgttatatgatgatttttggtaaaagttttcacctgcagttttacagtcacagtgaggactcatgagtttacaacgtttcatttctccaggccccgctccctgggcattccccatcaccgtggatccactatgtggccctagagagttacttttactctgtgatttgacctcctcatatttctcatcctgcctggactgtggccccaaccacgctcatagcaccaaacatgtccttggcagaatttcttactatcctggcacagatgagtctgtccacctaatttaccaccgctcctcgcgggtccacgtgcagaaccatgctgcattctcatcttcagggatggactggaagcattcttgaagatgcagtgctgagtttagcaacttatttgttctatacccacagcctcagcctctcccctaatacagacttcagctcagaaattcaagattactcgtgtgtctctccccatagacaggcttttggtgcacagaatttgatttatgtatttgtaatcctgagcaatgtgcccatgacacctaaggatgctgtaagaggcactgaaagaatgaccacatgaacggctgggctggtgggctggtgggctggtgggtgagtccacagcagcaggagaaatgaaccctctcctccaggagcttactttaatttttttctttttttttttttttttttaagacagagtcttgctttgtcgccaggctggagtgcactggcatgatgacatgatctgggctccctgcaacctctgcctcctgggttcaagcaattctcctgcctcagcttcccaagtagctgggactataggtgcatgccaccacacgcaggttttttattttttactagagacagggtttcaccatgttggctaggatggtcttgatctcttcatccgcccacctcggcctcccaaaatgctgggattacaggtgtgagccactgcacttggtctttttaaggaggaagatgtaacacgtgggcccgttgtataaccatagagagccacagatagcaaaaatatagaaagaagtctccgtccctatgaaaggcattagcatgcttgaaagatcatttaaaaatacatttgaggttttagaattttccacttctaaaacggatagctgtgttttcatggtcattgtctagccctccttggggtgaatgcattgaattattattattatttttttttatatgcctttatggattcagctacaatgcctagactttactctggcaaactttgggaaaaaaatagttacatactaatcctccaactttaataaatcccctagttttcccctatttggaaattattttgttttttgtaagaggagtattttctgagtgaagaaatccataggtaagtcctggctttgtcacttgcccacagatttttttttttttttgagatggagtcttactttgttacccaggctggtgtggagtggtgctcactgcaacctctgcctcccaggatcaagcattctcccgactcagcctcctgaatagctgggattacaggcctgttgtgggatctcaccttgtgatcgtgtgagtcaatactccttaataaaatcctctttatatatacacctatcctgttagttctgtcctttgggagaatcctgattaatacactaatcctacgcaatgccccagaaaacatggtaagacttactgctctgccaccatcatctaagacagtctaccagccaatatgccagcaggtccacaaaatatagacacttggatatgtaagtctactgccctcatagtctgtgtgttagttaccataataggtcagctgcagagtgcagcttcaccaaacacatgagagatagacagcattttaattacgtaatagagtacagaataagaaaactgcattgcagatttggagagaagatcctggagtatgaaaaagtagataaacacacaaaggttataaccacagaataattcaggccagaacataagaaggggccattagaagtgagagtaggtacttgtaataagaaaacagagaaggtagcagattccaatccaggccttctttttatcgtacagaaaaataattttcttataatagcacacagttctcttaggaacaccctgtgttctttagtttttcaaagcatcactcaatcctcttctcttggcagataggaggctcaaatcaatctctccgtaatcacttctgtctcccaggaagctgtcatagcttgttccccaatccctcatgaagacatgctcttgtgtaaaggatactaaataagaccggctttcttagagtctctttcattttctcaggaagccattataaatggtgcaacatagagacgtcctcagtgcattgcagctagtagatatttttggctaggtggctgatctccctggtgatgttgtaagtcttcaggtactgcacacctagcaatacaacatgcaatctcttggaatgattacataatgtcttgcaaatgtggtgttatccccatctgctcacgggtcatccccactgaagaacccaggcttcaatttttggaattgactaaaaatggctttaatgacaatcacttaaaagtaatgtttcacaaataaataatatgttatagttgggggaatattcctaaattctatatttaagtgtatttgttttaatgtgactcactacttttttcagtgctagtcatatataacccaggctacatttcaaattttttttatcatatttgtaggtatcttttgttaatatcatttgaagctgaaccatgatattaatactattttttcagtaaaaataattgccttcataatttatactgcacatgatcctttagtgattaaactgtaacttacagtgggtacctatattattaacacaaacaacatattgctgataatatctaatgactttttaaaaaatcagagaaataaaataaattttattattgtttatatctatatgctaaaggctgcccaagcaaatgtatttgaattgataaatattattggaatatatcaaagtgccttttaaaaacaacattttatactgaaattaaagcctaacatttaatcaaatttataatccatcgactatattcgacatctaacttttcaaaataataatacagttaatgaacattttacacatttaaaaaatcagtcattaatgttataattcatcttgaatacatgcgaaggatcaagaagtagtcatgaaagtcctactctctatgaaattttaaagatttgaggaaattaaatgtcaagtacatttgacatcctatttgtccttaatataaataacagcactgtacctgctttttctggagtatgtggtgtaaataatgatatctgagctgatgctggcatgctgttccgtgcactcacacagctacagatcaccactgtgcaagatcaacaaaaactaaggctctttatgatcttgaaaatgttggtgaagtttagacacttggtgacaaatttgctaactagagatttgcaagagaggaatacacacaattatttccttgtttgttcacaagtaccactggaaaaataaaaaaatggttggcaactgttcaggagaatgagaaagcaggacatgctctcccattgccgttttcggaagtttagaatgtttccaacagaaaacttattactgtggcacgtgtacttggcaggccactggaaatgtggccaacttgcaacagaccaacttggaacaagtcaatcatcacatattctaggccaaaatgaagaatgttattcagcattcattaattcaggtgtatgccttccccattgacttcatttaacaactactttctgaacatgtaggaagtgtcagtcatgacactgggcaatggaattgcctattatacatacggaaagaaaactggacttcagcgtggggaaaattaacttctcatagcatatcttgaaatagtgtttggttacagcagaaggctaaaataatgaatactagtatgtgtttgagtgacgtaccaaactgttcgttgccagtcaatgttctaaaggtttaaaattagtaagtctactcaattaactcaacatctctgtggagatgatcctattagaactccctactgtagaactgggaaactggagctcagacagcctggttacttgagtgtggtctcacagaaagaggaggaacagaatgtaaatctatgcattttgatttcaaagacaatatccttatccactaatattgtctccaaatttgaatataactgtcctggaaagggacattctgcagcacttgcaaaacctaagactcaccagctgtgcataggtatggagctccagtaaatgctaagttctgggattataaagaatccaaagaaggtcaacatagcagatgaatagacttcttccaagttgcaagacagcttagtataatagaaaaatactgggatgtgtcaaaagccctggaatgcagactagttttcaaaatcgtctagccaggcctggttgagtgagtcattggagttgccacttcagtgtctgtgaagaggctgtagtatctatgctactcctctcattacacctttgtgagaagcacatcacattatcaggtcatgtctgcttgaaaatctttcagtggccacagaaatttactcaaagtttaagaggatgtttatttttgttgttattgtttttaattttaattattgtgtttttctataatgtattggggtacaggtggtatttggttacatgagaaagttctttggtggagatttgtgatattttggggcatgcctcaccacagcagtatacactgcaccttatctgtagttacataactaaaagtagaactaccatttggcccaacaatcccatcgctgagtatctacccagaggaaaggaactcattatttgataaagatacttgcacacacatgtttatagcagcacaattcacaactgcaaaatcgtagaaccaacccaaatgcccgtcaatcaacgagtggataaagaggatgcttctgtaagaatgagggtgaaaacacagaaaacagggcactggttaggtgtcatggtgagcaaaggagctggtgtggtgtcagatcaaggggacactggaaccgacagctccagggaaggggcatctggcggccttctcaggagaggaaggaggccatggtgtggctagctccctcctgcagtgtgctcctcatgctcatcccttctcatgcctgtcaccagatgtttgactctctttgcatctcagaattgccagtagaattaataaaatctgtgattagagggaaaacttgaaaagacacagagttgtgaatcacaagagaacaaaagatggaaagaagagggctggcagagaacaggcaatccaagtaaaatttaaggaaacaagcaaaactatagtggtgttattaagtgttttaaggaagctgataaacaatccttagtatccaagcaaagagagtcctctacactccaacctatgcattgatttccaaattgccagtgaaatttgcaggtaaagatagtttgataaaaaatacttagaaaatgtcaggttccaatgtcacacaagtccctgggagaatgggaggagaagtctcattccacactgctgtcctctgcaataccaaatacaggctgagggaataatatttactatacgatttttttggggaaaaaggctttctgaaagaattttggtctagctaacacaatttttcacttgtagacacaaacgaattcagtcacattttttgatagtataactcatagggctgagagattaattaaaatgaagaattcaaggctgggaaatttgtaacaaaaaataacgagcagaattcccttttagtctatgagaagaaacacccaacgacccatcctagaaatcctcaactgcaggcttacaaccccattcttaaaggagatttaaagaaatgtgaagagttcggggcctccttccacagttaatagcttcaacaagtcaaatcttcatgaattattaaacctcatcaataaataatcatataaatcatgtaggtgaacttaagaaacaactctagaaaattatctccctcaagaagatttatcatcagattcaagtgtttagaaaatgtgattataactataaaacaatatgactatagattataactacaaaacaatattaactatttctagaaaaaaaagaatggaaatataccaaaatgttgtatggttattagcgaactatggaccaatgattacttattttttaatctttttgtagttttaattttccttcataaatatgtttcttcaaataagagaaaattatataagagagaattatttcatgcagccaaaagctgacgcaaattcctctggagcttaaatgcaaacctgcgtaccaacatcatataagaaacaaccatttaattgtaaatattccagatgccattgtatttagaaatagacggagacacacaaaaatctgcttttaaaattctgacacatagaaacaatattgcttttgtaaaatctcattggtagactcaacaaagaatcagaaaaatgactaaaatgatcaatgattgccataaagtaaaatgcagtatctatgtgaaagtaaattagaatgcaacaatacagcttttcaaaataactcagaattgggagttaatgtagggtatcaaaaatgaaaggaagaaacaaataaaacaaatgagaaacaactaatcatgccccaaagaataatttaagtaagtagttggtgtggttttcaaagtccttgaggaatgtggagaagaacagttcattacatgctctgtttgttagaattaattactagatggaactagacaccatgcaaactttctataaatcaaactaataaatattattcacatcgccagtcatactataacaagacagtcctatttacagtgagtccgtaagacacttatcctgagagctgttgaatctcctcatattgtcccttttatttggtttcaacacaacaatgttatgtagcacttttaaactgaaatataaatgatctgtttttaaacaatttgcaagctaacttctgtttctatcgcaacattttaaaaatcctcttaaaaccagagttaaggaatttgacttttgtgcctcactgtcccctgtgcaaatatttgggtactgcacaacttaaaaagaaaaacatacctatttaataagctaaaaattccttaatcctgaacacgtgattaattatcactgaagggcaaaattaccaacactttttctttccctgcatataaacattttgtcctgttcatatttttctttctgaaaatacctgagtcttcaaattcaaaaacagcttctactgttagctccaaccccaaataaaaatttatctgcagaaaaagaagtcaatcttgaaagggtttctatggattatgcatatcaattcactagtctggtaattgcatgctggttcatgtaaaagatgaagtttcttgatcatctgagaggaaacacaggctcacaattgagactacattcaaactccagccagcttgtctagtatacagcacagtgtcagaaagctcattttgaccttccccgccatgaggaccaatgagtaccttggtagagactaccttcaaatcagaaagggatgaggcaatgtgccactcagctatctgtagcacatgcatacgaaagcttatcaagcagcatgcaggccatggctgcttcattaatttaatgaataaagtggtgcacgctatacaatggggttgtgttttctgtgatatgtgtaaagatagaaagttggctgtatggaacacttgcatcatttaataataaattaactgctacattactgttacctcttcttaccatggtatcaaccatcccatcaacctcccactaaaatagcaattattttactcaattaatacatttatagtggttttctacagtagtttacttttataaactcaacgctaatataatttcgctgaaagtcaggcacacttttttaaaacttctttatctgtgtgcatatatatgtgtgtgtgtgtatatacctatatatatatatatatatacacgtatagttgtgaaacttgctccacagtaataatagtaaaattctatcatttatgcttcttaaacatacttacaggcacagagaaataatttatatgagaattactgttaagaaaccagaaccgagaagaagagaatttcacttaaattataatttttaaaagtacttcataactatatgtagataagttgattataggttggccagagaggaagcaccataccaaacttgaagtttcaacctcctctattccaaaatgttgaagaactggctttgatatcagtgacataaactgcagaagaatattttgactaataattatgatcctcaaaaataaacacttcaaccataaaaagtatatcatcacatacagctaaaaaagcatatcttaaaaataaaacaatcttaaaatatcaagttactattgctagactgtagtcaacaaaataaaatgtttattatcttgtcaattttatatcatgttttagcttggttgtcaaatcccatcatttctagaagtgcgtacatttaacctttaaaactcacagacaacaccatttactgcttgctcattcactggctgtttcctggttcacctgcatctccgggtcctcttttgtttgtttatttgtttctttaagtctgtttttctaccttctgcttgttgcatggctgcccacctttttttgtgtgtatatcctacaatgacacttgcttatcaccagccagtctccaaaccccatcaccacatctgtagaggaaatctccactaggaaacatcaacacctcaaatacaacctctcccagcctgaaccccacttaggctttgtcacccttgtgtctagcactggaacctcctggtcactgagcttcaacatttgggatgattgttggttcctcctttgctcccctttgtgctccgtggaaaaccatgtgcccatcaaagtcaaagccctctctggagcatccattcctcatgttcttcacctgtcacccctagaactttatgcctccagtcacacacaacctctaattttactgtcattatctcctaaaagtcttcccactttctaccagtcaccattccagtccatcctacacactgaaaatgaatgtatttattaaaacaggttaactctatttttttcacacccaccacccttgcttaaacaccttccctggtttctcactgttgctgatttccccagggattcgtccaatctgcttcctccctgtgctcagagccaagttaatgacttactctctctcaaattcacatgtcttttcacctctgtttctttgctgttggcccttctcccatgatgtcagccctgttgtcttcccagcaacaattcagtgccaccatttccatgaagtcctccttgagcaagctaggaagctcactggccttgaacttcatggcccatagcattgttccttgctgtggtcatgccggtccctgtattacaatgatctgcctgagtatcttatctcatcagtaaacataagttactcccaagttggatctattactgaccatcattgctccttcttggtgtttagctaaatcccttgtacacggagcaaagtacatttacaggaggattaaacagtaaatgttataactggaagtgatgttaaaggtcatcaaccatgaccagaattttcttaatgagaacagtatgcctcaaagatgttaagtaaattctcatttattgtattcccagaacaaaatgcattgaatgacaaagaatggattctctgtatacacaccttcttagctttaagaaatgtatattatcatactatctattctaataccgcggaacagtttgatgccaaattttgtgttgtcaataaaagctgaggcaaacccaattaaatccatattcatcacatattggaaagtacaaaaatgcaattaacaaaactttcatttccacacagtgtaaacaagtatttgcattatctttcatctcaattacattagagtattgcctgtgtgaataatttttctccttatagatatttgggatgtttatctaaattgcattaactttttttaaccctcaattctgtattctttaaactaccactctgactgcaaagtcaaattattcgaagtgttcagcaatgtgaaaaatcgttatatgattaaattttttattattttatcttacataaaatattgcatatgatattactttgaaaacaataatttccattaagcaacagctttttattggcaactacgaagtaagaaaaaagaggagaggaaattgtaaaggatatcttttgacttaacatttaaaggaatgtatgtcaggaacaagtataaaaatatatattgtttccatttcgtgtgggggttttgtatctaccagcagcttcgatttctccaggcaaagagacagctgcatttacttttagatggcataacaatttacaaaatattttgtgagttttgtttactggaacattggtagccccctgagttataagtactttatgactgagaatagagaaagaaatgggaacactactcatgtttcaggcagcccacactccaagaagggtagatgatcacatggcagtactttattgcagactttgtgacatgtgagtttcagtgaggagtagatcagtcgtcccggtacattcacaccgatactgattctgcaccttaatatgtggcattcgggaactacaaagtgctctaccacaatgcccagggaacccaacacatttttcatggttacatattaaattacgtattttatttgacatataatttgttagatatatataattatatatttaatgtaaattatattaaatattacctttcaatatatttatatattatcatgtataaaatatcaatatatttatatattgacaaatatttaaacctgtctactcatttatctattttatatacatacaaaatggagatacatatatacacacacccacacacacacacacacacacacactactcttaaaaataagagttaaaaattgaattcaggtctctaactccacatccaatattatagttacatctgcacatttttcctaaacacgtagaaaattgtcctccttggcattcctcaaagtagatgctgggctacttggaatcaaatacaactgtgtccataattatcccgcatgctatggatcatagtaagacctaaagcatctaccatataggatttaaaataaagcctacataagaataacctatttctgtaattatttttgctttactaaattattttgttctattgtggcaacacagtgtcattctgagattacgtgagatggaactttgagggacaaagaaagctctcaatgagagatcaaagcgtttgcaacctagatgcagaaactgagccctagagagaataaggtgcctaaagtccaattcgcccacctgtggatggctggcagcagaaaggtgatctgacgtgaaaatatgcacacacacacgcacacccagacacatgtgcacacagatgcacacacacatgtacacacagacatatgcacacatgtgcatgtacacacacacatgcatgcacaccgagacacgtgcacacacaggcacagttacacatgcacacacacgtacacccagagagacatatgcacacatgtgcatgcacacacatatgcatgcacactcagagacacatgcatacacatgcacacacacatgcacacacatgcacacccagagacatatgcacacatgtgcacatacacacacgcacatatgcatgcacacccagagacacatgtgcatgcgcatgcacacacttacacatgcacacacatgcacagagacatatgcacacatgtacacgcacacacacatatgcatgcacactcagacacgtgcatacacatgcacacttacacatgcacacacacatgcacacccagagacacatatgcacacatgtgcacgtgcacacacacacacatgcacacccagagacacgtgcacacacatgcacacacttacacatgcacacacgcatgcacacccagagagacatatggacatatgtgcacatacatacacacacacgcacatatgcatgcacagccagagacgtgcacacacatgcacatactcacatatgcacacacatgcaacccagacaatatgcacacacatacacacatacacacccagagacatacacacaagcacacacacacgcacatatacatgcacacacacgtacactcagagacatatgcacacataaacatgcacacacacatgcacacccagaaagacaggcgcacacaagtgcacacatgcacatacacacacatgcacacccagacatatgcacacacaaccagacacatctgcatctgcacgcacacatgcacatatgcatgcacacccagaaagacatgtgcacacacaagtacacacatgcacagatgcacacatgcaaagacatacgcacacacaagcacacacatgcacacacacatgcatacccagacacttatgcacacacaaggacacacatccacacacatgcacatacacacatgcacacccagagagacatgtgcacacacacagacccatgcaaaaacacatgtacacacatgcaccaaagagacgtgcacacacaagcacatacatgcacacacacacatgcacaccgagacatgtgcacacacacatgcacatatgcaagtgcaccgagagacatgcacacagaagtacacacatgcacagacacacatgcacacacagagcctttacaacttcctttctattttaacatcactgtatttaagaacaaatttttggtggagttaaaaatagtaataaacttggtatcatgaaatgtaaaaaaaaaatgtttctaaaaagcacactgtacactcattaggcaccccaggaaaaatgataatgtatgtatcatcaagttggcatttattttctgccccaatcccttggtccaacgccgaataaactctatctgaaaagccaactaaagtgaatctcttatttttcaagctcaaagttacacacatagaaggctcaagccacatacagtgagtcttgagtctcagtagggtcttcttgtctgtgttctgtgtgagactcagccgtcagaaatcattcaggatttgaccttccttaggggagatagcatccctggaactgagggtccttaaaagcactcaggaactttcaaagcaacagaccaggttaaaaaggaattagcatttccagtgagaagggcagcatttcaaaagcactctgggaggcaggataaggatcaaaattctaaggtggatttaatttcaaggtaatcatagtaatatcccaggtactgagttcacaaaaatttacaagccaagccattttataactgacagcaggacatgaagagctatcctccgtgataagaaacgcagtaccctgacactgattttactctgaaaatattggtgaaagcgattgcctctcttgacagttcagggaacaagcagagggataagtctgtcactaggagggcatcgtatcttcaaaacctcttgcctgacattctatcaatctcatcatgatagcaatcaatggaattaaatgctgctctatgtacccagcttcctatgaaccactcagattttaacacctagttgtcgcaatgtactttcaaaggaaatgaatgggaacatcacgttgtaagaatttctaatagaaacttggttgcttaccactaagttgacacacggaaaaaatcaatagccccccaggtctccagaacccccattagaaaatgttattaacttgatctgtataagacagccaactgggcacctaccacacacaaatcgtattacatgcattgttcttaagccttacaacaattcttcagctctggtaaaatcagcacctctctaggacaagcaaacatgggatggagcttaaataatttacccaaattaaacaattaatagcctgggtatatgtagcttcaaagaaccatcaacatgctgaattgtcaattcagctttaaaaacagtctacattctgtttagaaattgaaagtggcaagtttcaattaattcagaaatgtggcatatatcatatttctgacattttctcatcaatcataagactacatcgtttttccttcctgaaccttctatagaatataaattgtcttaaaatataaagctaccaaaagaaaagaaaagcaaatagatataggcaatgtttaaaatatattttttttttgtggaaattggacactccaaatccctttggtgtgagttgagagtaataacgtcttcttcaatcctaaatatatttaaatttttaagtggcctaaagttagtatgcagtttagacacagcagatatattaccagaagctggctattctgtagaatttgctctctggaccaagcatcctacataaaacactcaaaagcaagctcccaggaatgggaacggccccagagtgtcactaatgcatcattgcctgtgtttattctagggcaatgtgtgatcctacaagtattagtaaataatttttccaaggtaccttcccgatcgatattttacactatttgcccggatgcaaaataaaagatctggcttcaaagccaaaattgtcacttcctagctgtatccccttcaataagttacttaccctcattcagtttcccttcctgtaaaacacacttcctagtatttgcagcagacgacgctggttatgtatgtaacaacctgtattctcctttgctttcttatttacccaatcatcattttctttggagaggtaaagtgctagtaattcacattcctaatattcctttcatctaatggtgtccaggggataagatctttgtcaatgagtctatgttgttgggtgcagccctctggagggtggggctatatccttttctggttgcctctccctactcagaatgtggctgggctgcagttgtcgtatgcatgccgggtcagtgccacgctgcaaagaaagcccagaaaatgccagaaggagcccagaacccagaagaagacaacatatgagccctcggatgtctctctccacgtttttataacacaaaaaaataaaattttaatataaaacactattatttttattttccactactcagaaccaaatgttaattggctcctaattggtacagggcgctgatagggaattataatgggagaaatcagctaatctgacatcatattcatttcttatttttaaaggcactcgtgccctttcaaaaagccattctaaaaggttacatagtgtatgatttcgtttgtataacattcttgaaatgacaaaattatagggatgggaactagattagaggttgctaaagattacagtctgtgtgggcgagggtgggatgtcactatgaaaaggtttcccaggggaggtctgcctggtgagggagctgggtggtatctcgattgtggccatggtcacaagaattgatacctgtgataaaatcgcacagaactctatacacacacacacacacgggcatctaagagtccatgaatctggtgaaatctcaaaccaggtctgcagctcatccccttgccaatttgctggctctgcttttggcttagagcaatgtgacccttaccactggtgggaggggtgggtgaaacgaagacaggacttctctgtactgttttattcaaccctttggatctgtaagtatttcaaaataaagttacaaaacatcctgtttaataacagtagatgtgcatctcttaacagagagatacatttagaaacaggtttctcagcctcagcaccacggacattacaggctggctaagtcttggttgtagggcagttctgtgcaggtcagtttatctggcagattctgtggcctccgcccaccacacgccagtcgtacttctccctgggtttctgacaaccaaaactgtctccagccattgccatttgtcccctgggtggcaaaatccaaaccacccccatataagaaccactgatacagggggaaatgaggaatactggaaagtgattctttattttacaaagggagctgacatagaattattttgcatggttaactcccctggtagaatcaaagtttgattttgttgcacaaatattaagtactgcattttgaattatgtgttgtggaaagggatagacacatctcaaatcaccaggttcttgtatgccactgaggtgttttgctaatagctcagtgccaaaattcttcccctctctatttataccaaaggaaaggtgacaggcacaagagaatacaaatatctaagagcacttgtcttagcactcgtgggggaaggaggatggctctgtatgcaagtctagccatgcctgcttctatgccttgcttcagcttccaaaccttgaggaagaagacatttccttaggaaccctgtgggctcttcttcctgataatcacatctcatttccataaaattaatcaaacaaagtgttttggttcagtaaactgtatacaacacacaatttgaatttcaaaatacaaatttatattaactgactaattaaatgtcttgaaattcttcttgatttctgggacatggtggctgcacctcacacaaaaatgtcagtgcatatggaaaagcttgagggattggaatagtgaatgttccaattgctgagactattaatttcctgcaaaactgaaggttgacagacagaaaacacctggataaaattattactggaaatagttctccatttaaacataagaatgccaactaaatgagttttaatactctgtatgtattataactgtgcatttcatttgcatttatctgcaaaaatatgataaataatataatccttagataattacatgccagtgaaaagtatgacagttgatatacatttatactgacatattttcagaagcccaaaatattatcaatctcaacagagctttcgaacaaggctcactttagtacaagctgtaacacagacactttcaacagaatataccgacttctttgaaaagtgaactaatcattatttcattaaaatatccaattgtgtagtaaagacaatacatacgctactgatttaggtcctactgtttgaatcagactaccaaagtcaagagttgtgttattaaaatgcaaaatgccagtagctcatatttcaatgcaagttcttttccatgatttttttgcattaatttgaagaatgcaaaataagcagctttgaagttgcacatggccaacacacttaagtgtactaaatcaattcaagaaagagtaactccctcttaaaataattgactatattgaaggagatggggggttgatacatgaggaattcagcaggaatttttgtaagacagaatcataaatttgggttaaaggaagaaattgggattatgtgactctggctctaatcatatagaggagaaattttaatgccagattatttaactaccttttccaagaccacacaatggaagagtagaatcacaggaatgcgatgcacatcttctgacgcctagttcgtgatttgtcaaaagtatagtgtttgctttgaggaagagtatcagcttctcagaagagcttactaagcaactcatatgtacaaatacatcttgggagatatatctgttgttttactcacaggaaacggaatttagccatgcaaaatgcatcaacatacttcgtttcctcttctgagcaatccctcctggaattttcccactctcagtgatctgtaagcctacattttcttggacaataaattaattatagcaagagagaagcagggcaagctgcttatggaaagccgaggcctttctagtcatagaatcaacatttgtaaatatatacacaataaatttgcccacgaaatgatgtgccatatgtcatttttgtttccccatgacaatttaattttatcagtgatagaagaatgagccgtgagtatacatgctaaatgctcagtctatgaccattttcataatccatgacactaaaggtttcaattttattgatcttttcaaaaagcaacttggtttaagttcattttctctgttgttttctctattcatctctcctccaatctttattaattccttctttctgcaagcttcagatttagtttgctctttttttatagctctttaaaatatattaggttgttgattcaatatcttatattttaatgtgatggtttacagctacaaatgtccctcttggccctgttttggctgcatcctgtaagttttggtatgttgtaatttcattttcatttgtctcaaggaagtttccaatttcccttgtgattttttcttcgatctaatgattgtttaggtgtgttgtttaacttccacatatttgtaaatttcctagctttccttctgctattaaactaataaaagcaaaatgtacagtgaatcttttcgttttgttttgtttttgttttgaggtggagtcttgctctgttccccaagctggaatgcaggggtgtgagctaggctcacagcaacctctgccttctgggttcaagtgattctcctgcctcagcttctcaagtagctaggattacaagtattacaggcacccgccaccacagccagctaatttttgtatttttagtagagacagtttcaccatgttggccaggctggtctcaaattcctgacctcaggtgattctcctgccttggcctcccaaagtgctactattacaggcatgagccaccatgcctgccctgctgcagtgaatcttgacgcctctcctttttcctatttttttttttaagatggagtctcattctgtcatccagactggaatgcagtggtacgatctcactgcaacctccacctcccaggttcaagcgattctcctgcctcagcttcctgagtagctgggactgcaggcacacaccaccatgcccagctaatttttttttttttgtatttgtagtagagaaggggttttgccatgttggccaggctgatctcaaactcctgacctcaggtgacctgcccacctaggcctcccaaagtgctgggattacaggtgtgagccaccacacctggcccatactactttaagaaaataagcataatttctggagattcacctaatttaaaacaacctaaaataacttttcaggtccctcccatttcctctggcttttattcaccatggatattaattattattatttgttgttgtgtgagtactagtaatcaaaacctttaactaaaatcttttttagcccctatccgacttatgcggcatttgctcagatgtgttttcattatagaatctggaattataaaacacaatagtaacattattctatatgtgataaacatcacccctcaaaaaatcaaatataaaaggtgatcctgtcattgtgagattattgaaatgccccagggtagcataaagaagaaggcagtgagagggaggcagccagaagttctgggagccctgccatgcagtccaggttccatctgtggtctggccccgtgggaggctggtccactccaggttatgtgttagcataggtgcaatacaggaagtagaacaaaaactatttatgcagataatgagggcaaagagtcctcagcagaacttcccttgtaacacaaaaaaaccccaagaaatcacttcttttctaacaaagagcagcctggaagatcgggctgcaaacatagataagcaagctagaagcttacacagggggatgccagcagttgcacagagagaaacggctacgtggggccaggccggtccaccatggggccccacctctcccctaatcagcacatgcacagtaagaaagaaatgagcaacatgcagtagcttaggctgaggacccacctgcaaaataaaagactggaatgggggatcccacagattcatgccctatgcagatggcacacctggtcctaaacagtttttcatgccctgtctagatcagatactgcctcatgattagctcgtctatgaaagcccctacattccactttgagatggcaacattttttttctgggactcctctctggagtagaaaggtgttcgctttgtttctcctatgaaatttctgctctaaacctcacccttagtatgtccgtgtccttgatttccttgggtgtgagaccaagaactctaggtgtcaagccagacaatgaggccacttcacatgattctgcatggtgtcactggctggctcttctgggacatcagccagggttttaagaatctcctggctattggcacacattttcacaccaatctgtgtgtgtatgagcgagtggtgaggatggtgagctagaagaaagatggacttgtggcaactctcctcctccttcctaaaacagctgtgtctgacatttccttgcctggtttttacctctcctccatatcccaaccttcccctcagatgatcaggactttagatcaccttatttgagaaatggacgtaggttcaacacaggatttgatgagtgattgcattcatgccgtttggtgttattgtagatttactacgccaaaattttacattctattactctgaaactgatctgcaattataattataaaaaataatattctcatccttattccaaacaatttgcttaaaataacactttcagtatgtcatatctattgatcaatatatagacaacataataatggtgaagactgtaaacttcttgacatataatctatatctgattcacatttgaagtcattaaagcacacagcacaatgacctacagaaaatataatttcacactgagatctattttttaatcaatagtaaatcattactaaatataaaccatgacatagcacatatactttcaaagtattatcatgtagagtctcatacaatcacctcattttatacattcccttctactcataacaaattaagtgaataatgtgttttaagggcaaagatgtctaaaatactttgagataaacagctcgtaattcatccaatgtacctttccatcaccatcttggcatgaaggaaaagcatgaaaggacttatttttgcagaggaagaaatttaaagatcaaattctgtgccaaaaattgtacacaaagaaagagcaccctaaaaccagatgcctattttctgtatttcattatttttattgataaggatagattacatgacatctacctcttacaaatgtttaaatgcccaatataatataattaactataaaccgagattgtacagcagatctctagaacttattcatcttacataagagaactttatactccttgaacagtgactcctcatttccccctccctgataacagtggtttgactctgtcagcgtctatgagtttaactcctttagattcctcatgtaagtggaatcatgaagtatttgtcctgtgagcagcttacttcacttagcatcatgtgattcaaagacatctctcactactatgtctataaagcaggttcacacactgctgttgaatgagaatctcagggaagcccttgcttccctgaatccactcatctgcatctggaatctcccagaggctctgggaggcccatgagcttcactccactaacacttatttcaccacacgtgcctccaccgtgatgtatcatcctggaactcagtactaagctccaaggtgcttgaggcatctcttttactttccttactcttgtaactatcacaaaacctggaaaacatgaaagttcactttttttctcccaagtagctgtacagttagagatcttagtctgtaggtatctacaatcgaaatctttcagatgtatcagctcgtcattcaccaagaatccctttggtccaccaatcacatgaactctctaaggataagagggcacatgaaacaaaattttgttttggcaatatttatattttaaatctacttttgcggaagaagaatattctatgaataaaagtcattgcttgaagttactagttttgacttcctttgaaatgattgttttagtatctgaggctatgagagcccatattccccgctctcactcatatgcactgtgaaataacaaatacccttgaagtaattccatctcttggtgtttcatcacttactcactcctgcaatgccacgccctttgcctaggtagtccagaagatctgcattcaattatctaactcacttattaatctttcttttgaaaatttattaatttccttcatctttaccttgatgtaagctccttggagacctgttttccacactcctctcagttctctttaaatgccgtgttcaggattgctttgtagactcagtttaatgcctcttgatcttctctcctttgttttgggcaaagtgcctatcagcatgtgaggatcacacttatgacaccctctctcatgctcagcgataagtagatatttttggctttctcaattacaaaaaaaaaaaaaaaaagaaaaacttttcaaaaattagtgtacaatcatttactttcagtgactgatctaaaagttgtgtttcctaagggcttttctgctagatgtcagttggtatcttgggaatgccatttccatagccaaacaattttagaaaaccattgtgtacatcctttttcattcttctagtcccagagcctttaagcaacaactgcataagcatccaggttgagcatatggcatcttaaagctaagattactttatttccttgttacaaatttctcacacaacattttctttgggtcacattttgggaaacgttgctcttttgcctagatgtattcatcaaccatctgggagctacttggtacaaatggtttagtccagaattcaagtaaaagatagccagggttactgtaagacatgtatttacttatttatttatttattgacagcatctggctttgtcgcccaggctggagtgcagtggtgcaatcagaactcaccgtagcattcaactcctgggcttaagccagtctcctgcctcagcctactgagtagttgggactacagggtgtaccaacatagtcagctaatattttttttttttaatttatatagagacagggtctcaccatggtgcccatgctggtctcaaactcctggcctgaaatgatccttctgtttcagcctcccaagctctaggattacaggcatgagccaccgcacccagccactgtgggaagctaatgacagacgacactgaaatagttattcaagcttttggccgtactttctatctttctatataccatgctgagtcactataggaagaacctgagtccagaggacagaaatggaaataaaagtgtgaaccctgacacctgcagcctgacctcaaggggtcttccctccggttccatccacattgctgcaaaagcctccatgttctcacttataagtgggagctaaatatgtatgcacatggacatagagtgtgacctgtaagaccacggagacttggaagggggctggtgggtaggaagaagaaggatgagaaattacttaatgagaaataacttaatgggtataatgtaccttattcaagtaacagataccctaaaagctctgtcttaaccactacaaaatctatgcatgtaacaaaattgcacttgtacccctcattgcttttttgttaatccaagtaaacttgattttaaccttcaattatgtagtgcttggcagttcacaccttcccacatgctttgaaaattcccaagggctggattccttgcagtttcctctcccaccagtttttgtatatgaagtgtggtatttggccctgttgtaggtagaactctaggctggccactaagcttccccctcctggtggatgctgcttcaaggctagcaggagaagcccccaccagtcggttacagttatatgacagagggccatccagggagggactctcccagcaacttgaaacaaaaagtgacctcctcaagccagcgaccacgctgtcatagtcacaggtcctggccatacacaagtagagatgtccccaagtagctgataaatattatcattgtttttatgataccaagctgtgatatccggatcatcaactgtcattacataggagagcacggggctttcagcagacgtatccagagcactgtaggtttgcttttcaagactcgaagcatcaatattaatttataaatgagctgagttaataagtttgtgtgtatgacagcaacttgtacttaaactaattattttacaacatatttaaaatggcagcctgtggcttcaattaatgttaacacttaagtgagggtgtcagaattccatgaccattgattctactacgtgcaactgtagaggaagaatgggcttagagtcagaaagcaggttcaccaatgggctgagtgaagttgggccaggtttcctctttgattaatggggattatgttttttcctctccagggtatcttcgaggattggcctccatgagaaggatgagcctggttcctggtagaaattcagtacttggtagtcactgtctccatcatgaatagtgtgaacagaaacggtaattcagaagtgtgagctgtcactaccatctagtggcagtggtcagaagtgtaggcacagagcaataggatctgtgccctcagagcagcctccctcctccggtcttgcaggtggcaggagccccaatacccaaaagtgtccattgtgtggaagggactaagtcatctcttcagcaccgggaatgctgttaggtttgtgccatccttgggtgttcggtcccacggtccgtgttctgtggctcagataagaatcccaggtagagaaaattaaatctagtttagaaggatttattgtacgattgccctagtcgtcagtagagtcagtatttactgggagctttcacatgcaacattgtgcaacaataggtcaaactctttttttcttttctttcttttcttttttttgagatggagtctttctctgttgccgggctggagtgcagtggcactatctcagctcactgccacctccgcctcctgggttccagcaattcccctgcctcagcctcccaagtagctgggactacaggtgcccgccaccacgcccagctaatttgttgtattttaagagacaggtttcaccatgttggccaagatagtcagtctcgatctcctgaccttgtgatccacctgccttggcctcccaaagtgctgggattacaggcatgagccatcatgcccggcccgcaaactcttgcttatatgactcatattcctatcacctgtatgagtttttattgttgtttagtgtactttttttatacatcataagttatcatgcaacagacacaaatactacacctgttgcattccaaaaattgatatgttagctaattgtaacataataaaatatgtaaagtgatttcctcaggaatttaagacattggttcataaatgtttggacaaaccccctaaaagaatccttcttttaaacattaatatttgcatgtttgttttagatagctctattattctgataatgtaatgatggaaattgtgtttcctttaatgaaatttatgtagcatcatttatttcaggcaaattacatatattcatttacaatactttgtatttgcaaaaatcatatatcacttcatacattatcaagaatcaaaagtttttaactattttatttaggacagtaaaacaagaacacttcaccaattaaagagtctcatccatagcacttggcacaaacttggtcaaatgttacagacacaataaatacttctaaattaattcaggagcctcttctcccatatttcattgttgatgttccttttacttctcttggatagagaataatgagtgtttctcctattaaagttgtttattcactcagggtatcgtttattcttctatttatcatatcctcattagagaaagggctttcctacaagactgtggtaaacccttttatgctagatgtgcagaacctgatggtcaatgacccgatcctatgcacagagtttttaaaagagtgtttcaagtttataaaccaaacgattgcacatggacttctagatttacatctttacttgaaaaattacatgacggatcaactacaccttgcatttcattcccactagcaccatcagctggaactgagtagcaatggcacacctgagatgcctcacctgagatgcttcaccttcagtggtgcacctgatatgcttcacctgagatggtacacgtgcgatgcctcatctgagattatgcaactgacatgcttcacctgggatgatgcacctgggattccacacctgggctggtgcacctgagatgcctcacctaaaatggtgcacttgagatgcctcacctgagatgatgcacctgagatgcctcacctaagatgatacacctgagatgcctcacctgcgatgcctcacctgagatgccccacctgcgatgcctcgcctgcgatgccgcacttgagctggctaacctgagttgcctcccctgtgattgtgtgcccacaaaagtgagccccattccccaccactcaacaaaggtatagagctttcctctttttgttgccagactggccttttcttccttagcaacgtggcatggcctgccatctttgattgccccttttccgtcacgtgcacttgcgattcatcagcagtcacacagctctacatgtatcctactcgggaagccacacttctccacttgcaccaagagcctggtggaaggcaatgtctcctctcacctggagtgctgctgcggtcttcctaagtgttcctagttgttctctgctcccactcttgcttcacctacacaccatgctgcacacagccgccagagcaacgtttgtgagaccccaatgtcatcaaagcatctcccttctagaaatcctgcagcagcatctcattgaagtgaaaataaaatccaaacacattaggacagcctgaaacacccagagatggcctctcctccatcactgagccacgtctcttacagtcttgccccagtccctttccctgcacccgcggatagcagggaccgcttgtctttcccttccacataccaagatgttctggccgcagggctcttgcatttgctgtaatttaggtctggaaggatgttcgcaaggctgcctcatgtgtatcattaatccttcagtcactctctcctgggcggatttagattaaatggttgtcttccccctactgcctacctcccacccccaagccaatcccagctctttctctactcctggttttgccttctgggcaacacctttactataagaagtatatacatattatttgtttccaggctaatgccttcacccattagattatacatcatgatgacagttgggtttatgtgtgttctaatctgcatctccagagcctaaaacacagctacacatgtgcattatattatgaagcccacaaaggttctcattttaaacgtgcaaggaaaagcgtgattcagaagttgtaacacttcgccaagaattgaagcgaaacacagctctgcccctctaaatcccagcaaggctccctcccccatccctcactgttgggtgaccttgtcacccactaagaaccaaatcaagtgtgggataacagtgtttaaaattaaaaacatatcacacattgaaaacaagaatctctagccctttctttatgataaaaaaaaaaaaaaacacaagaaagaaaatgcctacaaaaaaggaaagaaaactctagacgtgttaaggtgccgtggaaaatctggtggataattttgttcgaccaaacgaacttagaaaacggcttccctttgaatttagacacaattgcttcatggatagaccataacttctctgtttcccataaattgtagctagtttgagaaacagtcttctaaagcctgcttatatttgcatctccagtaaaacagggctgcttctgttgtgtctgctgctgtgtgcaccacactgcaatctctgattggctcataaataggcttctctgtgattctagttgcttgtagacttgtttacggtcacagtttcaatacttggaaattaaactgaactgagtgtaacacagtgacagtttagtcttgaaaaaaaaccttattccaatgttttaggcttattaaacaatgaattttaaccagcacttcctgattcaacttacttgcaaaacaacctcctcatttggcaaacagagttgaataggtgataactcttcttagaaatacctggaaatcttgcatcacaacagtgccctatacagaatctcctttaaaatcaagtacagctcaaggtggattcaagacttaaatgtaaaacccaaaactataaaaaccctagaataaaatcaaggcaatactattcaggacatagtcacgggcaacgaattcatgacaaaaatgtcaaaagcaattacaacaaaagtaaaaactgacaaatgggatctaattaaagtaaagagcttctgcacgacaaaagaaactatcatctgagtgaacagacaacctacagaatgggagaaaatttttgcaatctatccatctgacaaagggctaatatccagaatctacaaggaactcaaacaaatttacaagaaaaaaaacaaacaatcccattaaaaagtgagcaaaagacatgaacagacacttctcaaaagaagacatccatgcagtcaacaaacatgaaaaaaagctcaacatcactgataagtaaagaagtgcaaatcaaaaccacaatgagatcatttcatgccagtcagatcacaattattaaaaagtcaagaaacaacagatgccggcgaggctgtggagaaacagaaactcttttacactgttggtgggaatgtaacttagttcaaccattgtggaggacagtgtggtgattcctcaaagatctagaaccagaaataccatttgacccagcaatcccattactgggtatatacccaaaggaatataaatcactctattataaagatacatgcacatgtatgttcactgcagcactattcacaacagcaaagacatggaatcaacccaaatgtccatcaatgacagactggataaagaaaatgtggtagatatacaccatggaatgctatgcagccataagaaggaatgagatcacgtgctttgcaggaacatggatgaaactggaagccattaccctcaaagtaatgcaggaacagaaaaccaaatactgcatgttctcacttataagtgggagctgaacaatgagaacacatggacacagggaaaggaacaacatgcactggggcctgttgaggggagctggggagggagagcatcaggatgaatagctaatacgtgtggggcttaatacctaggtgatgggttgataggtgtaacaaaccaccatggttcatgtttaccgaaataacaaatctgcacctcctgcacatctattctggaactcaaaataaaaattaaaaaaatatgagaataaattaaatatatataataaaaaataaaataaaaataaaatactctaaaaatgggtcatgatttttacaggtagacgttcttcactaatcaaattaatcaaaatattttatttggacaccctataattagtactagttcagaaaattcatttttctttatcaacaattaaaaattataaaatattatataaatatatataaacaaaataatatcaactacagctgttctttttaaaaaacaaaaaatttgtgctgggcatgatggcttgcacctgcaattccaacactttgatgttaggagttcgagaccagcctggccaaaatggcaaaaccccatctctactcaaaatacaaacattagctgggcgtggtggcttgtacacccaggaggtggaggttggagtgagcctagatggagccactgctctccagtctcggcaacagggactccatttcgaaaaaaaggaaaaaatatttgttgttaattatctacttccacctatgtgcacccgtattatttattttactgtgctctatagtctttaaaaaattcaacagagactcttttatttcctatggaaatccctttaaagttacattattacaaaatacttcaaaactaagagtcttgcttgaccttaatattgatacttacctcttattaatcaatgactatttgtgacatactgtcataaattctttactcttttatgtcatctgaagatggttcattcattcagatggttcattcagaatcttcaatcattcagatggttcattcagaatcttcaattctgaagataggtaattagttattttattttacaaatatattttagcacctaccctgttccagataccgttctacgattggatgtgcgttagggaatgaaactgacagtctctgaccttgctttctttctcaggcagggaaaaagcaataaatcagtgactacatcctgtgtcagatgctggcagggactgggaaggaacacggaacagggttatagacaggaaagagcgtacgtgctgtgagcaggcctggcctccttgaattctatgctgtatggagatacataggaggtaacacaggacagttcagatgtgtttctccccctattcttgctcaaatgtctcaagaataactgtcaaatgtgctggggatgctgtaggttgaggtaagaaggagctgaatggaacagcttggactctcttccagtctttccccaggacaggatatccttcgatgctttagctaagcaagatccataaccctggggtacaaagcccagggagagctgctttcccgtgtccctcagctacggtgcaagtggggctcatgcggtggagacaccgtcctccccaggcagctctcctgagacttgggggacccgctggcagtgaatatggggctcctcttcctccctgctgcccatctgtgagtaaaatcccacttcatggcacctgctgtttgtgggtgtgttctgtctcgctgggctcagacaagttgacaaccagtgcaaagggaacctgcttcatgcatcgtgagcaaatctgtgcatcctgaaggatgatcccagacagagagaaggacaaaagtcaataccctgagacccaggcatgcttgatgcttttgagaaactggtaagtcttagcagcaagggaggtgggagaagcccaggatgtgacgtagagcagaggtgaggcatgttttacagaggacatcggagaacattattagaataatttatgtttttagggagtgaggtgaaaagtcactggggattttgagcaaactagagatataaactgacttttgaaaataatcactcgtttctgtgttgagaacagaatgaacaggggcaagtgcagaagggcagaaatgagttaggagagatttgcaataatctaggcaagcagtgatgattgccgagactggcaattaactgtggaaatgggaggatggctggatccccaacatgatggaaaatgaacagagtgtatgggtctgctgatgaatgtggggtatgagaacaaaagaaggattaaatataagtataataattttcagcctaaataactgaaaaaaaaaaagaattgccattttctaagaagaaaagagtgtgagaggaacaggttttgtagaggagacccagagtttgcttttagacatgctgtgtttgagatgtctgttggacacttagtggagatgtcatgtggacaattcactgtttgcagtctgagttcagagtctgaataggaacattttggtagaggttagcagatggattgtatttgaagctgcaggatcagagtcaggacagatgaagaaaatgaggatgtggaggaccctgagaactccagtgtttacaggaagagacaggaagtggccaaagcaaagcaactgagaaagcagaaagagtcagataggaaggggatcaagaagcagagtctaagtaggtaataaaacagtcttccacaggtgaagtgtccagtgctaaccacaggccaaggtgtgagaggtgtttgaaccagagcgactccatcttgagtgagggcttggtaaaacgagcctgggacgtgctgggctgcatccctagaaagttatgtattcctagcctctagaggttcatggttaagggaagagattgataacgtttactaaacagacccaaaattaaaagtgccccgacatcctgataccttgaaaaaagagcgttcttaattttgctttaaagaaaataatatagattcttgcaaaatatagtaattcagaaaattaatcctttatcacaaacccttgtagcaaagaacatctcccctgatcttttttcatcctatatacgaacaagcattttacctgggatggaggcgttctttctcttactctcgggaacgccttactctgtccatggagtagcttgctctttcccagttgacgttctgaataaacttgcctttgcttttgcactgtggactcgccctgaattgtttcttgcatgagatccaagaaccctctcttagggtctggattgggatccctttccagtaacaaaggcgggggccctgggaacggaccgtccaatctgacagcttggccaccactgcagacttgcctggagctattcagtgggcaggagccacagaagcttgactagacggggttcagggagaccaggatgctgggtggagacagggaatggagccaaatcttagaaatgttgtttgcttttctctaatgagaaaagatatgaagacaagcaggagatgacaagacacgtgctagtccaagatgccttacagctatagtaagtaaaatgtcaatatggttatttctatgaattaataccaacttaatgtttaatctgaaagtatcttaaatatcttagatctcttctttctcatgtgtcaacttgatccttcatttttgttccttttatgaaatttctctcagggaaatttatcaggacagtataaagttaatttcaaatatggtatttcctgaatacaaacttttccatgaccttaacaaagtataaaacctaggacaggtatcaaagcagatcgtctctctctttctccgtcattacttgcaatctattacagtaaaggactctacacttagcaaagagcaggaggtagaatattgtttccatgtgtctgtctatatgtgtatatatgtatgtgtctatgaacttttctgatttaaagaaggacatggtcttcatgattttcaaagttgcttttatccctagaattctctatagtactacataaactggtagctttattccaatacttaacatattcttctacaaaacagctgtaaaacataaacagccattgtgatgtctgatggtccaaggtggccatttctgaaaagcaggtgcaaaacagaaggtaaattttccaggcctaggtctacagacaattttgaagaggtgagtgataaagaatcatactgttcggtataatttcaccactctaatgtgatgtagactacaaatgaatcctgtctttaccatgaaggctacttatcatgggctctccactgccgtaacccaagttgagcaattcaggtgcatcatcagcggtggacaacttacagacactgcctttggcaaaattgaggacacttaactgcgaatcacagccatttgacaagtaatggtgctgattattttaaagggctactggaatctcaaatacagataagcttttgttaaaaaaatagtcacattctgtgaaaaggctcaggaagcaagttatttagtagcagagtctattggccacaaaaagcaaagtcaagcagttggtgcaaacttagtgatgtagcaataaaattatagtgaatgcatagtggggaatgctaggacagggtgcagtgggagaaactggaaaggtttagctcctaagccaaacaattagtcaacatattgatgagtcacatgacactgagaaagatttctctaataaaccaaaatgcagtttctccatcaagttgacatttaacagcccttgctaacaaatgtaaatagcagtaaaatccaagaaaatatgttttgctgtgcataggtgtctcaactaagcaaaggtcatcatgtatttgtttgtcttcatatatggaaaaaaacacttcatcttagagaaattgtgtaaggttctatgcagatagtgccctcaatggctggccacgtgaatttttcctctattattaaaaaaaaaatcccagtactttgggaggccaaggtggggggatcatgaggtcaggagatcgagaccatcttggcaaacatgatgaaatccccatctctactaaaaatacaaaaaattagctgggtttggtggcatattcctgtagtcccagctacttgggaggctgaggcaggagaatctcttgaaccagggagtcggagcttgtggtgagtcaagatcctgccaccgcactccagcctggtgacagagtgagactccaaaaaaaaagaaaaaaaaaaatcctgatactgtcaccatacattgttctcctcacagtactgagcaattgtcaaaagttttgaataatactgcaaaatgattaacattataaaacaaaaaaaaattactcatcaatgggtaaagattgtataaacagctggacaaatcttcaatcaatgtaggaattactgaagataaaaggagctgcagaaatcagcctgcacagttgtgtttcatgacatgaactttttgaacaggattctgcagctccctgaagaacatcatttacttccagtgatgttattactgaaatgaaagggaaggtgaaatattggaaaaacgatgttgcaagggaaactgtgaaaatgtttccactgctgcttgagtttagatggagggaggatatcagaggtcttgagctgttttgaaaacctcctggaagaagggaagagcaaaactgaacagcgtctcccctcctgtccacagatgtggggctggtcagggccccttctctgaatctgctgtttagctggagacctgacttagacagcaggaccaataacgtgggctacaggttggccaaccctcatgctgccattcacacaggctcctggacaagctctgggcttggcaaagatgaataccttgtcttacacaagaaaacagggccacatggctttgacttcggccttaaataagtgagcaagcctcttcttgtgttatgagcaccaagaacaaagacagaaagtcatactcgacaagaaaatgaaatgaatgtgtgcttatttcagtttctaagtgagaatgtaaaatttgtacggtcgaaaaatatcaaaaccatttagtttccacactgaagaggtaaaactgattcagtttttaaaacactacttcttgtacatatacagatgtataaacggatcagtaggtcaatgattgtccgtaatgttttccaacttctgagcatatatttatgcctgatcacgtctctcaaataagaaaatatttttccaaagtctcatacaaaattgagttttaggctttatttttatttacattgctttactatttaaatattaagtttactattttgtattgttaataaagtgggtttgtaagtaatattaatttaaatatactacaacctttctttggagttaaatctactaagcctacctatatgaaaaacaatagatcttattttggcttgagctagttatctaatagaaatgtgttgtgtttttcttgttgctctttaagatttatgaaaagaaaataaaatgattaaagacatgcaaacaaagttttttaaaaggaatttcgctaggtcattttttaaaatgtcattttaagaataagaagtactcctaaaattactacatgcaccatgccatatcctgatgtcataaagtagaaatttgcgatacaacttcaacctatttggatatggtaaagaaaaaaataactaaaagaaaggaaatgagtttataaacttcctggagaggggtaaccaccccatgaaagtaggacagtattttgaccaaaataaataggtccaccaaaaaaaataccgtgctcagaagagcactgataattattgctgtatgactctatcggtacatgtaacaatgttatggggggttcctgcaacctaggattcctttgccttcctcaagccacaagggctgatggagccatctcagtgcccagttctgcccttcctcactctctgtagcccttgtctattttaaaatgcttatttaattattattttttatttccataggtaattggggaacaggtggtatttggttacgtgatcgagttcttcagtggtgattcgtgagattttggtgcacttatcacctgagcagtatacactgcacccagtttgtagtcttgtatccctcaaccacttcccaccctttctgcctgagtcctcgaggtctaccctgccactcttatgcctttccatcctcatagcttagctcctgcttggaatgagaacatacgatgtttggttttccattcctgagttacttcacttagaataatagtccccaatctcatccaggttgctatgaatgccattaattcaacccttttcacggctgagtggtattccatcatacacacacacacacacacacacacacacacacacacacacaccatggtttctttttccactcattgattgataggaatttgggttgtttctaaagagtaagcccggccaagttgttttcatgcttaaccaccttctcaggtttctaagccctttcagagcaaagccacccttgctaggagggcaggcagggtgctccctgggctgggtcccgctccctaccccgagtccacatcctccccttctcacctggtggtcacacacactaagttctcgcgtgttcctgtgcctgtcctgtcttaactctgctcttgcagacacccctcccaatatacctgggtttcctcaccctctagccttgtttcaaggaagacctgctcctcgaagccatccctgatatcaaccccacttccctctgctgaagcctccatctcagagccacacattgccatgcagatgcccgcttccatgtttgctttgcttctagattgggtgtctgcaaactacagctcacggtccacatccagtctgtgcctgttttcttggtaaagcctcataagcatggtttctatgttctgaaagggttgtggagaccacaaaggcgaagtgtgccagtgactgtgtgtcctgcaaaatctaaaccatttattatcttgccctttacaggcaagctcaccagcttctgttctaggccaagtggtctcagatagacagatctaggccttattctactctggcctgatgatgggaggctatgctttgaatgtttatggcctttgaggctcacatggaaactcagcccctcatgtcgcagcagtgagagatgggaccattaagaatagcttgggtcgtcagggctctcctttcttggatggataaattcattcatggatgaatggattaatgcattaatttgttaatgaattactggattattgtgagagtgtggctttttaaaaacaggaggagaaacctcagctagcatgatgggagaaatctaggagaaatctagctagcccccttcaacactggacgccgtgtgctgccttgggcctctacagaaagttcccaccagcaagaaggcgatccccagatacagttccttgactttgagttttcagcctccacaactgtaaataatacactccctttctctataaaccacccaatttcaggtattctgttacaagcaacagacagtggagtaacatatgctccaagtgtaacaaatgtaatttgaataaataagtcaacaagcagatttattgaaagaaaattcaggcaattgaaataattaggtatcttggatctagacataaagagttaatatatgtgttgcttatgttttaatgaccaccttcttacatttaactctgatttttcttgtttcatattgaaaatcattctaagtaaaaggcaagaaaaaagaaagcaaagcacagagccgataaaaaagtgtcccattgggatcacccatgcacgtggcctcaaaatctaggagccatgcttcaccttttgatcccgattctcccatatgcagcccatcagcaggcattccaatgtctcttcctttagaatacatcctatgtctcaccacctgtcaccaggccactatggctgccctctcctgttttctccaataattcccacctttttggcatttcttggacacagcaaactcattcctactccagggccttgaccccgcctggaccaatcttcctccttccccatcttcacaacctccaaggcatggctcagcagacagccctcaatataatcttttaaaagttttttaattgacacatggcggctgtgcatatcgatggggtgcacagtaatgtttccatacatataaggtgtagtgattcactcagggtgattagcacatccagcatctcaaacacttatcttatgggtgcatcatccctaagttcctttctctgacctcatcagtctccacccctttgcctagtgctgtttcctttcttactggtttgctttccttagctgctatgacacctgaaatcttgctatttgtttgcttgcctattttccactttgcacctccttgaaaagaagcttcatggccaaccaggcttgcaccacatattcccacatccttcctgggtcacagacaggcacctcgtgaatacttgttggatggaagagtaaatatatgggtaaatagggtgtatgcaatatgcattcccatgttgccaatctctgcttccactcgaaaataggagtatggcatcatgcaaatgtgtctctgcttttctctcatcagatgacaaaccactactcaacttgaagtgaacagtcagacccctttctcaaaactctccagcaatgcattagtcaggatcagcctaaatctaaatgtaattgccactctcaccatgctgtgagagctcatggcagaacaaggtagcagttaagagagtagacttgacctctttgtgattcagttttcttatctttaaaaaggaaacactaatgtagcctatggcatagggcgttcaaagattcagtgagataatgaacataattacttaaagtttctaaagcatgtaaatttctcaagaaatattaactaatatcttgtggcatattttctgtactacaggactgtcatatccaaactctatatcaatatgtgaatgttttgaaagccaacacacactttagagtttgtgagtcattggttttaagcctaagagtagatgcagggggtaaatgctttaggttgcagtaaactggaattaactaatctgcacactgacagctaaggagaaaagaacatattttaccaaatacataacttttattgtgactgtttgataagaccctttacgtccctaaccactgcttctatattggtaaagctctcttttcagaattgtcttctaataaatatgtatatatatatatatatattttttttttttttttttctgaagatacattatgttctttccggtgctcatttaataccaagccagtgtatagtttcttactctatgtaataaagacatgactgatgatgagaaatagtcattgtagtctgtcatatcacttgtatactaaagtccgtgacaagctgcgataatatgatgttctctgtaatgtgatcatgctgagtgtgacatgcagtacctgcatcagtctagacgtggctttagctactgaaagatgaggctgccactgtgtctttaatgtgatcatgctgagtgtggcatgtggtacctgtgtcagtccagacgtggttttagctactgaaagatgaggctgccactgtgggagctgaggactgatagggatctcacagtggcagaaacaggaactcgagaagtttcatagcaaatgtttaaaaaatagagattttgcagatgcatgttctgtattgtgaaaacaaatggtaaaattctttgaacaatgagaggaaaaaatctcctttacatggaggcactttgaattcatcccatcttctaagagaaagaggtgagattttctgcacaaacagagtactgtctgtggaaaagacaacattctgatttagaaaaaagggctgaggaaattacaaaaaagtgtatcgacacagaaagcttgaatactaatctaaatatgcatcatccacatggcatgaaaaaataaggtcagcttattctctttttttttgcatatttctaaattaaagaaaactaaatctccatgacattttgtaagcattacatgctaaaataaacagttcataacaatttgtgtatttttaaaagggattgttgttaggcagttataaagcttcctctgacctgtgataactgcctttctatctcagaaaacattgctaaagagactcaaaagtttttttgaattggattagccaagataaacataaggtggggggcattgtggttatgcaaatataaggtattttaaggaattaagaggactcaagtgtaacgcgtatgctacagagatcctttctgttgcaagagtattcacatcaacattgttcatatactccatttgggtctgaagttttagactacgaaattatctacgtaaagtatgcttttagtttatatgaattttattgacacaagaacagttctgctttttaatacagaagactaagaaccattttcattaattttaaaattgtataatttatattcttttaaattaagttataaaagatttacttgtttaatacaaaagtaaattcttccactttcttgataattaatggagatcggaaatctgttataatttttgataaaacacagagaagatttatatttcagaaatagttcaccacatatttagacctgtcacgtactgtctgtcaattactggtagttttgcagaagaatactgaagagttcaatatattcaagcaataaaatattattcttaaaaccaatcaaccaaccagctaaaaaataaattgtggacaaggagaaaaaaaaaaagaaaggaaagacctactctgaatatctttcatcagtttcaggctgtgctaaatgcaatgtaatatcacttcatggatttatgagaagatacctaggtaggctttcagtaatgtagccatagttcggagctgcaggcacaccgtcagcacacgcttggtgaaatggagacatgagagccaatttcaggaatttttataataatttgagaagtcattaactgccttttttagataaattgtttcatgaaacagacagagtgtgacagacccagctgattcatgatctcatcctatgtctattcagttcctcagtttcttccctactatgaaaaaaatttgaagaagatattcctaagacagctgcgtcaaatcaaccatactgtagaagcaggattgctgccgtggcacagacttggaatatccaacaattacagctctaccttttatcagaacataaaccataactgtgatgtccctcccagcattgctaatgacagtaaaatcttgaaaacaacttgactctttgttaacttgggatagggaaaccaattttagtaggtccatagttacaaatattctgaagacattaaaatatgtgaagtagacatataaattaataaatctagagagatgtttatgttttattaagtgaaaaataggcaaataatttcacagaatatttataatatttgtatcactcttgaaaaggactgaaaacacacatatgccaaacacgtacacatacatatccacaacagtcatatttaaatggtcatgtaaaggcagacttctacgtaatggggcaaaacagaatgtaatttgtacattaggtgatggaattatgggtgaaatttgctttctctaggactgattttatttttcaaaaaaaataagtaaacattatagttttgaaagatgggatgtggatgtgtgtgctcgtagcttatattatgcgttcttcatgactgtatttaatgcatgtctaagctcatgccttttatacaagtgaaacatacacaaaaagaaggtagacaagaagaagtttttaatggatatagccatttaaggcaaaaaagattgtgtttttctttataagaacagtgaaaagacaagctgatgagaaaacacatttggaagtggtagggaatatcttaaatgggtccagaccagttcaacatgaagtcagaagagtgagaaataactacagaagacctgctggctggcgagggctgtgaaccaatttgggattgaggaggaagacaatgaagccccctctgggggtctggggagagcctggagctgggggagcagagaacagggtcacagacaccccacattgaggggaagggagggtggaagggaagcaaggccacataaatgtggaattgagataattggtacccccagctcctgctctgttggaagccatgaagaagctacagcccctctaacaaggcacagcatggccaggccaaagaggatctgagcaggtgggagaaatagcccatgaatggcagcaccttagttttcttgagcttgttagagttttttttctcagcctggctttgttaatcagaatgttgagagcttcagaacttccacagagggtcaatacttcagagcgggggagggagtaaatctacaaagtaagcagaagagatttcaacagtgtgtcaagtgagctgggtctgggcaggccaagagtgctgtgtgaacagccagcaggcagggagccccctgcagtggtgagagtgtcactgaaactcaacagtaacctggcaagcagccacacagggcaagtgggtcaggggtgttaaagagaagcccagacacctgggctcttgtcagaagcaggaaacaccacataagctgaggaggaagggaagaagactgtgcgtgaggagtcctccgccagggaaggctaaggagccaggagagccctcggcaagtgcagccgtaggacccgtgacaggcaaaccctggcaggcgctattaaattatgagcaaaacctaggccagaaaacaagcagaatggggagaaatgtgtctgggaggtgtagggaaagatggacgggagcttttgtgagcagtgcttgtgaaatgtgacagggcatttagctaggagtcatgaagccaatgggatgatttaggcagtatttcaatactgaggctcacagaggttttcattctgttcttgggacacgttcagggtatttctggtgtggtcattgatgatgacagtctgaacgctgtaagaatttagccaaatcatcccacctgctcttcctgatgagggctggtggggtcaggtggccctggcaggtcagaaggtggaggtgaagtgggatgctgacaggtttaaattctatgcactgagccccatttgcaaaaattccacagctgggtgaacttaaacgcttgcttcactgaagcttttgtgtaagtttagctcattttctttaattctacagaacaaacttattttacatataaatttaaagtaaatatggaagtacatgtacacttgaatctgataacttaaatgtgagggtgcataaaaataaaatatgtgtctatcatatttgagttttctgttcatttcccattcatttcattctgtatctctaattttagatagttagatagatgtatggttaggcagacagttgtatggttatagacaaaatcttcggtgccaaaagtttttctatgaaatatacatagtggagcattttaataatactgtttagggttccagaagtcagtcaaatgtgatattaaaacagctcccagaaagcaaatatttgaatagctctggttctcccaatgttaaatgacagactattaaaactggtgatttcaatcccattcaaggacagaacaaatagaatatagaggaatttgacattaacttttcgctctagatgttcttaagtatgtattattccatattccactaactacataagactcctcacaaaacccagcagcacaaaacagaggaactattcagaatcatcaatttcctaagtggattttataaacatgtaacacttaattatgaagacttttgtttgttacagtagaatttaggagggatcctttccatgttttttggtacccattaaccaccctcacctccctacaacccccactacccttcccagcctctgataaacatccttctactatgtccatgagttcaattgattttattagctatctacccacaaagatttttaaaatttataataattaatatatatatatatatatatattcacacacacaaagaatttatgagggatcctgtgggttgagataatttgttcagtccttaagccaaaattatcaaacaaaatacaaacttctttttcacacgcacacacacacacacacacacacacacacacacaccctctctctctttcagaaatggaaaagttcaatatcactctatcattgcctttagggctggtacaaaaacattgtcgtgggggctgcctgtgccacctgttaacgaggataatggtaattgcgtctctctactgtaagcacctttaaatgaaaagtatgacttaacatttaacttctcctctctcaaagctttattagctttcaagcctagctgctcagcctctgatcatagaaagactgccaaaagaggcgaccttggtggatgcccctctcccttcactgccatagggcttaccccctctggacagatctcagcacacttcgtacttcacaggaaagccacaaaaacaatcatcaggtcacaaatgcagttttcaaacacacacataaagcctcacttagagaactgctaagtcaagcagaacccagcacccagtcctttgcagtatcctctttgtaatctgcactttggtggaaactgcagggtaatggcactgtcaaaaaacacagaatggcaagtgcaatggaacacaatacaggcggccaaatccattccaaatattacccacgactgagcttcactgccacaaatatattttgtgtgttacattcagaagacacttctatgaaaataatgttttgtttctctggatatgtattagtacaacatatttggccatttttaggacccaaataatatgtagatttgtgggattcgtggcttggagacagctgtacctatttttaacaaaagacctttaattatggcagaccatcgctgcctctctagtggggtaaaacattccaaacttggccattattactatcatttattcgtgaccatttatgggtcttcactatttgccaaacgctgtgcacaagactggaaattcaaagaggttttagacataggcttccttgaaaagataatttaaacaacatgtctcattatgcaccattaagaaacaaacaaacactctttaaaaagaggcacagtgtttccttttagaggtgagcaagtcctgaattggccccaacagcctctcactgcttgaggctttctttcctctgctttgaggccctatctcctgccttctgcggaaatgcttggagcatggagataatcattttacaattctctccacagtaaaacacatcacagcttcctctacctgtggatactttccccttagtcccctagtaggtgacacaggttttggtttgcctaggacagatagagtctttggttgtttctaggttgattattaatagcattatcaccctttactccaaaggtaacttaagggtaataatgccattggttcagcatttggatcagataataagttatacggtcaactccctaaataaatagtttgttggtttgcaaaaacattgtggaatgtgtgctactactccaatgatgaatggtgcctcagtggtaccctgtgtccactcctccaatgatgaatggtgcctcagaagtaacccgtgtccactcctctgatgatgaatagtgcctcaatagtaccccgtgtcgactcctccaatgatgaatggtgcctcaatggtaccccgtgtccactcctccaatgatgaatggtgcctcaatagcaccccgtgtccactcctccaatgatgaatagtgcctcagtagtaccccgtatcccctcctccaatgacaaatagtgcctcaatagtaccctgtgtccactcctccagtgatgaatggtgcctcaatggaactccgtgttcactcctccaatgatgaatgatgcctcagtagtaccccgtgtccactcctccaatgatgaatggtgcctcagtagtaccccgtgtccacttctccaatgatgaacggtgcctcaatggtaccccgtgtccactcctgcaatgatgaatagtgtctcaatagtaccccatgtccactcctccaatgatgaacggtgcctcaatggtaccccatgtcgactcctccaacgatgaacggtgtctcaatggtaccccgtgtccactcctgcaatgatgaatggtgtctcaatagtaccccgtgtccactcctccaatgatgaatagtgcctcaatagtaccccgtgtccactcctccaatgatgaacggtgtctcaatggtaccccgtgtccactcccgcaatgatgaatagtgcttcagtagtaccccgtgttcactcctccaatgatgaatagtgcctcaatagtaccccgcgtccactcctccaatgatgaatggtgcctcaatagcacctcgtgtccactcctccaatgatgaatggtgtctcagtagtaccccatgttcacctgccgccctgtagttgctcaaggtgtctgaaaaggaaagcgtcctggggcagcaccacgattcgaggtcccagagtagcccagtatgacggcagaattggaatgaaaagataaatgactagaagtgggactgccgtggtggtctggtgacctgtcatgaaagattggtgacatgtaaaggaccatggagaagtgttgaaggatattatgctgaagaataacatcctctgattttaactttgctatcaacgctgttgaaatacaggtgtgtgtaccctgtggcaggaacttccatgagctctcttttagcatatggtatgtgtttgggcaataagtatcaatatttcaaatgtgcaacaacattaccataattccaattcaaagaatttgtcctatggaaataactgcccttggtgtgaacatgaagatcgccatggaatgattgtttgtgatttcaaagactaggcatggtctgaacagaggtttaaaggagtaagctgatgggaagaaatactaagtagccaaaacaaataataaagttcatctgggaatatacgcaacatattgtaacgttgccaagcaacctgtaaatgtgtggaacatcatctaaaatttaaaggcaccgtgaagaagaagaacgaggaggagaaggaagaggaaaaatggaagatgataaaggaaaagaattgggtttttgtgtttataaacacagagatacaagtcttaaaaataagtacccacaattacaatcactgattatcttgagattaaagcatttcaaggtcttcactttctgcttcgtatttgactgtattatatcatgtttaaaataatgatcacatattgattgtattttatacatatatctacatttttgaaaagtacatttcaaatttattgtggaagataaattagaaaatggagagtgaggagagacaaacagctatgagggattaaaacaaaacatatggcaagactactaagaggcccctagagtggacacagtgagaatggaagaggggttgaagacaaaagatattcaagaggtgaaggaattattgctcagctggaggtgacagaggaggaaagccgtgcggaatgaaggtgggttttctggatttcctaacaagatgagtggccagcgtaagggatttagtgtggagggaatttggtgaatgagagacaattgatttttttctggatctgttcactagaaaagacacccagagattccaggacccattcgaacttgtagtgctgggttcagcaaagttgattatataacttatctctgtaaggcacaggaagagcccttgaaataatggaatgcaaagaaattcaaggtccaaagaagaaattatattaatagaaggataatattaacagtagtactgttaattacttagaagcatttccacatgcatcatttctctgagaaacacagaaatgataccattagtgaaggtacctatcattatcatcaccacagttatatggcatatgaggacattgagagtcaagaatttcagtgtcttttctaagatgaaatagctgcaaaatgggcaaagtcaagatgggatcccaggtctgtgaactccagactgattcttctcatgctgtattagtgccctagaagaaacctagaccttgaaagcatgtatttgagaaaaggcagctcctctgagttataaatgactcttaaaatgaatgggagaggaagaaggaatggaaaggctagagaaaagggggaatgagatggcgggatgatataaaaacctagatatttctattgtcttttactgtcttcatggaaaccatgaatttctctcagggtactttttgacataaattagtggaacctaattatcactagcagcctttcaggagaacttttttggctatatatctccttgatttgaccctatcgagctagagaaagcaatttcatttatccttctgtaacacaatggcttagggtaaagggtcttttgtagaatttcatcaccatttactgattgattcttccagttcctatttacttccatgttacagacgcctcacgttgtatttagaatccagattcacagagcatcccaatgggcagtgaaaattacagtgaccactcattatttaacagcaataaaacggcaggcagtgaatacacacatgaaaaaatgcccagcatcactaatcatcaaagaaatacacattagaaccacagtgagatgccacctcacaccagtcagcatggctattattaaaatgtcaaacaataacaaatgttggcaaggatgtgcagaaagcaaatactattggtagcaatgtaaatgagtaagcctctatggaaaacagtatggaagtttctcaaagaactaaaactggaactcccacttcactcagcaattctactactaggtatctactcaaaggaaaggaaatcattctacgaaaaagacacccgcactcctctgttcattatacactattcacaatagcaaagtcatagaatcaacttaagtgtccaacaatggttgatcagataaagaaaatgcggtatctttacaccatggataccacacaatcataaaatgatacatttcttggcaatatggatggaacagaatgtcattatcctaagtaaaataatgcagaaatggaaagtcaaataccacatgttctcgattataaatgggaaccaaacaatgggtacacatggagataaggatggcaacaacagacactggtcactccgaaagtgaggagagaggcaggagagtaaagcttaagaattgcacattgggtaccatgctgatattcaggtgatgggtgtactaccagccccgaccccaccacgatgtagtgtatccatgtgacaaaactggacatatacccgctttaaaaaatttaacaagtaaaattaaaaacagaaaaagaaaaaaaagtagtatctataaagttagtcactgaggaaggagaaatgtatggccctccaggaaggcaggggctagcattcacagacagaggaagccatgcccagaggcttctgcataagcgagggatgcagatgatctcccgtgagctgcgtgtgcctgtgtgcactgcagggcttgccttatctgctacgtcagaaactttgtgaaggaggagtcctgactttacacatcactaccacccatctcataaaacactctgcaggtttagagtaaaaattcggtaccttcttacagatgaacataaccatatgagggaaaagaaaatccaacccacaaaaaaaaaaaaaatccactgtaaataatacagtagtaggtggggaaagatggaaagtgaatgttaaaataatgatgtagaatagagatttgtatcatacttgttaaaggaactctagtggcatggaggccacaaaacatcaactgatgagagagttttagaatctagaaagacttgggaaccctcctttcctctatctgcatcttggtcagtattgctaatgggacacacacacacatgcacacacacacacgtacacacatgcatacacacacatgcacaaacacacatgcacacacacgtgcacatacacatactcacagcatatatatgcacacacacacattaaggttgaacacagatgagtgccacagcaatccaaaatttattttagcctgcttggcaaaatcaaaagttccccacttaaaactctcccttaatatgcttatttttttaactcagtaaaattttatttctagaaatttttctgaaggcaaatatcctggatctgtgaaacaatttatccactgggaatttaaagacactattatagttaataatgaaaaaaaatcacaaagagttacatgttaaacaactgattggttaaaaataataataatacggagcctattggagggtggagggtgggagggggaagaggatcgagaaaaacaactaaggcgcactaggcttatttaccgggtgatgaaataatctgtacaacaaacccccatgacacaagtttaccttttaacaaacctgcacatgtacccatgaacttaaaagttaaaaaaaaaaccaaaccatccatttagtaattatttttaattgcattctattagcccaaaactcttcacaagataatatgaagtcaaagagaaagtagaagcatttagaatgcaatgccattctttgcttggtcatgatctgggtgggaggaattatacagggttgtaatttttcttcattttataaatattttcaagaatttatttcttccccctatttcattgtcctaatgtatttggcactgtgtgactacgttttatttagttgggttttttgtttgttttctaatgtcttccttctaaagtgacatctccgcacaaaccgggattttagtgacttttctcacactccttcccagttatctaaaagtgtgtaatttaaacaattgctgaatataaaaggttttgctttgttgttactcatatcattactattgtatttaagtacgacaaatactaaaaatgagaaaaattgtaaaaaaaagttcaaatgcataaaataggtaacgtattaaaaggtaaaaaaaaaaaaaaaaaaaaaaggaccacatctaagacctgtaaaactaactgagctccaaagaaaataggtatttacacctccctgtatcttaaaccatataaatacacacctcttactcacaaaaaaacaaaacaaaaacacaagtaaaaacattttttaacctggcctggcacagtggctcatacttgtaatcccagcactttgggaggctgaggcgggtggatcatgaggtcaggagttcgagaccagcctggccaatgtagtgaaaccctgtttttagtaaaaatacaaagattagctaggtgtggtggtaggcatctgtaatcacagctactcgggaggctgaagggggagaatttcttgatctcaggaggcggaggttgcagtgagccaagagtatgccatcgcactccagcctaggtgacagaactagactccgtctcaaaaaaacaaaaacagacaaacacaccaacatatttttaaacctatttttcatgaatactaatgttcattcttttgggtacattctgagtatacgatcattaaagttctgtctttttaagctacttttattttgatttgtagttgtatatattttgggggtacacgtgatattttggtacatgtatatgatgcataatgaccaaacagtgtaacaggaatactcatcacttcaaacatgtatctttccttgtgtttggaagattgaaattattttcttctagctattttgaaatatataataaattatcattaactataattttcctactctactattgaatactagaattttttccttttccctaacttaagcaacttttattaagaaaaaaaagaaacggagtaaatcctgtaaacttttctcccaggatgttttttgaatgttttgtcgtcctcagtgtccataaataactcctacacaaacctagacattcattcactcacacctgctaaatagttgcaagtctattgtctacagctgtgctgttattctttacctctgtaacactttacgttgtacactgataagggattagtcttcttagaaatgctggctccacagtatatttgtgtgtgtgtgtgtgtgtgtgtgtgtgtgtgtataatacatgtttgcaagcaaatcaaaagcatggcccttgttctccattttatttctcagctccaagaggaggcagtaaaaataaatctatttagttctgaaagttaagaactgaggtgttataagaaaatcaatccagcagaaagtggagaatgtacgtgcccttgtggcagaaaaaccaaccaaccaaacacacaaaaaacccaaaaaaccacaatcgatcttgaaaggggtgatgacagaggtgtgagagggaagtagtcaccaaaaccaaactcagtttatgaaaaaagttgcaactgttaagcagcagtaacgggtaagtcatagacaatgaaatagctggcacacagagacaaatatgttggagagttgacaaggacacaatcatggatcaacgccataagattaatgatgaatagctaaggaatgctgggcttaatacctaggtgatgggaagcaaagcaccatggcacacatttacctgtgtaacaaacctgcacatcctgcacatggacccctgaacttaaaataaatattgaaaaaaaatactcttacttaactctgtagtgcaagacagcaaaaaaaaaaaaaaaaaaaaaaaaaaaaagagagagatcaagaaagaaagaaagatacatagatagacagatagatagatagagagatagacagatagatagattaatgatgacagccaagatgaactaagggatctgtcaaagcaagttggccaggcgtcctcctttccccagtggcatgggagaaaagtgaacagggcagttggtggagccactgtgtctttgcacggggaaaggtctgattgaataatggggaggctcccttcggtgttataggaaagggtggtgtgtctaatctctacttctccaccaatccgtgaatcgcctccttaataaagtctactgaaccatatctattccaatcacatttcaaaatgtcttaaaccaatatatacaacataggtttctatgttaaccttttaatacttcaaatgcaagtgaatgcctcttcttcatctctctgaatttgttaattcaagttctttaaaaaaaccattgaatcataaaagaagttaaagctccttccctaaaacagatctgataaacatatcaggattttcttgcaagcattaagtttaaagcaaatttttcttatttactagcagttgttcattaagaaacgtgtagtgtaaaaacacaaattgctgtgactaattacataaccctgagatatctctcaaatatattgttttttttttctccccaaatgacatgcaagcatcttgatttaggttcatatcatctttcatagttagaataaggctctagattttcctgcttccagttttgtgccatccgtgatgcggaccaatcttcccaacgtatacgcattctcatgccattcctttcatcaatataatacattgacaccccatttcctttgagaataaaacataaactctttgcctgtcatacgggaccctgtttatatctttctgaccctagtcatttaaaataaacagaaagggaaggaggcggagaagaaggagagggaaaagatggaggagagaaagaggagaggaggcaaacaacaaagagaggagaaaggaaaggggagaaaagacaaggaaaaggaggaggagagggaagaggaaggggatgagaaaaaggaggatgaggaggaagagttgaagaaaagaataacaagaaggtggaggacttagtatttggcaaataatattctaggtgctttaaatcgattacatattcctcacaacaaaatttaaaggtggatagagttaatacaaaaggaaatacgaacggacccaggacatacagccatcccttcactctaggcaccactgtacctagggaccaccgtaccgctcctcctgcacctccaccagcccctcctggtgtgctgtcagtgtgctcagccccggtacacccaacccacctcacctccctttgtccatagaggatgtgaaggtttattgaaaaagaacttagattttcaagaaaaaaaaaccattaaaaagtgggcaaagatatgaacagacacttttcaaaagaatatatacattcagctaagaagcatattaaaaaaaggtcaacatcactgatcattagagacatggaaatcaaaaccacaataagataccatctcacaccagttggaatggctattattaaaaagtcagaatttaacagatgctggtgaggttgtggagaaaaaggaacacttatacactgttggtgagagtgtaaactaggttaacctttgtggaaggcagcgtggtgattcctgacatctaaagacagaaatccatttgcctcagcaatcccattactgggtacatacccaaaagaatataaattgttctatcataaagacacatgcaggtataagttcattgcagcactattgacaatagaaaatacatggagtcaacctaaatgcccatcgatggtagactggataaagaaaattggtacatgtataccatggaatactatgcagccatataaaaagaatgagattttgtcctttgcaggggcatggatgaagccagtatccttagcaaactagcgcagcagcagaaaaccaaatactgcatgttctcacttctaggtgggcaccaaatggtgaaagtacatggacacaaagagggaaacaatggtcactaggaactactggagggtgcagggtgggaggaggcagaggatcagaaaaaacaactgttgggtactgggcttaatacctgggtgatgaatctgtacaacaaaccaccatggcacaagtttacctatataacaaacctgcatgtgtatcccttaacctaaaataaaagttttaaaaataaaataaaaataaaaatataaatgaagacataaaaagtaaataaaaaacaacaaaaggaagaaaggaaggaagggaggggagggggaaggggatgggggaggggaaagagaaagggaaggaaagggaagggaaggaaagggaagggaaaggaaggaaagggagaaagaaaaagcctataatacctatcatctggtatcagctcaaattcccagccttgtttaccgacaatattcccaagcaatgcaactgtacagaaagactggttatttcccctctctgaatttctggaacgtccaaccttcctccacatcctctgagacctctctgcccccttccctcacaccctctgctacttgcctttcttgaacatcctctgcagatccgtcactatttgctgtattaaatgattctgctttctcattatatagttggactccttatcctcatcactctccttcttccttccacacatcatcacacacatgtgttgacatccccatggacgccggagatggaaacccaccaatgactgtgcaggcatccagcatttgtgggaattcatctgatgccttagaaaagttggtactgacagaagccactattagaattacatgtgcttcagagtattgatttacttaatatgtttaaaaataattttataatttccattataaatatataataaaacaaacttataattaaatacttgaaaattcatatgaaagtctttttgagggttataaagtactgatgttcacttgccaaacaaaacaattgttgtggatgtttgagtatttatttccctaatcaaagtttcacatattttgttttactcatcagaacacctgtcagatccatgtgtgctgttgtcaatggcagaatttccttctttttatagctgagtaatatttcattgtgcttgtataatacaccttgagtctgtacagtttttgtcaattatacatcaataaagctggaaacaaagaaaaagaaaactaaacaaagaacaaatcagtaagatgtactaacgttttgagttttttaaatcctcagagtttttaatgagctttaatagcaacaaaagtattgcacaagaagctcaaattagaatcagtagctgaaattatgtcaccacagaatgtatttaaaatgtgtgtgtatatcaatgtatttatctttatatgtatttgagagctatataacagaaacttttaacttagaacacacacctctcattccagctgatatactgtatatgtgtatatataggtgtgtgtgtttatctatgcatatatatatacacatatatatatgtatgcatgcatacatttatacctaaaagatgttagtagaagacaggtcttccatgatatatttaatctttccaatgaagaccctggggataaactttataaaattattcagtagaaggtaggtccttcatgatacatttaaactttccaatgaagaccccagggataaacttttgagagaattttatcttaattactataacacatgtctcacaatatatattactttttcaagaattctgattgcaggactcatcaagagttctgaaaatagctggattgtcaaatgtgtctacaataaaacatatttatacatatcatataatattactttgcattgactttctaccagaataccctggtatgagctgttccaattgtttaaaaatctgcctctccactaaaggaatcttcttgagaggcctttcattttataacttcctgaatagaaaatgctagtttcttctaaaagttttagattttctaacgatagatatttcgtgttccttttgacatgatatagcatgataacatgtgatgtgcattattagggagatgctaagattccgcaagtaattattttgcatgaggagttttacataaatacttgcaataaactgaccatggcagcacttggttatacaacagtcaaagccgagataagactaggaaagagtatgaatcaagagaggattaaatgtttcaaaaaaagagaagtttgtattgactaagagagaattggcgtcggaaactgcttttctgtcctatcttatttcttaaagtttgcagaccaggtcaaacacacaaattgaagtatgcaaattcttcacatccaaaatgcttcactgatgcttctggcaagagtcattgcatggaaactttatgtaactgtttctcttttctcttatgttcaatacgtaatacactttcatcaacgtgcacttaattgagaaacccacttacttggaatgtctcccaaggaatcaaattaagcctaattatacttaatggcaatggctgctgcttaatttggatggtaattctgcttaattgagatgccttcaggtgtctaagtggtgctttgctaagagtattggttgtgcgggtatgtcaacctggaataccttgtttcttctctgaacatttctccgagataaatgacaaagggcaaataattttctgaagcaatataacacaaaataactgaaatttaatgtgttaattattaagtcctcacaatcaagaaaatatatacaatgtctgcataagtgtacacaaagatgagagagaaaaaataaacttctaaaaggagagaagagaattgtataaacccaagctgcctaaattcattactggtcattttatgttttggacaagtttaaaagtccactttaagaaatcaaagaacatacatcatgagttttaatggatgttagccataaaactaaagtaaaaggaagatactgtgattggaatcacatcatatgcaaaagatatactagtgttaattccaacctctttccttggtgtctggcttgcctggatgtgatggatatcactggtcaccatacactaaccgtcggctcctcttcctggcttctagatatttctttccttggctccgtggcaattggaccacaggcatttgacgcaatgggatatgaaggaactcagcagacaaattctaggaaatatgtcttccatctctagccaaacatgcctcatttcattaaacatgaccaaatcgggaactaaagcctcaggtggttgcagacgtcttgagaactgaggggaaatattgtctccgctctagagagggggcaggaaaaatgtcaaacacctgagctgcaatgctatcacggagctactgaatacaacctggaagctccctgactctgcccctttgttatctaaaataaggtatcccccaaactttcggtttttagttggctcttctgttagttacagccaaaaataccctatggaggtagaaaataacctgttctttcatttatttatggtggaaagcaagcaagctaataaagcgttctcacagtgcaatgggacgacaaggagtttcactttccgggatcttgacttcctctctgtcaagtagtaaaaggtttaaacaataggaactctaagcttctttttagatagaatttcaattattctagtatgtgtaggaaaataatagaaactaaaatgtgctataggcacatctttcatatagaataaaaatatttatgattattgatgtataatctggatttaaatgaatttggaaagtggaaactgtgggtattccactccagggcaaaacacttcagtcttttaaaactctgtaatggcacttacaggtggaagatcattctcacgacagctgaggcaaaatttacctccaactgactatgagagaaaaccaacgccatcaacaaggctttcttggactatattctgctttctgcatgctgtcatcctaatttctggtttcctcggctaacaacacacctgtgaattctaaatgtgcctctgcccattccatggacttggatggacagtaggcaccttgctatctctgtgcctaatagcatacacatctcctacataaagaaattggttcctgaagtctgttccctggttaaaggtacggagaacatatattgttctgaactggaaagattttgagaatgcagtagaggcattgttagtaactgttcaaggacagcagagatttaccaagactcctctgcgacagaagcaagaatgctcacctgcctcgagtttgactctcacccacggcgtcatctctctctctcctgtttcccacacccacggcacctactggaggcagctgcagggggaagcctgcaggggtgtgaggtccaagggaatccggtgttctgcgctccccgagctcgggggtcctgtgttcctccctccccatgcttgagggtcttgtgttcctccgtccctgtgctggaaggtctccagtcttgctaagtctccgtctggggcaatttcccctgcaccactccatggtgtctgctctgtttcagaccttatcatctttcatctgaagtactgtattagattccaaactctgcgtctcacgtctccttctggaaaccttttagggtgtacttccgtcctctccaccgaaagggctacaggaagaagtgaagttactgcgtgttcaagttcgtctcctcgtggatccccctaaagcgcagccttcctaaacggtagcccattcatttgacttcaaaagacgcgaaagaaggggatggaaagaaattccacctgtgagtggtatactgagtcggtgtccctgcaggcatttggctccatcctgctagggatggctgcagagctgtgagaattcacctcagagttttctgcccgacccattacaggggcgcattcgagcactccttctccacccaggaagggcggtgggagccccctctcagtccaagtggggctgtgtcaaaaggaggagaagactcctgcaggctttgcaaactctgagggcagagcctggggcagaaagcaggagcttcagggagcagttgagggagggctgaggctctgccactgtgaagcgggctaagagcagggaggtgggcaggagaggggcttggagcaacctcatcacaggcagcagacgcagggagcttcctggagagcccctgattgctgtgtttctcctgcccagcgtttctaattttatgtaatctccactttcacacacttttaaaatttgtgatagattcatgcaattctcataaaactacctggaacatacacaggttaactaaaccattcccttgatttgatctaattaattccttttagctatgttttctttaaaagaaattcaagaagagttccttctgcctctcaaattgcagaagtaacataattctgtattttgaaaatgtcgcaatgggatacttctggtctcgatcacatctcaatccctttaatataaaatatttgcttttatttgagcccctatggaaatgcatgtaatctatttactcttaactcaagtcaacacctaatatagcccccaaacaaactcaattgttcagctatttcctctgtaaagttctactatctaaccttcagaacttttctaaattctcaatatcatatgattttctggagaccaaacagaatattctaattatttaaaagtgtgtaaatgcagaaattagtaaacataattatcaataaactagttatatactatataattttaattcaaattgaaataaaactcttttttgttagacaaattaatgagatggcttagtaaatagttaacaaattgttaataagtgtttttttctatttatcttatgcttgtttctgttacactaccagtattagcagcttataatagataatgatattacatttacttacgcaacatgtggatttatctgtttttcacaactattctctaaggtaaatgctattactatatctctttgcccaaattcatgcaactactaagtggcagagctggttcttaaagtgatgattgcaagtactgaaaaataatagtttcttggtaaaaaactgagtaacaaaccattgagtagcatatagaaaaaacaaggtttgtaccactgtagttgatgtcccagggtacaacacggctctagcatactgagaaataccagaatcaaacttggaggcttttgtcacagcaaagagagcccagaaattcctcagtgtttcagaaagcctgcaacgccctggagttttacccagctctgctcattaaagcttgaatttttacataaataataactgagattttagaactaaaataagccaaccaaaaccaaaggcatctgtgatgaacactttacggaatctaaaatcagaacatttctcttttagaactggcaacccaacagctttgagaggaaactatataaataagatggatattttgacaaaatgtaaaaatgaagagatgatcacttagacacagaactgttagtaataactcaataattggtaaatagtggggttcagtaaatttaatattactataaatataattattttaatattacataatttagtgaaatccatacctataatagtttcctcacagttttttttaagtgaaatcaatatgaagatgtctaccttattttttcttcctactggcaagcatctatattgaacttaaaaggagttaaaaaaattcatttgatagccaatgaaacatgattatgagtatgatttctatcctaagatttaaaatgtagtaacataattgcaaactatgtatgcaaacttacagagaaataacagtattaccctctattactaccctggaggaaatatatattttacacaaagtatttaagaaagaggaaaacacgctcagatgtttaattcttgaaaaacgtatatagcttatgagaagaaacacatgaactgtagaaaacaattcaaaagacagaattgttttttatcttttcttgatatggagtcttgctctgtcgcccaggctggagtgcagtggcacgatcttggcccacttcaagctctgcctcctgggttcaagcgattcctgggcctcagcctctcgaatagctgggatgacaggtgcctgccaccaagcccagctaatttttgttcgtattttttagtagagatggggtttcaccatgttggccagactggttttagaactcctgacctcaagtgatccacccactttggcctcccaaagtgctggcattacaggcttgagcgactgagcccggccaaaagacagtatttttgtgtctgagtatagtaggagcatttctaacacttagtcatactatgcataaatactgtggtatttaagaaagcttgtaatatagtggatgagacctgagttgaaaaagacataagagaaagcactatgatacataaaggaggaatgtagactttctctccagaagcactaaatggcaccacagtgagaatactcactttgcatctgaatctcagactgctctgcaatgaatgtggcatctagacacaggatgcagctggaacttttaaattcaaacagtaaagtgtaagcacggatagcatttgctgggctgtttgcttcaacaatagatcctataagagtgctgtgtgcattaaccacaggggttggaggcggagccttaccttgtccgggtcggtggtggtgatgacccacacacagtgtgcattatcttcatactgaaccggataattaggggaggtaatgacgccgctgggcccacgcagattggatccacatgttctcgctggaaacacatagaaacgacgttattttctacaacattgtgtcagtttggtaaagacataacatttatgggaaatttcaagttagctattatctaatcacagtaaaaaaaaaaaaaaaaatggtgcatggactccaactggggcatggactccagtcagcaagtggattgctcagccggcaggacttttgcttggtatctgcagtgttacgctgggacacttcatttttcccaaaggcctatccactcaccaaaggatctaacagatgacagcctcatgtgcaatgtcaataccaaagtagcccatttcaaatcccagtgtgactcagagtgttcacgtaggtgtcgttgttcagagagtctccatacacacctaattgtgtgcgactgcagtaagatagagggaaaggcaccgccgagtgcaattcaaccagagttaccatctcagctacgtcttacactgtctgacctccaataaattgtgtcttttcaactttaaaaaagggttttggagcagatgatctccaaagtcactttcgagctttagattctattctacaataaactataccaatttctttacagcacaacgcaaataggaacttaaaatttattgcaagtttaaagaaagaaaataggaatggtgactttaaaaataaaaaaaatcttaaagttgaaatgaaagactgagtgaagcatagaaattgcataattctatatatacaacttagtctggaatacaaaaataatttaattggcctccagtttatgaaaggagtttttttttttttaaatcaatacacatattttagaaatataatgtcagcagagactctggttttaacattcataatttaaactgggtttcagaaaggagcagaagaaactaatttcacaagaagaaattaatgtaagagaacttctgcttcattttcctaagacatcctatgacacaaactgacaaaaatttttcataggaaggattaatcctcgtcatagcccatcctctattttttcattccttgagtttaaccctttcttcaagtcagttattattctagcagactcagctacaaaactcagcacaacaggacttgtgacttaacaagggctactttgtggggggacaagaattaaccactgaacgcaggttttccaaagggactcaagaaccagacatttctctcttccatgcatgtcaaaataataataataataataataataataataatacaaatcatggctattcctcataatgcttctttaatctgtaatctactgtgactgttcatctgagatctctcctaaatggttatgcattccctgaccttaggaactgtcctctttctgcatttacctgtccctcctcagcactgtgtaccacgctgcagtcctagacatgtgaaaatgggacaacataatttgagacaactgttcagttgcttcctacttactatggaaataattagctaaaattgacctattctacattgataagtgtgttaaaattaacttttaaaatgctggcatttactgtccaaatgaaaaacaaacatgggtaaaacataactgggtttccgaaactcagtaggtgtgtcattggtctaaaggtcactggacaaaggactggatgaaaacatggacccctcttatacactaatatctcactctctaatgagtctgttttaatgagctgttctcagagaggatcataaactttagatgtgaaatcttaaagccctctaatattagcattatccaactagaaaacctttgaaaaaagtgataataaactctgagttgtaatacctttatgttgcattttcctactttttaacacttcataattaacagctgttataaacatcatgtagcgttcataaatatttgctgatttaattgtgaagcaatgtaaccatattggcattgtcggcctgcatttcaagcttttaaaaagtacatctgaaaaacatctgcaggggaaagtcatttgttacaatcctactgacaaggtgggctcagcctgtcattggcccagatgttcccagccggaaagatccctaaagctggccccgcccatggctttgtgtcctaggtgcctgctgtgaagctggcccctcacttggcttatgaaaattggctaccagcatctcatgaaatgcatctcatgcatcatattttatttgtgaagtaacttttaataaaatatgcataggaagccagcccgtcaccacattttcaggcctatgaagtaccaagtttcacacaaagcaagtcatggacccagttccttcagagacattctttaccaaaagctttcaaattaacccatgtttctttttttaatttagaaatctctgtccgtctttgcaacatattttaataaaaaattgtttattttttgtccatttttttattaagccatcaaaatggtcatctaaaatgaatattgggaatattcagaccagagatttgtgtctgatttgttcatttgtttaactttgccaattagaacaatttttagcatttgattgtttcctcaataaatattagcatagcttctgaataggtgtaacagccttaagtcacataacctaactgtaattatgtaattctaaccctccttcttaggacattgttgaaagcttgtgctactttctcaatgtttgcctttctaaatcttctccaacctaatcatctgcttctttaccatctgatgatgcgccccctatttggctcgttatgatttatttagttattgcctccttgcatctagggttttctactagtcagaatcaccctcagtttttcaaatggcaactaccgtaagttcagccgtgcatgtgtagagaccttattaaacaaccaccctgtggcttgagctgttgtgatttctaccagccgatgtccacacggtggtgaacagagtgtctgttgtcccctagctgtcctgcagctcaccttattacctgggccaggaaagcttacattaatttctctgaatttcatagtggagagagaagagccaacatacagtcctccatctagcacacccactgtcttccctccgtcagcttccagcaccagaagggtataatttctcatgtctaccatatgttacgctttaaaaaattaggtatttggaaaatagaaaaagaagagttagagaagaaaatgggacaggctgagaaagaagagatgacccagggctgagctttgtactgagtagatccaatgagtgagtgtccttgctcagggagctttggtgatgatctgttagggatgcctgctgtcctcccttagaaatcctctagttagacgggaagggcacagcagcctgcgaggcaggaagaataatgggtgtcgagaaaatctcggcagtgcacgcaggcccttgcaaaggaagcggatggctgccattatcttatctaaaaaccatatccgtgttgctttgtcgcctattggggggctgtattgaatacaaatttatctgatgttctgggaggtcacgaaacgatgccataagttctgactcagaaacatagacgtatgaaagtttatcacctgcctctctcttcactcatggactctgctggtttttcacttcatgcaaagaaccgattgggcagctcctcacacaggagacagccgagggaaactgttctgactgggactggacaatttcatagcatccctggaggcagggaaacttctttccttcccttagcttctgtgctaaacaggcattcaattagtcaacgaagtatgtgattaaccagcataattaagtaactacagtataccagtgccaagccagtttttaaaacaagatctctctccgtaagttgccatcgtggatatctgtagacgcacgtttacacaaactatagtagaatgcctctttctactcttgcaaaggccttgcctcttggaaatataacatctaatagagagtaaaattcaccgacatgcttgataaaggtacttggataataactacgacctaatgtacacctgatgttacttgcttggcagttttccagacctgtaaactcaaatttcacttacatcttttctgtctccccagtaaaactagaattcacagaatgataaattgaaaatataaaacgtcaggagggaaagtggaaagggagaagaaaaatgaccaattttggatgccaatgcatgccattttgacatttatccacttaatcaatgaatatttgttaagtataaaataggtttgtttcatgcaatttatcttacttaataaaagtaataacttatctgtttatttaaatgcaattccaggaaatcttatggttctatagtaactactcaattaatcaaattacttgaaagaagaaacattctaattgattaaatttaaattagtgggatttcaggagtcgcattagaagctttttttaaagcaaatttataattacattggatagcctatttctcatatgtttttaggagaaatcatttttatcaagcacaaattttacgtccagattgtgaaccataatgaagataatatatcacagaggctaagaacttcctttccttcaccacacctggttccaggcctggcttaggtagtcagtagctgtctcatcttaacttatttaattttaagccactcagcttatttaattagaataatcataactccacttatgattgctctaaggattgaataaaagaagacaataaagcatttactacatggcctgacatatcacagcaaggccagtgtggtggctcacgcctttaatttcagcattttggaaggctgaggcgggtggattacctgaggtcaggagtttgagaccagcatggccaacatggtgaaaccctgtctctacgaaacatacaaaaattagctgggtgtggtggcaggtgactgtaatcccagctactcaggaggctgaggcagaagaatcccttgagctagggaggtggaagttgcagcgagccaagatagcaccactgtactacagcctgtgtgacagagggagactctgtctcaaaaagaaaagaaaataaaaagaaagaaaaaaagtatacatgcagtgctcatcatgagttgaacactgagggtatggcggagagagaacaaaactaagtttcttgccttcagcaggaaactaacaaacacatggacatataatgtcagaaggagaaaactgctttgaagaaaggcagataaaagatttgtaaagtgagggaaaaggcctgctctgtaagaagtggttttggaaggacgtgggttcagatggcatttgacgaacggcataaatggacagtcacagggatacctggggggaggcggatactccagagaggggaaaccaaatgcaagaatcctaggagagaaacacccctggcaagctctaggaatgtaaatagcaccaacttaaggttagctttcaggttctttgatgtcaatagagtatgagagtagtataagatacaaaactatattattgccaataacttagtaaaaataataaggagaaaaatatattttctcccaggtgaccttcaggtaaaaagtataaagcttcaggagtcaggaaacagcagcagaaatttctccaaattcacaggaattaaaaattaaccgtgtgttcttctgtctaaatctctgagacagtggttacctgatcaaatacacaaaatattatcctgacactggatctataacctggtataaagaagagtcatctttcggggtaaatgatcttcttattactctttaaaaggtcatttctacaagggcagaaaacaccaatggaaaagaaaaagctgtaaaagtttttggtaaatgatgagttcacaaattaagaataatttttagctaacctcatctgaaattccaacgcaataataactttattccctgactctgcctggctccaattagctcacaggtaaccacagttacaactggcaataatactttatttctcttagagggcttttcatctcagggagcaactcaaaatattaactctacagatcaaagtgcattagcattaaagaagttctctacataaatcgcccctaaagactgatggaatgaagtaccagcctgaacattttacttaaaaaaatagaacgatatactcttctctccactttgtttgcttattttaaaaatctactgccagttaaagatactcatacagttttaaacagctcgtaatgtcttaccctgcaaaaaatcataatggttgttttcatattcctaaatgaagtaagcgtaattccaaacaaaatcacttgtataattactgagctatgacaaccattcatctgtttggtaacaggaagaaaaggtaatgttgccccccgttctcagagctaattagctaatgtaagcattggctaaccacaccagcctccagatggaaggatcacttctgactcactgcaatttatcgaatgcttccatcagatattcctgctccagagaaggcatgatcattacttcagagttacagtcccttcatgaaaataggaaccttgagaatcagtccttcctggatgcacctcgctggaatacctttatgctcagaatggacctgatgttcagaccaggggcattttattgcatttcatagacggttgagttgagaatatgtggcagaaacgatcattatcaggccacctttagaggctaagaatgaatcaggaaaattcaaaactatgatgctgtcttttttttttcctttttagtttttgagatgaagttttgctcttgtcacccaggctggagtatagtggcacgatctctgcttactgcaaccgccaccttcgagattcaagtgattctcctgcctcagcctcccgagtagctgggattataggcatgcaccagcatgtctagctaactctgcagagacagagtttcactatgttggccaggttggtcttgaactcctgacctcaggtgatctgcctgccttggcctcccaaagggctgggattacaggcgtgagccaccgcgctggccaatgctgtcttttctgatactattttttgtggtaatggaagagtgacaaatgaacttggaaaatggtccctgctgtaccgaacgtgtcaacagcaaagaacgattccctgtagtctgttttaggtaggatttatccattttcctggacactgtagatatataacgttatctttttataaaaagttataaaagctccacttttataaatgtttttcacctcttctctaatggatgaatccattatcggaagcaaattgagacgctacttaaaaaagggaatggtgacatactcagggttcctaaaagttgccaacctgaggaacttacgtattttaattgaagaaagagtgttctacagagggatgccagccaggaagtggggcacaactcactgggctcatttctcctcttcacaactacaagggtgttgatggtttttcatagtgaggaagaaaatcataactgtaaatgtctaaacttgcgctgtcatatgtggcaactgctagccacacgtggctactgagcacctgaaatgcagctggtctgagatgagctatgctctaagtagaaaatgcacactggatttccaaaacaaagtatgaaaaaaagaaaatatataaaatatctcattatcatatttgtattaactatatgttagcatgatactatttgggagtatttgggttaaataaaatgttattacaattaaattcacctgtttctctttccctttttagtctagctactaaatatttcaaaatcacatacatagtttgggaaataaacacatacctttcccagttactcaatccagcactaacttaggtgctcctgtgaagggattttggaggcataattaaactaccttattaactgactaagttaaggagattattttgtctggcctttacataatcagttgggaagtcttcaaagagggcttagaatttcccttacagagcaactcctgcctgtggacagcagctttgacctcttcctggggagcctggcctcatccctatctttccttcctaacagcctgtctttcagaattcagatatagtgccagccctaccaatcatgtgagccagttccctgatctaagcccacacatttctctccatcctagtggatttgcttctctgcttgaatttttactcacagagtcaactgcttggacatgaggtgttgctgaagcaaatgtgggcacagctttggaaccgggttgtgggtcagagctgcatggttttggggagtgtcatagagaaggcctcaggtgcctcgaatagactgctagtagaaatctatcttgtaaggatactcttgatgggacttggaaagagctagagatattcctggaaaccgaaagaggtggcagaagcttagcagaagtggttctgtgattaggtaggaagcagggtgttcagcgacaaacacagatggacagctaaggagagttgcaggccatgtgtccaagaggccacttgatttcttcttgctgctgatactaaaacatgataggaaagacataaactgaggggaggactatcaaacaaacaggaatcagggctgggtgattttgaaacttctcagcctctgcagatggcaaaagaggctgccatttggaagctacagctgcacaagcattctagacaggaaaggcagagcgtgtggctgcgcagccatgccctgaaacctcagagtgactgtaaggtcagaacacaagtattaggtcccagaaaggatacttttcaagaaattgagggtttcttatccatcttatcaactgatgcaactagatagataaggagcattgtccctctgaagtgtcagcaggagtccaagatggagaaacgattatctcaaaaatatgtgagagcatggcctttgtctaactgagtcaacactagtaaaacccatccactataaaaacacctccttaggaattatttccagcagtataagtcattatttcagacaaaaaattaagtttattacttcaaatacatttttacttcttactaaatttattagaagtaataaacttaataagaactaataagaactgaagtactattcaatgttgatcaaagtatatctaacttaagcagaacgagggaatcatcagtaagaacagaagattgacaaagccaggcactctttgcctgtggagttgaaaggaagaggcagagtcttggcgattactagtaacgttccagaaaactaaaccaaacacaccaaacaagagagaccctgcgaaaaaagtgttctcttccaaaatatgatcaagtgggacacttgaattgacgagaacaggaaaccacaaagaatcctcttctaattatctctaagcgtgagtagctggggggttgagaaggatgggagaaatgtctccaccttcagcctggatggagcagctgtttcctaagtgataagcacctctgagtgtgtgatatctttgggataggatactgagaaagggctttgagtttaagatgagagtcagggccaagaaaggcaatgtcataggtaaacatataaaatcaaataatataaaggcaaatatttaagttactctaaaatactgatttaaaagtaacatttaaaagaatgcacatttactatttgtctaaagtgaactttaaaaataatgaagcctatttcccggatataagagcaagaaaactattgaaggatttttttttccccaaaggaaaaataatccatgtgactcgttcctcctgtataattgggaggcttgtgcatcaccagccctagtgggaacatgaattttagtacagctctttgaagtgcttaagggtcttatgttagaattgaaaaatgcacaatcaaagttgtctagtgacaaaaagaaggggacagccatgtgcatttcctggaccagagattgctgactctcctgaagggtctccatttaagaggtgacaactcgctatcagctgggccatacaccctccctccccttccggtggggcgggtcctgcaaagctgtatcccctgcatgtgactgacccctagtggttatagggaccaggtacaatacagtaaatggggccaaagagtattcttagcttagaggacgatagtgacgtgtttggtaactagttattttcacaggctgcaatgacactatgcttgttgtaccttttttaataactaaaatgcttaaaagtttaaaatgtataagtccattcacgtgaaaagactatatggaaagataaggtattcttacatatgaagctttcctttttagtcaaactagggctttttctcccaaaactaccagtttacataaatcattttatggccaaaattcaaaaacaaaacctccaaacccagcatttctttaattttattattattttcattttaaaacaaccaaaataattttctgcttttcaatatgatttctgtaattctggtaagaatttgtgtatacttcatagcagtaaaaaataagtaatttaacctttgctgacttcgtatgttttattagaaaatgatgatgacaataatgatgaatattttactctgctaactatgttagagattaaagatcatttattaataaaatgatgatttgcaatcaggctaacaattccttttattacttacataattaatacctaaaaaattcaacctcactgcaataggaaagtgaacatttttaggtttgcggggtgcacagaaacctttccggcaggtccagctgtgggacatatattcacacacatgcacactgtttgtgtgtattgatagataccaagttatactcagtatgtgtggatttgctcacatctatcctcaaatgtaaaacacaaaaatattcttggaaatgttagcctctcagcaaattccaaggaaaggtttctgttattacccacatcactatgaaaacatacattactaccgaattctactcttcccatacacaatgcttcatgcttaaattgtatattcataaaaatgccaaccttaaagaaagagataatccaggctttacccaccgcaggtgccttacctcggcagatgggcctgtggtcactccaagcagcgagcgtctctgtaactctctgacaggtgatgcttttagatccctggagcacgtaattgtcctcacatgaaaactgtacatttgcaccaaccctaagccgttaaaaaagaaaaaaaaaaacccaaattatttacagaagacttctttaggaaaaaaaaaaaaatcagcaaaatggctgctacgatcttgttcagttaaaacagcctaagacattaagcaactcattaggtagtatgtatagaggcaaccctgtaatttagcaaaggttataaaatcaaaagacttgggttcagattcctgttgtgccagcttcagaactaaacaaacacatgaaccttaacttgtcatgactaagacagaataaaatagcaaaaatgacttcactgaatagtgtggctttaataagaaaataaatgtgaagaaattttgtaccctgaaaacaagaggaagttggatgtcattcatcgtgaataaatattttacaaaaacaagaagtaaaaaagtctaggttaagaaaatatgtcagtaaagactgtattttgctatcacacatgttaattatatttaaaagaaagctagtgatatttcagaaattcttataggaacagaatattttacttttcttttgtttgtttgtttgttttgttttgagacagagtctcacactgtcacccaggctggagtgcagtggcacgaccttggctcactgcaacctccgcctccggggttcaagctattctcctgcctcagcctcctgagtagctgggactacagatgtgcacaactaggcccggctaatttttgtatttttagtagagacagagtttcaccatgttcgccaggctggtcttcaactcctgacctcaagtgattcacctgcctcagcctctcaaaatgctaggattacaggcgtgagccactgcacccacctgtgttttagaagaaagcaatccatccagcctggatttagagaaaaaactgccctggctccagagctgcatttgcaaacatggagctttacggttgtaaacattaacaagacactgtcacagaacacaaactggacagctgcattcaaaagtgtgagaggcagagatcaggtttgaacaccacccagttacttcttctgagcctggcttctggcattgaattaaatgtaggcttatttaactctctgacaagcgcattgttacaagaggaaattctactcatgtttttagtttgagaaaccacgggttgatgttgaggaaacagaattgaaataaggagatgtgaaggaaaagaagcacagttgtcagtgtggatggatgaagttaatcatagagacaagataggggaaacataaatagatgctttcctttcttgcttagtggaaaaaaaatccatatctataatatcagagtgaatatcattcaagtaacatcgcaccagcatcccccacggcatctatgtaacactctctagggattgccatggatgtcggcaacagccatcaaatcagagtcaaagcaactgggaaaattctaggtaaacaaaattaaacacatttcttttctaaaggggcatctcatcttaataaaacttaatatgcaaaagcttattttagaaaataatgaagagaattcaaaagatgtagacttttccagatttatctgtctaggaagttctttttttcaccaggaatctaggacaactagagttctatggaactaattttgagaaacccggcatcataagaacataatatgtactaatttgaaatgtgaaaaatacaaaaaaacaaaacccagtcgtgattcccattttcattgctagccatcacagttatttaagatatctgtaattgtagacatattctgccgccatcgtttttgatcattggtctgtgtttaaacctcatttaagaaattttcttttaaaaaattgttatatctttgtgttttctattccaggtatcagtctccagttctttctgtttacctacattttaatattcatagttttcatcattctttcaatatattgtcattgaacatctgctatgtgtcacactctaagtaccaaagcggcagaagtgaatagcacaaagccacaatctcatatagataacataatagttaagaaagaaaaaaataaccaaaccaaacataaagaaaacaaaaagtcataaagcaccatgaagaaaataaataaaatgacatgagagtcctcgggtaggaagagttggaatttcagtgtggccacttcttcaatgatccccttaacctgaggcactgatattcagtgtaatattccaggggagttcaaacagaaagggagggatgggggaagcattgcttcaacttagcaagcactatatttcaacgactgcagcacaccaatccttagtcatggagggctctctgctcctataacacctctatctttttcatgcatttttttcctacatccaaccaatattcctttacgtatcagtagcaaattgtattctgttttgagaaaaacaatcaataagcctaaacccccaaagcgcagacaacacaggcaaaaacagacaaacgagatgacatcaaactaaaacccttacgcacagtaaaggaaacaacaaacagagtgaagagacaccctgcagaatgggagaagatgctggagaacaaaatacctgctaatgcgttcatatccacaaatacaaagaactcaaacaagggaatcacaagaaaacaaatcacccatgtaacatatgggcaaaggacctgaatagacatttctttaaagaagacataaaaacgaccaacaggtatatggaaaggtgctccgtgtcactaatcatcagggaaatgcaaattaaaaccacagtgagatatcaactcacacctgttaagatggctattatcaaaaagacaaaaaataataagtgttggtgaggatgtggagaaaagggaacccttgtacattgttgttagaaatgtaaaatatgtaaattagcatactcattatggaaaatagtataggggttgctgaaaaaattaaaaatagaactactacatgatctagaatttcacttctgatcctatatctgaaggaaatgaaatcaatacgttgaagagatatctgcactctcatagtcactgcagcgttactcacaatagccaagtcgtggaatcaatgcaggggtccaacactggactgagaaatggataaagaaaatgtggtgtgtgtgtgtgtgtgtgtgtgtgttcacgcgtgtgtgtacacaatggaatactattcagccttttttaaaaaagaggaaatcttgccatttgtgacaacacagttgatcctgggggaaattatgctaagtaaaatgaaccaggcacagaaagacaagtactgcatgatctcatttctaggtgaaatctggaaaaaatagaactcccagtagcagagtgtgggtatcaggggctggaggaaggagaggaaacaaataatacaaaatttcacttaggagaaataagctcaggagatctactacacagcatggtgactgtagttaataacagcatattgtatacttgaaaattgtctggagagattttgaaagttgtcaccatgaaaaatgacaaatatgtgaagtaatgggtatgttaattagcttgatttgaccatttcacaatgtattcatattccagactctcatgtacaccataaatatctacagtttttctcaattttagaaaagaaaatatcaccactctgactaattgatttcatttctggcaatatatgtttatcatccaaaatataggaaatttctggtgatattcttcagaagacattagagtgtccaacaacaggactgtgcttgactaaatttttttggatatatttgaaagaatgcaacatcgctttataaaaggcaaatataaaatatatgtagcaataaagaaaaataaaaatgacatgtagtaatatagaaaaagaaaaaaggacaatacaaaattgtatgtactgaaaataactatgatctatctatatttatatctaaatattaggaagataggcacaacccatttttgagcggtagtatcacaagtatcacaatacaaatttttgtttatatattcaaatgattatattttttcctgattctattactttataatttaaaagttaaaataaaaacacttaggctgtttctattagaccgttcctttcttctcacccatcaaggtagtcatgtgcactctccaggacctgaactcggctcttactcttctcagatttccaccaaaggaaagttttcaaagactagttcagtggagagcggaggattgctcctgagcttccacaatcatcacctggtatcacaagctagtccagaaatctctgcgcacattcatattcagtacattgagagtacagtatagaacacattccataattacgatcatgaaacctttttgcaaattatcggaaaaagccatcaatagaatatggaagcttctctaatttcaaagcattaaaaatattaacaggagcaacctcttcatttgattgcagctggcaaacagagccaatgtgggtaaacgccattccagcagcacagccgaggaggagactccacgtgggaataaatcaagttgaggcagaaactaaataagaccccaattctaatttattaattcaatcttttgctctcattttatctaacacatgaatcagttcaatttccaagccatgtgtgctttcgatgtcgaatatataataaactaagttttcactgatttatgattactatatttgaagtaatataaatcagatataacatcagataatctaacttggttttctggaaagaagtctcagaggaaaattccaggagaaaaaagctagcagtgcctttctattggcaagttactttagtccgccctagattaattacgttgcacaactgagacaattgttagtagttagtaactgtaagaaatactggagaaccgattttgtgtaagatcaagatacatggtacattgacaataaatatcacacagcaaaagttaactcaaacaaagcagcaaaattttgacttttcaattaaatacaacagggaaacatacattttctgcttcttcaatgcttaacacttctgaaattgctccgtatttgatttcggaagacatttatcaccatataattcactttacctcagtataaagactctttctaagtgagtaaactatttccaaacacgctttagttgtaatacaagcaatttctaaatatggttctcatagagcataactatttgagaacttattaaacattggtatcataactatttttgaaaaataatttgaggtgactcgaagattaaactaatgttcaaaacaggaaatgggttgacttagctgtccgctgtttaccagagattacactaatctactgactggctaggtaaggatctcctacctctcttttcaacccacactgctcagcgtctactgaatctgctgatgcaaccaatagatagatgagagatagatgattgatagatagatagatgatagagagattagatgacagatacacagataaacggagagacagatgatagacaaagagatggatggatggatagatggaaagatggaaagatggatagacagtggatggatagatgataggtacatagattagatagataaatagatgatagatgaatagatggatagatgacagatagctggatggaggaatatatggattagacagatacatagatggatagatacacagatgcatggatagatgaatggatggaaagatagattgatagataaaagacggatggatagatgataggtagatagatacataaatagatgacagacgaatagatggatagatgatagatagatggaggaattgacggattagagagacagataaatagatggatagatacatagatggatagatagatgaatggataggtaagtagatatccatctggttaggtagatagattgacagatgacagatagatggacagaaagataaacaagtggatagatagatacatagatggatagatagctatagaaagacagatatatatctttctgtgttaaaaagtccacttcaaacatatacttcagtactcataaatataaaaggaatatatatatattattaggtatcgaaggtaggcatttaaacatttttgcatcttcagcaaaaagaaaaaatacattaggtaaaatgtttttcagtctcaagcagcagaaaacacaaaaatttgaggaaaccttttcttcagcgtgacattcaagcctggatttgccatatttgtccttgtaaaatggagatggatggcatgggggcagtagctgcagccacactttatcaaaggtttagaaatgttgcttgaatgaaagtatttgcttaagaggaacaaagctgtgagcaggaggaagggtgaatgctgaagggtctatgtgtgtgtttacgtgtgtgtgcacatccgtgtgtgtgtgcacatccgtgtgtgtgtgtgtgtgagtatgcacagctttgatttttcttccccctgtattttactaaaactctgaggacttttgtcctagcacagcacacgttaaaagttacagacttccaaattcacagtgggatccaggtgtacatcatgaaataggtgtaaaggagatgtgatggtaggttctcccacttcctgcttctccactataagaaataaagtcaaagcccacagtgtggaatcgatgagttgcccaaacagcaaaggtggtggcctggccctccccgcaggcaccccatcccaaggagaagtcagaactcctggcctgtgcttggatataggcaggagaggctggaagccctggctggggggtcctgcccagtgagaaggaatggagctgagtcctgcttaaagcggtctggctaccgccagaacttgtcactggagctgtggtgataagtgtgatggtggcgtggaggctgtggaagcccagtgtcatgtttccccaccatacttgggaccaagacccaagctgggtgaggagacagaacaagacagaacccccgcgttgtgtctgtgtgttcaggagtaatgcaggactccttagttcccagctgtggcctcatggagaagcccctgtgtctcctggtgcttcatagagtctggagaaggtgggaggagcccgtgatggagaaggtcaagcccatgagcctcccccaggtccacctgcctccagggcagaggcctaggaaaggttatgactgggagtgagtggcacaggcgggatggaggagagatgcctgctctcactaaggccaaaatgccctctccacagcccgggcccttaacgtccttgagagagagtgaagggatgtccagatctgacttttaacctgcttcactgggaaatcactaattttaactcttttaagaatgaacagataaagttttctgactcagacaaaatgaggatcccacaaaagaaattaccaatcacagtacaaataaaactacattttatacatcagaatttatagacttattaattcaacttcatatatccattttaacttactttgcaaataacactgctatccttattatatatgggtcattctcccatctttgccatctctttctccctatctccctctctctttctctatttttctctttccctgccttcctccatcttacttgattttcacattaaaacactgctttttcccaatacgtagaatcagttatatggggagtttcctgaacaaggtgctaaaaagttttctggaaacgctattagaaagacgacagtgtttttctaactttagagcaacagagtgacgtttgattcaagaaaaggaatgagagaggaaaaaccaaccagaacacctccaatatctaatattcttcagcatcttgaaaacatttagctgctcctcactcttcactcttttccatgggcctctgctatgcccgacctacaggggtttggcactcatttacggccgtccccaaatgcaccagacatgaggcgagccctggaccgtattaatgagctgctagtgtaagagatacttcatcaaacagctcttggtcaatatattaaatctaaattgctatgggaatattaacaaaaaagaactgatttgcctttagtaaaaagataagaagaacttatgctggaaactgaaatttgggttacgtcttgaaagatgcatagaatgtattttttttttccaaaatgagtatatgtgttatggattaaaaaaccaccacagcaaaaccctgttggtaacaaagctgaggtttgttcagacaattgcatataacttggtttgtccaggaatgtttttcaaaggttatttccattaccatggaggctatctcctaccttcctgttttgaagttgcacggtgtccttccccagtagatacaatgacttaggtttataccctctgcctccacctcacctcccttctctcacttctgaggcatataacttagttcctttattgctccatctcaggtttagtctcaggatattaacacaaagcacagaagtatggaagagtgggaggcttgggagaagaggccggttgggaaggtgttaacctccgagggaaccgcggtgtgtcattcaccttgaaatctctcacagcttccagcactgctcatggagcttctgagagccctgcaataaatacctttggaactaatgtgagcaaaaaccaggaggcagaagcaggaattcagaacatctcctagatgtggaagaagcctctgaactgaagggctttaggaagaaaaacacaacccggcctctgtgtgcagtctctcagcatccacgcggcacgtgaacccttgggaacattcatctctattttaaaataaatgctttaggtatcctctccgattgtcctataagggagtttttacactactcagatgggaacttggacaattcaccggatggcctctgctgagggatgccccttagggacacgatcctaataagcaagaccaggaaggctgggaagaccatttgcaagcaagccagccacatgctagggaaacaatgtcccattgtgtgacttgctcagcattccagaaaatgccatcatcggagagatgaatgtgcatctgctgtggatattgaaatgccttttattacccgtttgactttcacacataatgtgtcttttctgggtcattttttcttttcatagcggcaatttttagactcatttcttcaagccttaaggcagtttaacaccactaaaaatgcatcagagagtagatggaactctctagcctgaggaaagaaaggaaactaatattttatgtgatttttagatactgtgtgttagcaatagcccaacaaagatcccttaatgacaatcaaaatataggatggttccagggtataagcaacagtaagcttggagtgattggcaatttccagctgtgactagctctcagaagcaccgcattgacaatgaggtgtgaatttttgtgtgagggaatttgatttaaatgttccaagttatgttataagttcatgtaaacctgccatttgctaaacaacaggactttgtcatgcgaagtagaaaaattaaatcctcacgttcacccacctatctatacaaaggcaaaagctgtttgcacactgtgtgaacgtggaagagggtttggatgcagccaggactgtggggaatcatggcttgggaaggagctttgcccgcaagcccctctcccatcttcttctcttttgtgtctccctgagatccaaggtgaaagcccctttgcctccttcctgacaatttatcagggctttgaggagagcaacgtcagtgcctattttccacgtgggcttaggaagccagaggagactcttcgaactctagaccaaaaggcgttttgcggatcatgctctttgctctgtagctcgagggaggaaacagtgaggagtgtcggaggcagagacatgggagaaggaagcagagctccagcagcctgcaccaccgccccggcagcctgcaccaccgtccagctcacacctccatcatgcatcagcctcacacaatagcagcagacatgagtttgttttacttcatgaacatgcccaggcagcagctggagctaaccaggtacagcatgcagggaagtgacatatattactaaccactcaggtcagggcagacctttggggcctccacgataagtcaacaatggaggaggctgattcccaaatcacagatgagaacgagagactcagagggccctctgctcagcatcatgggatgctggattcaaatgggctttctttttttgtaacttgggaacttatcacttaaatccgtggttgatcagtaaacaatcctaaatacacagagactgttcggcaaatatttcctcccgggcttatatctacacttggcaaaactttgcaattttttttatttatccttcacatctggttgtttgtaattgaccagcaaccacagtatccaggcttaaggagcaccacacaaaacaagagccaggagggtgggcaagagaagaaaacactgctataattcagggcacacacaaacacacacactcacacacacatgcatacatgcataccagtaatcacatgagatccaaaagcatgtttacaagacactaaaagatgtgaatatacttgcaccctacagaagttggcacaatgcaagcgctcagcaaacatgcctcagtttccaagtgcccctcttagcagcacacttctgcctgccttgtttggtgcaatggctcactctgtttctgtggccatgaatccagaacccaggtgctgatgccacccagagccaggagccctgcaagatattggccgataaaacagagccacctcacccaaacgctggctgcactgagcctgctgaggctctggcttcttcagcagacatatgggatgcccaaaatcagagggaatcaatgccccaggggtcatactttgagaaggggacacaggaactgagaggactcatggtaaacatcgggccccaggggtacacccaggctgtctagaggcaccggtgagacagagcatctccctgggctgattctgaagctgagcacagcttcccagcacgtttggcatctctgtctggttccaatttccctcactctcgcttcactggaattaaactgcccctaaagctgatttctatggaatcccaaataaagtagggaactactttcaatgcaagccccaagacctagagaagttattttcaggtcaccaggctattaaatagttgtaaataaaatgcagctgagataaaacatgagccacatgtttttctcaccacaatgcaaggtactgaggccaagaattgtcatttccatatcatacttcttacaactctgaacacagttcttaaaatgtctttgcccagcacatatacaccatggaatactatgcagccataaaaaatgatgagttcatgtcctttgcagggacatggatgaaactggaaaccatcattctcagcaaagtaacacaagaagagaaaaccaaacattgcatgttctcactcataagtgggagttgaacaatgagaatacacggacacagggaggggaacatcacacaccggggcctgtcggggggttggggactaggggagggatagcattagcagaaatacctaatgtaaatgatgagttgatgggtgcagcaaaccaacatggcacatatatacatatgtaacaaacctgcacgttgtgcacatgtaccccagaacttaaggtatattaaaaagtttttctttgtatatctcctctctttatcatttgccctacttcagcccaataaaacactttcttcttaatacagtttatttttctctaccttatattaatcttgggtcattcctagaaataaaatcatatatttcctaacgcatttaacaaaactaagtaggaccaagccaatctgagaaaagggatcctgtggatatcagaaaagagggtgtctagggaagttaatgctaaaattatactgtgctgtgtagatgcatgaactccagctgtaaacatccccagaaaaacagacctgctcggcttcctcgcacctactttcctctatgtagttatgcatttgatggctggtatgtttgctttaacttcttgtcatttagatccagcccttaatgctcacgtcagtctctaggagagaaaggcagggaaagattttccctcagggtttttacacaggctcttcttccttctgggaccgaccgccccataggctcaagtggggacatcctttccttcccatcctccaagccctggctgtgacgtctcccctgagccttcctctacgctctgtctacaacagaggaggacttttctgttgttccttcttttatttgtcctcatcccaagagctcagtacagttcctgagggcttgctcattttgctaaggaaatgaaagaatgaatcagtagctgaagggttgccttggatgctaaaaacctccctagagatggctccaggtagtgatttgtaatttccccccgccccttcttttgagaacagcagatacaaagcacagaaaagctgaaattgggccaggtgcagtgactcacgcctgaaatcccagcactttgggaggccgacacaggtggatcacaaggtcaggagtttgagaccagtctgaccaacataatgaaaccccatctctatgaaaaatacaaaaattaactgggcatggtggagtgcacctgtaatcccagctactcaggaggctgagagaggagaattccgtgaatgtgggaggtaggggttgcagtgagcagagcttgcaacaatgcactccagcctgggtgtcagagcaagactccgtctcaaaaaagaaaagaaaagctgacattggattgcaattgcttactgctgtgtgtgtgtgtgtgtgtgtgtgtctgtgtgtgtgtctgtgtgtgtgtgtgtgtgagatgagggatactgtatatatttaaaggtcctaaatgataaacaaagtgaaatgattactgcagtcaagcaaatgaatgtatccacctcctcatgtggctacgtgtgtatgtgtgggtgctgagaacacctgagatctaccctcttagcaaattctcaggatgcaacacggcattattaaccccaactcagcatcattaaccccaacgcagcattattcaccacaatatagcactattaaatacaacacgacattactaaccccaaagcagcattattaaccacaacgcagcattagtaaccccaacgcagagttagtaaccccaacacagcattagtaaccccaacgcagcattgttaacccccacacagcattgctaaccacaacactgcattattaatcacaatacagcattgttaattaaccacttcatgctatacatcagatccctaggtttattcatcctatgtaactgcagctttatgcctttaacaacatctccattttcctttgagtatctgctgcatgcccagattggcgccaacctataccttgcactcctctcttctttcaccaggtggtccttcccgcttggcatgggcaactcccacttctttcctcctgtctttcatcaaaatctgctgggagcaacagatctgacaaattctttcatacacaagaaagtgtaatggagtgagatggttgactaccttccccttccagaggaagcaacatttcggcacagcaggacgtcttaaagcaaagtgtcggtctctacaattcattgatggcaagctcctggcagcatcattgtgagggcagggaaaatgaccaccacaagaggcacctcctcagctcatcactaagggtagagctggttctgaatgcttgctgaacacttaagaaaagtctagcaggtaaagagagcgaggaattaatttaagacacacacacacataactgcaggtggcatcagcaagctgaaaactgacaaaccattgcttcccgaatctttccaggtatctgtctgtctttctccttttctccttctcctccccattagtataaataggaagcttaggtaaaattcctcataaaatttagaatttggtgccaaagggcatttaatgctgttgaagggtggagtgggtggatttattacctttagatcctagttaaattgataaaccatctaactagctactctatttcccctagaatatgaatacagaaacttaagaggtctctaaaccagcagttctcagcaagggtcaagtgtatcagaatcattcagggttgattggaaaagggacgccaagtgtcaaagactaccactcagagactatgaaatgtcatcctggggatagggtgctcccatttactcacccagcttgccagtatattctctacgatggcaagcaagtattattgctggtggcagtggaaaacgactggtgaccccagatgataagagacagaaaaccattgctctggtctaaagcgaaagtctgcaggggcggtaattttactgagggatccaggcacccacctctatccccactctatcacaggattcagtcataaatagcagtcattgttcttccatgaatgttttgtaacattcatatgcatgttttgcaacattcatatgcatgttttgcaatattgcaaacacagtattttattaattaaataaatgatttcaatacaataaaaaaatggttttgctatgtgattgaaaatgtggatagagaggaaggaattgattgcaatgtcaagaaatgtaaagaactattccaagggggtctctgtactaatctctatgtgcaagaatcagctatgattggacatttttcattcatcccgcatgatatcgtggcagcaagcttgataccaggtcatacatgctagaaacctccatgactcctgtatatcactgctagatgtaggtttgcctctggcttctgagatctaccagtgctgcatcattgtgtccgtgggattcctgttcatgggagctgctcattggcctcacatctttattatttttccaagaacattatttgatggaggccaagatttggtaggatttttgctgcggggaaacaaatcagctgtccttattcttccagcttctgcagacatataggagctgtagaaggcagcagatactgaaagtgttttccaacgatgaggtttccatatacattatcagacgatgtttatgctatcaaacaggtttagaaaagcaagcccatctgtatttagtcacctatctctaatctcatatcacggatgacatacaccaggcaggccaatggttaccaacctcgcttgcacatcagaatcacagcaggcacttataaaaggtctaacattgagttacctacactagtcaccacaatctactgtagaataagatgctgcaaaattttcatggctctgttcagcagcgtcaacaaactttaaggctaatggaagcctgtgaaatcattggtaatatgcagaagagttatcaactataggaacaatattaaagcagtgaacattgaataacaaccagtgcattgatttggggaccattctccctgctccctaatgtttccaattcgtttaaaaactcttcagaatctcaaatgattcattctgtttccccctacgtcttcaccagaaatgtgttgaagcaaaggagagagttagtgttcacagatctgccctagagagagagagggttatagcacattctgtctatagtgatcacgttcccaggaacaggaagtacaatggtggctgtcgggagatgtgggtaggggaggatgggaagttatggctttatgggtatggagtttcagttttgcaggataaaaagaattctggagatggatggtggtcatggttatacaaccatatgaatgtgttaacaccattgaactgcacacttaaaatggtcaggatgctaaattctatattatgtggattttatcacaattaaacattctctttaaaaatcttcatgactggtccatcttcctgaccaattaaaccagaaccttcggggtaactggagtgtgtttaattgcacagtttagagtccccaggaaaaccagatcactttctctctagggcagatcaatgaacactaactctcttctttccttcaacaaatttccggtggaggcatagaggaaagcaaaatgaatcacctgagattctgaagagattttaaaggaattagaaaaattagggagcagggggaatggccccaaaatcaatgcactggttggtcattgaacgttcactgctttaatattgatcctaaactcttttgcatatcactgatgatgatctcacaggcttcttttagcctcaaaggttgttgacactcctgaacagagccatgaaatttttgcagaatcttattctaaagtagaatatggcaaacacatggctaagagtcacagggtgttataattctaatgtatggaagaaataatcacatctcctatttcaacccattcttttacaggaagaattacacacacacacacacacacacacacacacacagaaaaagtgttacagaaggtcattttgaagagcatttatattcaaatagtccccgagatggcatatctgatgatcatgacaaactgggcttttgttgataattcatcaactatgttttgtattttgaagctaacaaattaatataggctcaagtaacaatcacctattttctcagaagactatttaaatgtgtattttattttgatgaaaaaattacttttctactacagatattgaaaagactgtgtaagagagagggaggatattccaccagccctatttggtgaattgcttatcagaagcaagtttagccacacaaatatgatctgaaacattcagagtgtgtcatttttcaaagggacataaaggcttcaaggagtgtcaatgggatattattgtttgtggtatttcttaagtagttcttaaaaaatgcagttgatgctctttgaaagagcagtaatcatcggcaaatatttttcctactctgcttcagtttcctagtaaccatgaatcctccttcaaaagctacctgcctgccttcagttacaggcataggaatatgttatgttccttaaaattttttttaagttgtgaaaacactttggacaatggcaggggacttaggcgcggcaggctcaaatacagcacgtcaggaaaggcttgcgagctaaagcctcctttctttatatgacaaacctggactgagcgcccaatcccactttgtcctccttcaccttactgttttctccactagacaagagagtaaaaatcacttacagaaatgaacactggttcaagaaataagatcatgtttgagtttcaaaaaataaaagacagttctttgtcttccacttagggacatggaatggaaacggattatgtcacaaaggggatttttttccaacaagaaaccaaacttgaatgtttttaaaattccctcttgtattcattatagtttccaaattttcttaaaaaaccccctgatatatgggcttgattctaactttacaaatgtttcatctattagtaaactaaattttttagttgatgggaagaaggaataacaatcataatccaatgatgtccatactttctactttttcttctagttgtacataaatgatctagcaaatggccaaggcttaatgcttaatacagtatatgatgcaaagaaacagcagcttttttattgggaataattatgttcttacaagtttacctgtaaatgaaaattttgcatactgaatcaatatttattgttgccttacaacctgtaaatgtaaatgcattcctgatataaaagtaaaattaaataacttagtgaataatggctgaatgcttccttcgaagcaggctctgtactgaacactggaaacatgatagtgaataaaacaaagttcttctctctacggggctcagaatcttgtgggcagatagaaaatatataaacatgaattatgcttagtgaaatcaaattggaagcatagacgtgcatagaatttctggctggtcagtgctagaaagtcaaaggccagagggagggaggctgcggggggggaccaaaggtccatttcagattgtgtggccaggaagtagcacggaacaggtacctcatggggtgatgctccgaatcttaagatctggattttctctggtcagtatataacacatctcttagcattgctgagaggacagaagatgtcaacatatcatggaaaacacgagaaggatcatagaaatgaagacgtgctaaagaggagagccaataccacataggataccaaccgagatatcagtgtatgcatctgctctaactttataagtatatgaaatctataaagtatataaatgatgacaaataaaatagtaagcaagaaaaggaatcaaaggagccaaaaagcaggtggaaatacaggaggggaagagctagaggtccctagatatctctccattattctctgcatcaggagagaaacattataacatcagtgcccttggacacatgggcataacctgagtgtgcagttttattgcttgtggtatccaagggcatcaacgtgatagcatttctctcttgatgaagacaacagtgagagttatctagggggctctagctacctccacgctctgtgttcacctgcttttgggcttgggcttgtttgacacttttcataataaaatttataatgtgcctttggtttccctcatttcttcatcatttaaaaaaatgattcaataacacaacttaaaagaaagcagttcttttgtttttttcttttgaggagtcactgctggagtgcagtggtgccatctcggcttactgcaacctcagcctcccaggttcaagtgattctcctgcctcagcctcccgagtagctgggactacaggcgcatgccatgtctggctaatttttgtatttttagtagaaacagggtttccctgttttgactaggctggtctcgagctcctgatcttgtgatccacccgcctcggcctcccacagtgctgggtttacaggcgtgcgccatcgcgcccagatgaaagcaattcttactgaaaagaacaccacatttactccctggtttctacacagtccataagtgcaattctttacattttcatgtaacaagagacaggtgcctctgctctcgctggagttgacctacaatggagaaataataaaaccaatgcagcaatactataataactataaataaaattatcaatacgctacaaaaaattaagataactgaatgtggaaactagaaatgagcagttgtttatcacaacacatgggctatggatttgtttctgcttcttattatgtaatttttttccttaatgtacttcagtttctccttccgtttgatgacacataattcataaagcatatttcaaaatagaatgaaaaataaacatggtatcctcgagataaaaatatgctaagacaaagaacagatgttattagcatgaatagtaacatgcacataccaaggacatacattaactattcagtttttaagtcataaatagcactctttcaacccccaaattccctttagagcctaggttatgactctaattttaattgttaatctattctctgatgagcagtgcttaacttaattggtttagcagactattaatgaggttatgtccatatatccctagagactggcttgttagcctcagtttaatccattcaacagaggagtcttctgccttgtgtggggtccggtcatataaaatcaaatcaataaggcgtctcccctttcctacaaaatcacatgattgtaatgagatgatagtaacataaatacatgtataaaactcaaagatgctaggaaacgttgaaatcgggaaatgacaagaagctgggtgtaaagagcccctcgttctgcagagagaagccaaccgtgtgggtgggggaggacagagatgggccaaggtgcagtcacttgtcttttaaggccaggatgcagtgtgagaaatgcattgttaggcaatttggtggttgtgcgaacatcacagagggcccttacacccacccagatggtgtagcctgatacacagctgggcttcatggtacagcctagtcctcccaggctatgaacccatacggcatgttactgtactgagtactgtaggcaattgaacacaatggtaagtgttcgtatatctaagtatacctaaacatagaaaaggagcagaaaagatatggtatgaaagacggaagatgtctcattcatatagggtactccctatgaatggagctggcagggtggaagttgctctgtgtgagtcagtaagtggtgagtgaatgtgagggcctaggacatgactgtacactcctgtagaccttagaaacactgtatccttgggccactataaatttattaatgcttttctttcttcaataataaattaaccttaacttactgtaacaattttacttcgttacaattttttttttttttttgagacagagtctcactgggtccccaggctggggtacagtggcgtgatctccactcagcgcaacctccacttcctgggttcaagtgattctcctgtctcagcctcccaagaagctgggactacaggcacctgccaccacgcccggcaaatttttttgtatttttgtagagacagggtttcaccatgttggccaggatggtctcgatctcttaatctcatgatctgcccacctcagcctcccaaagtgctggcattacaagcgtgagccgccgtgcctggcctaccgtgttacagtttttaacttgtgagttttttgcaataatactcagtttaagacacaaacacatagtacagctgtacaaaagtgttttttcttaatatttttatttcacaagcttttttctattgttctttttactttctaaaccttttgttataaactaaaacatgaacaagcgcactagcctaggcctgcacgacgtcaggatcattaatatcactgttttccacctccacagcttgtcccactgggaagtcttcaggggcaaggacacacataaatgaagctgtcatgtccaatgatcacaattccttcttctggataccacctgaaggacctgcctggggctgtttacagttaacttttgtgttttttataagcagacggagtatactctaaaataacagtagaaagtataccattgtaaatgcatgaactactaagacagtcattgattctcattatcaagtatgtgctagccttttctgtgactggcagcacagtacatctgtcttacatcaagactgccgcaaacatgtgaggactgctctgtgctgggagggagcagagctaggagatcaccaggcaatggaaatctttcagctccattaaaatcttaagggaaaaccatcatatatgcagtccattgttaggcagtgtatgactggatattctatttacaaaaagaacaaaaaattttacggagaactattccatatcagtcggttttgcctattaaagcccctcctctgtatctccattaactggcaatactcctttgtggaaagactcaaatgagaagaatcagcatggctggtgttggtgtggcagaaaggagatgatacttgaggaagaacatgactaagaagtaaaggaagtagccaggcacagtggttcatgcctgtaatcccagcactttgggaggccaaggcaggcggatcacttgaggtcaggagttcaagaccagcctggcaaacatgggaaaaccctgtctctactaaaaatacaaaataattagccagccgtggtggtatgtgcctgtaatgccatctactcaggaggctgaggccggagaattgtttgaacctgggaggtggagaggttgcagtgagccaagattgtgccactgccctccagcctgggcaacagagcaagaagccatctcaaaaaaaaaaaaaaaaaaagtaaaggaagaaagacaggacactgaaggtgggcaggtgccacctgcagaggaggtagtgtcaggacagatattgcagctcatgcagaatcagggctgtggccacatggagctctttatggatagacatgaagggggccacattgtggaagaaaagagaaaagggacatggaagcagttgagaagctcaagtttcagagaattcagggagctccctaagttcagtttcagcatctttgaaatgttcttaaaaggatagaagaatttgaaattatatattaaaaaaatatggctgggcgctgtggctcacgcctgtaatcccagcacttagggaggccaaggtgggtggatcacgaggtcaggagtttgagacgagcctggccaacatagtgaaaccccgtctctattaaaaatgcaaaaaaattagccgggcatggtagcacacgcctgtaatcccagctactcaggaggctgaggcaggagaattgcttgaacttgagaggtggaggctgcagtaagccgacatcatgccactgcactccagcctggacaacagagtgagactctgtctcaaaaaaaaaaaaaaatcataacgtccagcagtgtgcatcacggccaatgctagtctatgtggatccgtggtgccaattacaacatgacacaccccttgcagtgatcaattaaaccaagattgtccttctgctcagcatatgcaatgcatgctaagctgcagggcttggaatgctgagctcaagggcaaatttcaaccataccttgactcctcattggctactttgtgaagtccgcacactacacacccctttccagcggtcctgcatagtgagtgtaaaaacttctattataattatctgtgttacaaactaccaaggtcaatagaagctttgatatcagtaggatccagctctgactctgacaagatatagcactttgttaggttagcgttctgaatttcaacgcttctacttataaacatgaggataattacatctgcctggacataggctacatatcctgttagcacagaaagacagatgaacaatagatgacagtacccacccataaattctcaataccaatctgagctccctccctcagatattggtatttgaatacttccatcaatcttactgataaatattcaattgtgatgaatacactttgtcttttagacagtggtctatggtgaaaaatactgtcagcaaactgtccccaaactgacttgaattcaaataagcaagctttgtattttatgctttattttcttcgggtattttatacataatgatagaattaatatttaggttgtctacggaaaagggatttctcaagaacccagaataatactataaatgaaaccagatgaggaatattttaccagcctaaaaaagtgaactctttttaacaaaacagccccaagttacatatttacaagggctacactgcaaatgagctcatctacgcatcttggccttgttggttgttagtttggattacatgttagtcattagttttgattataagaatttaaaaaaaaaaaaaccgaattacctttcattaaagagagtctcaaaagaaaagactgttaaaaagtatcttccctttttttttttttttttttttttttgagacagagtcttgctctgtcccccaggctgaagtgaagtggtgcgatctcggctcctgggttcaaacgattctcctgcctcagcctcccaagtagctgggactacgggcgcacaccaacatgcccagctaatttttgtatttttagtagagacaggatttcaacttgttggccaggctggtctcaaaatcctgacctcgagattcacccaccttagcctacagcacccagccttccctccttttaaaacatcaacatttgtaatgaactgattatatgagaggcccaccatgtgtcatttcatctaagtgtcataaggcatccttacttggctgtagtccagcagcttccatatgaatacaatgggttttactatcccatggaacataaatagtagatataaacaataaatcgatatgtgggctgggcacggtatcagtaattccagcaattttgaatgtcaaggagggaggactgcttgaggccaggagttagaaaccagcctaggcaacacagcgagaccttgtctttacaaaaatcttttaacaaattaattgagtcagtggctcatgcttatactcccaactacacaggagatcgaagtgggacgatcatttgagccctggagttcgagattacagtactccaggctgagtgacaagtaacagattgtctctataaaaataaataggtcatataagtatataatataggtcatgtacacatataaatataggtcatgtacatcagatgcccatgatcactacacaatcctaagctaccagtatagatgacattcacttcaattcaactcaatttttcttgtaacatagcaaatatcttactataatgtttctttcttcatatgttctttctcttaactccaattataatttttatgctcagtagaattgcatacttaatgcatctctttttaaggtgtgccccacagatgcctggaaaggtggaattttagaaggtctgtgaggtcaaaatcattttacaatactctaaggtgttatgtgccttcttcactgagttgccttttccattgacagtgcagaaacaatgatgggaaaaactgatggcgatttcgcaccagtcaagcaacagcaccaggcagtaggagagaaaaggtgcagtgtcacttaaaccaaacaccgcatgttctcactcataggtgggaactgaacaatgagaacacatggacacaggaaggggaacatcacactctgcgaactgttgtggggtggggggaggggggagggatagcatcgggagatatacctaatgctaaatgacgagttaatggctgcagcacaccagcatggcacatgtatacatacgtaactaacctgcacattgtgcacatgtaccctaaaaacttaaagtataataataataaagttaaattaaaaaaaaaaagaaagtccttgagggagcagggaaaatgattgttttaataaatcataacacttgaatacgtaatgtgtctctagggcttggtgaagcctgagggagctctggaggaacaaacatctatgtaattgtttgagttttgagttgagctggctgcttgcttttctactgaactcctcttaatttaaagaacgatagaccaactatcactgctaagattggagtatctctcacttatttataaaaactgaatgagtcttttacttcaaggaaaatgacaaaatttgagcccatgacaaagttaaagttttctaattttcattagtaataaaattgtaattttcatttgtaattttctaacgaaaattagaaaattttcaaaagctggtatctatcatcatgagtttgacagtttttcaatgctttcagatcctcctaatgaaatacatggtaatatcaacaaatgtatttttgtaaataatgtataggacaatgtataaatatttgaaagaactcataactcgatgaatcattattttcaaatgaccaatgtatgaggtacaaaatcatgcatatacaaaaaattaatttaggacagaagttcagccaataaattttgatgtaagaaaataaaaaatgtttattttcaaaaccccatatccaaattgcatctaaaatttaagatgacatcatttgccaatttttgttatagtatcaaataatatactcagttatttgaaaagatttttaaaatactaatttccttttcagctatatgtacaactggatttttaaaaatatttaattaaaacaatgttgtgcaacagattgaatatagaaacatatataacaatccatatattatagactaacaataattcaaagaaagctaaaatggctatgcaaatgtaagacaaatttgatttcagagtaaaaaatgttactcagggtaaagaaagtcatttcataacaaaaggtattgaagaaacaaaaatacacagcaattttaaacatttgcgtacctaattacagagcttcaaaatacatgaagcaaaaactgataaagctgcaatgagaaatagacagattcacaattttagtagatgatttagataaatctctctcaatcacagatctgacaagtgttaagaaaattagtagggatcacaaagccttgaacaacactgtcaaccaacttgatctaactgacatttatggaacacttcacccaacaacactaaaatatgtgttattttcaagtggtcatggaacatttaccaagatagagcatattcttgcccataaagcaattatcaaaacattttttaaagttcagatcctttaaagcataatctctaaccatgcagattcttagaaaatgttcagtatatggcaacaaaatagaaaactttcaaataaatcatggaacaaaaaagtaatcacaagggaaaatagaatgtaattcaagctgcaggaaaatgaaaacacagcatatcaaaattgaagagatgcagccaaagcattacttagaggaaaattgatagcagtaaatacccacatttagaaagaataaaggtcttaaatcactgatctcagcttcaactttaagagactagaaaaagaagaacaaatggagcccatagtaaacagaggaaataaattaataagaggtcagagcagaaatcaatgaaattgaagagaaactaaacaatacagaaatgtatgtaaaagtaaattgtatttttttgagaagttcaataatattgacatgttaataggcagatggaacaagtaaaatttttttaaaaatatgaatatcaagaatttgagctgtgaaattactactcatttaaaggataataaagaaagataagaataattttaagccaacaaatttgacaacttagattaaaatttataatttcttgaaagatacacactatcaaagctcactgaagtagaagtagatcatctacataagcctgtaagtagaaaagaaattcaatccgtaattaaaaacctacttgtaagaaaattccaattccaggtagcttccctggtgaattattccaaacatttagcaatgaaatattaacaattatacacaaactcttctatggtattccagagaagagaacatttttcaattaattttgagaccatttttactctgacaggaacaacaaagtctttataagaaaagtctacagcctatcataactcataaaaatacctgtaaaaaaactaaacaacattttaacaagtcaaattcaacaatccataaaaagaaaaaaacatcattacaaattaatattatttcagaatatgagtttttaacttagggaaattagttaagccctcatattcacaaaatatacaaacaaaaaatggtcatgtcaatagatgtagaaacttttgaaaaaattccaaattcatgtcagattaaaacacacacacacacacacacacacacacacacacacctcaaaaaattacaaacagaaggatacttcctcaaactgataaagggcatctatgaaaaaccaacaagcaatgtcataactataatgaaagccagaacactttccacctaagctcaggaataaaggcagagatgtctcaccatttctactcaatcttgtaaaatagtttcttaccaatacatttaaagaagaaaaagaaataaaaaaaatccgattggaaagcaaaaattaaaaatccttttatttgtagataacaaaatcacctagggagaaagttctaggaaatctatcaaaaaagctactatataactagcttgtctctgttatgtatatattcgtatacacatacacacaccatagacgatacaaataacattttacatgtgtatttaagagaaaatttaatctttcaaatcatcttcccaggtgttatggcatttgatttctattgctacaaacatagagacatataaacaacatagtgatttcccaaaaaactaggaaagtgacagattgaaattctcttctgagataagattctacagaaaccttatctatattctttccctgacgggctatacgtctgcacaacctagattctccctacaccgccccccgagccagatcaacacagccctcagacttaatgttcatcctgaatttaaacctcttcttcagaaataagtctgatctgagaatgaaatggagtaaagattggcttactcacctaggatatgattaaaacttccatgattgcccatgtgctaagaagacattggcctgaatattcacaacttccctgttaacttttaaagcttaagcatttcctctgtcatttttttaaaacatgaagtgcaatttgaagaatttgatattctcagatatgagttaatttgttttgtttttagaatacagctctgcaaaattcaccaaagaagtttctaggtttctgggatgacaggatacaagatgggcagttcctctgatacacaaagtatatatcacacatagatgagtttctttgtgccacgcacagttttagtcactgaggatgcaaagataagacactctccattctggagacgcttaagacaggtgagaaaacagatgtgtgagcacatcgtgatgatgcactgttgtcaactctgacaaaggggcacagaaggaaagggaagggaagcaggaagaagatttttcctcgacaagagggacatgaaagacatgactgttgacacaaggaaggaatacatagaatggggagcccttggaagaatgggcaattttatttcgttgctttgttttcaaaagagataaaattcctgaatgacttcaaatgactgctgttttctaatatgatactggaaaccagcatccttctgttagctgccagctggtgcatccacacaccacactcactgcattgctaataactgttcacaaccaactcttcctctggagaacttccttgagccaaaggaaggaagccatttattgacagacagcaaagtgggtacaaaaggtgaggcctgcttgtcagtacagtttgtgccccagaactcgccatggaaacagactgaagtgagtctccagtaaaaacatccttctgcttagctctttactccaattctattccacttcctctactcccctcctccagagaccacttttccaataaatcacttcaataagaaatttcatctcaagctctgcctcaaatggatttcagcgaaaacacaaacttcttaatatattagtcaagatgtgtaatagttaacctatatccattccgacactatttcttcacatctatactttgtatgcttttcatgtaaaacaatataccattttaccaacttcaatatagacacactacagttttcttatttttctattgcttttaaaacgaccgttgttactccaatttaactaaaaaacattccttctttcctctctaatagtagcagtacttttcttccatttgtagcccacttcagcagccttagctctgtgaacctttttttggatttttttcaaaaatggtgacattgtaagaaggaaaaacacatatcttgtttctctttactattttattttacagctgcttctaataattgcatccatcttgtaagatggaaaatgttacatttcttgaactcactgaaataagtgcaaaaatctaaagtaataggactattataatcactactgtattcataatgtagcaacagaaaatcagtatctagttcaccataatcctagtaaaatgatatgcattttctgaataaactttactgactgatactaacatgcatcattcctaaagttttttaatgaaataactatgaggagataattaaatattttaccttctatctttaaacattaaaagaattggaatatgacatttacatggtttggctctgtccccacgcaaatctcatctggaactgtagcatccataatctccacatgtcatgggagggaccggtgagaggcaattgaatcatggggtcagttaccctcatgctgttctcatgttagtgagtgagttctcatgagatctgatggttttttaagaggattttcctccacttcgctcattcttctccttcctgtcaccatatgaagaaggatgtgtttgcttccccttctgccatgattgtaagtttcctgagacctcctcaaccatgctgaactatgagtcaattaaacgtctttcctttataaattacccactctctggtatgcctttattagcagtgtgagaagggactaatacagaacttttaacagattataaacaaaaaacaaaatctctgaagacaaattgtgattacacacatttagagttaatgattaagaagttttatctttacctcaaaagaacaaaagagttaaatttaactgcaagctgaaataatatatgtcttaaaaataacatgcttttttccaccactattgtatctcttacctgaagtcggaacctgctcttctaccattttctggaatcccaggatctggacacatgtcagagaccaatgcaacacctccttggctcactgtaatagacagaaacattgtcaaaatgctgtatagttattgaggaaatacccagataaaaaatttattctaggcattttcagttctttaatgataatgacttaaaatgtgatctccaaaggaattaagacaccttaaatacattcaaataagtgtttatattctgattggtgaaaatcaaacatgtgttttccagtgaaaggatgataatctttggttttatttctctcatttttaagatgtcaaaatttaataaaaaatctcatttggtccttatgattacttttatgccaggtcacaattaacagcatgatcagaaaaacagcattatgagaaaaacgcatacacttagagagaagaaagtcttcacttattcccatagatgacaacagagatgatatttactaacttctatacaaaagatactttaaataacattatgtatattttaaacattgaagtgcttatcattgaactaaaacccataatggtttctttgttcaaatgcactgatttatttctcgaatttcatggaaaaacttttctcctgttgggacttgcaccatcacagaataatttctaaagaactcatttgtttattggatagagtagctctcacttcaacattcatttcatcctgtataatttgtctaatcaaactaacacatttctttttttttctcccaggaatttgcttagcagagggcttgggacccaattcagtataatgagatgtgaggggaagtccacaggagtacttctgggaaacattacaggatgctaataaagtgcatatctattttactctgaaaatttctgtgtccaggtttcaaatgtagaactattgctgccattttcctataatccaaggatggagacaacagcatgtatgcaacagaaaagatgtgtcaagaacctggacctgctaccttattgttaaggcagaaaatcaaccaatttaggagcaatgtcgcaattctgaacattctgttgtatttattatagctgatttactatagcgtaaatccaatgaatagctgattctattatttgtagctgaaaggtatacatataaatatacattttctcacaaatattttaaataattccgtgagaagaaaataatatgtctgggtatatgtggaactcgtgaagcatttgattaaaattaccataaaaacaacagtaatcatatcaagtttagcttagtttgtttgttttgagacaggatctcactctgttgcccaggtgggagtgcagtggcacaatcatggatcactgcagcctcaacctcccaggatcaagcgatactcccgtctcagcctccctaatagctggtaacacaggcttgtgccaccgtgcccagataattaaaaaaaaaatcttttctagagatggagtctcactatgtttcccagactggtctcaaactcctggctcaagtgacactcgcactgtggcctcctaaagtgttggggttacagacatgtgcaaccacacccagtcaaaatttatcttttactactaaatgagaataaatttgggtaacataatccttcattaaatacaaattctattgaatatattatgtggtttcattcttagtaagtacttcactattccaaacgggttaagatattttttaggtatttttatttcttttttaaaataagttttttttaataacatctaaacattattttgctgcatgatgtgacaattatattgaattccaaaattttattttctaaatgtttaattttctcaatattatatcaaaataatccagcaagtttggtgatagcatcagtagatagtgagacagaaagctccagacctgtatttccctatggaaacaccaaagaaatgactaccagaagattaaaataattttacaggagcgctaaatgacagtaaaaaaatctgtaacaaccaagcaaatgcccaatgaagaaaaagatgttcaaaataggactatatttcatgatgtcttactctcccttgtttcataccatgacttgcgtggcacagtgcagttgagaggaagcggcccagtgaccagtttcctctctaggtatgaagaagcagagagaaagtggctggcagcacgatggtcgctctgtgggctgcctgagagactgagctctgtctttcctgacttgcaggtcagatgaggaagggcggcataattgggatctctggctagcagccatgaaaggctgtgacaagcactgctgtatagaaaactgcagcaagattgcaaacccatgggtacactggggtaagggattccaggcagaggaatacaatagaacacatatctaaggtcccaatgagaagatgaggttagattctttggaatattaatatgtttaaaagcagctggggaaaaaaataaaaacaaaaatacagcaaaatgtacacacaaacccagacaggacatgtaccccccaaaaacgtgaaaacacctaaagtcttcagtccaggttgatctcaacgttcagaggcccactaattagtgaacattttctaccgtgttctgcaaacatggagcacggtagttaatttttttcaaatgcttatttttttttaacaaaaaccacaaggcatacaaagaaagagggaaacatggccattcaaagggtcgaaataaatctctagatacagtcactgaagaaatatatgcatcagacttgctagacaatgaatttacaacaacaattatagatatgaatttaaataaaggaatataaactttccaaatttgaggaaagacatagatgtacaaattcaaggagattaatgaacacctagtaggataaacatcaagagatccacagcaagacacataataatcaaactgttaggagccaaagaaaaagagagaatcttaaaagcagaaagagaaaagcaagtcctcataaacaagggatccataataagactatcaacaggtttctccatagacatttcacaggttagaaagcaatggataggctgggcacggtggctcacacaacgtaatatattcaatagaatttgtatttaattccaacactttgggaggctgaggtgggtggatcacttgacgtcaggaattcaagactggcctggccaacatagtgaaaccccatttctactaaaaatataaaaatcagccaggcatggtggcaggcacctgtaatcccagctacttgggaggctgagacaggagaatagcttgaacctgggaggcagatgttgcagtgagctgagactgtgcccctgcattctagcctgggcaacagagcaaggctccaactgaagaaaagaagaaaagaaaagaaaagaaaagcaatggataatatatttaattgctgaaaaaatgtcagctgaaaattctacatctaggaaaaccatccttcaaaaatgaaagggaaattaagacactcccagataatcaaaatagagtgagtttattaccaatgtatgttccctacaagaaagtccttcaagttgaaatgaaagggcactacacagtcacttgaagcctcatgaaaagaaaagggtccctagtacaggtaaatacatgaaaatatatataaaaaagtattatactaagtttgacttaaaacccccatgttcatttcctacagtatttaaagataaatgcataaaataattatgcatttacgctaatagttacattatatataaagatgtaatttacaacagcaatagcataaagtaagggagcagacttgtaaggattgaagttttcgtatatgaatgaagtaaactggtgtcaatttaagatactgccatcattgtaggatgttatatgttatctccatggaaaccataaagaaagtatctatagaatatgtaaaaaagaaaagagaagacaatcacaacgtgacactacaaaaatatcaactaaacatagaggataacagtaatgggacaaaggagggacaaaaatgctgaaagacatatgaaaattgaataacaacaaaatggtaaaagtcagagctaccctttaaataattattttaaatataaattgatttaacgccctgttttaggctgaattatgtccctcctccccgcaaagggttacaccttgaagttctaaacaccagtacctcacaattgactgtatttggagatagagactttaaagaggtaattaacttaaagtgtcatccttaaggtgagccctaatccaacatgactggtgcccttctaagaagggtaagttagcagaagaatacataaaggaaagtccatgtgaagacacaagaagagagtcatccacaagacaaggagagagcgcttagaagaaaccaaccctgcccaaaccttgatctcaggcttctaccctctagaattgtggtaaagtgaatttctgttgtttaagccactcggcgagtagcgtagcactttttttatggcagccctcgaaaatgaatcaccccaaaccaaagacataggttggcaggaggcgttgaatagtaagttaataagtaacagaatgcaactgtatgttgcccacaagagactcactttaggcgtaaggacacaaagaggttaaaaacgaagagtaatcaaagtcagagagccagaaagtagaatgatggttttgccaggggctggggcaaagggaaagagaagaaggaatataaggtgttattgtgtaaagtacttcagcggagtatgatgaaaatttacagagatgaatagtggtgatggatgtacaatagcatcaatatatttaaagccacagaaatgcatggtttttacttttcttttcttacttttttttctttttttgagacagaatcttgttctgttgcccaggctgcagtgcagtggcataatcatggctcactgcagccttcgtcttccatgctccagcaatcctcccaaatagctgcaactacaggtgcatgccaccactcccagctaatgttttattattattattattttattattattattattattttgtagaaacagggtttcaccatattgcccaggctggtctcaaactcctgggctcaaacaattctcccacctcgacgtcccaaagtgctggaattacagtaagttatcgtgtccaaccagaagtgtatgcttataatggttaaaaccagcaagcctgatgttacttctgtcttatgtctctctctctctttgtgtgtgtgtgtatgtgtgtgtgtgtgtgtgtgtgtgtgtttgaataggtctgtatttctaacattctgatactctactacttttctcttcaagcccatgttttcacagtctgcactatgtgctggggtacagttctcaatgagtaagcagtggtctactactagctctctgaaatttatcttgtaaatgcatttagctttaataatttcaaaatgtaatgcagattgttacttctgccacgtttattctttctgccatcacaggctggatgtcttctatactacctcaagcaaaatcattattgctgtggcaaattaaaacagcttcatcaagatgaacgactatcattgatgtttgtcagaaataatagactctagcttggtagttaatgcacttttccacaatacccaaactggttgaaaatacaacacaccaaggcttacaaaggcccacttgcatgtctccttttctatttttctcacaaggaatagcagttaaaagaaatggcagaaattggagctacctgcccaagttgggcaaaaacactctggatctttttaaagataatgccaaagtcacttactaaaaaaaggttacttagttggaattctgtgaaggcgcaaaatgatttagacaagcctgaatggattgcagatggtagaagataacaaaaagtgattagagattaaatgtaaaatacaggcgattttctgaaacagagggagttgtttcgtgtgataaacagtcagaaaaagtatgctgacacactgtatgtgcaaggaaatgatagctccataaatcccaactatgtattccatccacaccatgagtcattgattcatctagaaataaaagctccaaggttggaaagaatcatggagatgaaaccacttcaagaggaatccttagtacctcagagaaacattttcaaagagaggaattactgggcttaatatcactttaactctaattttgttgaattatatcttttcagatctcatagaacacatgacatagatagtaataaatatgttaaatgtaagtcaaaaccctgtagttaaaaatcaaaactgaaaatatcaatagattggttcattacacaccattaatattaaagaaagatatgtaattatgcaagtggatgatcagatataaattagacagtttgtaaaagagtttaaatgaatttgattttaaaagtataaattacatatattttcaatgactttttcaaagcatgttgatttataatacctcattagatctgcacaaaaccttgtgactctgcagggcagtaaagaaaattcttcttcatcaaattaccctgctgtttgaggacatgccatgtaagtatcaattaaaactcaacatgaatttctttgtagcaaactatagaagtagatcaggtgccatcatgaataaagcaagtgtctgaaaagaagtataagcaacgacatctatgacagagattagaaacaaatcaattagtggagataagatctatatgagtgaataatcagaattaattacaaatgaagcgctaaaaataattacaatgatacaaaattaagcttatgtgtttgctagaaactcttagtatcatttacatatgtttttaaatgtaatccttataatcaggctatgaattgttaatattaaacccattttataagaaagaaaactgaggccagagttaagaatgagctgactccagggccgggcgtgggggctcatgcctgtaatcctagcactttgggaggccaaggcaggcagatcacctgaggtgaggagttcaagactagactgaacaacatggagaaaccctgtctctactaaaaattaaaaaaattagctgggcgtgctggtgtgcatctgtaatcccagctactctggaggctgaggcaggagaatcgcttgaacccgggaggcggagtttgcagtaagctgagattgcaccactgcactccagcctgggtgacagaacaaaactccacaaaaaaacaaaacaaaacaaaaaaaaaacctttctgtactctggccataattaccttatgagacattatgcgttgaagggctttgtaaactaaagagacacttttggttaataaaaacttatttttatttcttaaaagttgccttcctttcataaaatttaattaataataaaaatacactgagcatccaaaagaaaaatgaagaggtgttttcatttatattcccaaccaaacatacacatgggaagccatatggtttcaaccacgagtctttagtccaaaccatctgttagcaaatttccttcagctaagaggaaagagaaagactttccatggagaatataatccacctttagagaacaagagccacagattggcttgaatgttaaatctctatgtaaggtgtcattttaagttaaacgttgatttatatttggaataaataaaccaatataagagccatttagataaactcacactttttagcacgaaggcacttacgattgattattattgtctattttcattgttggtacttgtttcttcaaagatgtacagatgtatttcagttggatcagttttgagacaaactgtaaccatttaagccttcagagaggtgacgtatgtttttatctgcataaccatcaggaaagtggttatacaaaacatgttctcattgaaatttttagtagcagtctccccagtgtattgatgagctttgtttgagtgacagcccactctaggatatgtgtttgagggacactctagacttcagaccttcctgctttactcagtttgaaatatgtcaacaatgacagctttttacttcagcattttgtagactcagtattatctcattgaattgaaaagtaatagctctattttaataaatttctcctctttgatttgcaggaggtttatatctcagcaagaatgaaactttgtcatgccacacccttcttcaaaaactaataacttgattagatgacaatttgaacaataagaaaatgttgccatggtaatcatttctttcttgcagccataagaggataattttgatttacagcatcctacgagacatttctacatgcataacagttttttttttattttttgctgtttttacagaatatttgtacagtctctagcagtagctgttttttctctcatagtagtaaacaaatgtttacaagttctatataaacaggtaaaataagaattgttgacacttggatgataaactcttattatcggagcaacattagaagctttaaatgaatagttcacatagaagtaagttgctcagcacatattgcttttatacgtattgttttagatctcatactaatggatctccaattggacgtgaagagcttccaaccctgagtgagagacaagggctgcattttccaagtgtttaacttattacattgccagatttttttgtctggcccctctttcctctcccactacataccttcatgtgctgacttttaaaacacaaggggttgatcacctattatcataattcatatgccccaattttacccatgttctctggtctctaactcaactgccatggtcttaaatcaagctctcttttagtttatagtaatttatttttaaaaaatacatttcagcttctaatgctatgtcctaaaatatataaatgatacactaaaaaaaataactctattgtacataaaaaataaaacgatttggcattcctaaaattcagtcattcaacattattcttactactccctacagagatcctatgatctcagtagttttgaacactgcagattcttacagtctttatttatttttaacatcgcctgccctaggttatttttctatcagagggaaaaacaagtagatttttcataagggctcagatattaacaattatctttccaactgatatatcacggtagcagtaaatgttcaaagagaaaatgttttccttataaagcttcaaattaagccaagatgtttatttactatacacataaaataaaaaataggaatattctactataaagtcagtgtaaatgaccttaacaaaattaatggcactgaacattttataagagcctggagaatcgtcctcatcaccatctgtctgattccacatggtgctctgagatgttcaccggaatgtatattggcagcaccaaagagcgacgtctctatgcctccggctggctcccgcaaatgcagagtgactgtcacctggggagagcaccggcttagctggaggacttagggcctgtcatttctgctctagtctccttctgcacatttaagaactctagacttaagactcagaaatagttttgggggctcactcaaaaatatcttacaggatgcccaattattcatggtctcctcacagtgaaagtagcatttgactaggccagtttatattactttgcatagaatctgtaattcaggccagcaacttaaaaatgtggaaagaaatgggaaaaagtcttaaagtcgttatatattttagaaacatatatagttatagttaaacataatgtatttaaatatttatgtaaaatataataattaaatcttcaagttttatttgtcattccctagatttagaaaaccatgagatatgatttgaatgatgagtccccacagaaagtttctttttgattatagttcattagtgatttcaggataagtacattccaatacagtaaatatggatgatataagtatgtattatgtaatttatggacatattttattacttttatatatattacctatgtattcagaataagagaatagtgtcattaaaactttaatactatgtatactaaatataatttatatatcaaagtaaatatatacaataaataagtgtatttacataaatacataaatataagtattaataaattaatatttaatattaaggctttattaaatattagtatattatacagttttaaatacacagttatacagtgtttagtatttgtttaccatagtacgatatataaaaggaaataagttcaagtatttcctcaggagtttaggcatttttaaagagcagaaatattaaattatctggttgagaattgctgtgatagtttaacattgtaattaacctatcaataactccatttgatgtagtcactcaaaaatttaattctcttagaatatgtgcagtgcaatttcaccctatatgctattcagatattttgcagacgcaaaattgagagaactgagtttaagattgtgataaaaaccttctgtgcagctgttcatgcccattttgaaaatacctagctgcaagacacttgggagaagtaaaatttaacacgtgatgctataatacgtgcgttaagacttcaatttcacagatcatgaattattaagttatatatatccttaaagaaatcacggcatatcacctcgagtcctgaaatcacagacattaacatgcactgagaagactatgtaggttatttaaagtcgtgctattatttttatttatataacctcacctgaatatatgagactacttttagtatgttcctcatcatagtacattacttacaggtatctgtaaatgtggaaaaggtaacaatctaatattatattctatagtgtaaactttaatgtttatagggaactatgagataataataaaacaggaagggtgatcacatatgcaatgttttatggtaagcacgtttttatgtattacataatttaagtgtcacaaaatctttaggagggaattattactttgctgaagaaatgagaaaagtgagggttggaatttcagccagcacatcttgtttatttagctgataaatatattaaggtgtctgatttcaaagcccacattgttctttgtacattaattcactgttttcacttttgacctttaggagagctttaaggagataatattcattcagataccacaagttgaaaaggaaaatgagaagtacttcacacttcgctaatatttgagcttaccttatatatctaatatgaattcctatgtaaaagattcaaaagggcaatgtaatataaagcagattaaaaaacagaacgtggtgtaattctatttttttaaataaaagaaacatagaaaaagaccggcagtgttgcaggatatactgtcttcacctttgttgacgtgtaaacccccctttggttactgaatctctaccattgtaacaacgcggttgtatttttatttttaaaatttgtgttctaataatgctctacaatgagaatagttctttctttaaagagaaaaacaatcacaaaagcccagcagaggttgcagcccatgcacacttctctggaaccatcctgcctgcccacaccggccgagggtgacctcacgccccttccttgtttaccagagcacaggcccgtagtcatggggacttggcccaaatagggcaaggcttccattaaccgtaagtcatgaatttgaattattttaaaaaatccttaaggattacttcttggagaactttagctatgatgcacacagtaatatgaagcccttagtgatgaaagccagagctggttggatgccactgggccacggcagccactgggcatcatggcaagtgcagggggaggaagagggagtgtctcagagggaggcagctcccgcagaggggagggcatgggcatcctcacaggcgccccgagaaggggcagactcacagaaagaagtgtaggcaccctgcagatcacgtcacagctcatgagagccatacggaaaagtgaccagcgcctacagccaaattattagtggcttcctagttttggcacacgtgtccgagccaagaactctcatctctctctttcttaagtggttctagtaacccaaataatctaagtttttttaaaaagattattcaaaacgaagacaggcaggaaaaaataagagaaggaataaaaagagtaggaatgagaaacaaaagaagaataaaagataaagaagggaaggaggatagagaaaagggaaagaaaaagataaaatagaattctaacctttgcttcaaggaattccaagccttggggaacagacagttatcgacacaagaggagtgagaagtcgggggaagaaggggtgtgcagaggagacacctcaggcatgacgtgagcaaagacagaaagaacccgggatgttcgcaggacgcaggggaacttgcttgtaaaggggaacagcttcaactgagaaacaagaaaatccaggtcagttactgaggcaaaggtcaaaccatgaagaccctttctgaataagatgcttaatggaaagcagagactcttacttaatattattttctttcactgatgcattcagctgacattcagatacagcgtcctccattatttatatgtgtatttagttacatatagttattgttggaaattttatatataagggctttctcccttaaaatatcaaccatacaatattattgggaaaatttaatgacatggaatacacaatacacctagcattgctcaataaagacaacgttacagcaaatatcagctcctcatctttttctcctgtaaacagtttagactaaattatttcagtgttttctttcaactttaatataccatgagtcaatctctatgattcctatactcaggattattttatcaaggaatgttataatacacaagtttataagagattacggagatagaaaagaccacatgatcggcacagaaagaataaaggtaaaacactatatgccaaaagaaacacacacctttcatttcaaaaagacagattacttgcacagtataaggaaaggctaaaagacataacttcggtccgtcagaaacacagggtttgatgtctccacaaacaaaactagttgtacaggaaatcgtgccttttcacttagaaaaaagtagattcaaaattttcttgtcacagtgtttgtttgttgcctacagtcttattgaattatatttaaaaactggcaaaaaatgttgacgtatatttgaacaggccccagagttttatttgtaaaaagaaaacatttcaaatgattacttttctacattagagatcaaaatccccatggaaataacactttaaaagagaaatagaaagttaattgtagccagttttatttagttattcaacatccagtcagtgaaatattgactgaatgcctggtacaggcaggctctccgtcagctcctgggagggagaaattaatagctagatgggggagcatcagattttggatagggtcacagttggactctgatgcaaaatgacatttaagctgaaatggaaaagatgggcaggaattacctaaggtaagagtgaatttaaaaaccctcttgcccagtaaacagcagaagccaagccctcaggaaggaacgagactggagtattcaaagatccgaaaaaagatgaattggcccaaaccactgaaacttgagaacaagaaagaagaaaaggagaaagcatgaaagatgcttagatgagaaggtccaatttatatgttaaacagttcatcgtcgctactcctacagacccaggcaaagccaattagaggaagaaggagaggaggatgttgaagtcattcagacagaagggtgaagtgttgggctggcatgctgagtgagggttgaagggcagcagacagatttcattgcgttcgagaaaaaatgtgagagaaatgtgtgagtggtttgcttccaagaattgagggaaatggagttgcctctctgaagccactgagccaacggtggtagcactcaccatggtggctaaagcaatagaagaacacatcacgatttggaaggtcaagagttccattgctgatctcagatccccacaggcaaccaagaggaaacctcagttggtctgttggttatatgcatgtgtgtctggattagagagccgagatctcttagagaaacatggtattcactttcttccaagagatgagactgaaaagcatgggaatcattgatgtgacctagaatgggactcagcaccatgttgaacccttgaaaacgcaatcatgcttctttgctcgtgccgctccttccacccaaaatactcttcagccaggtcttcctgtcacagcctgctcagcacacaggtatcagctcagatgtcatctgcaaaatggccctccctgtgcaccctggctaaaccggcaggactccttccccttctctatctacctgctttatgttgctatgtggacagcacgtaacacgatcacaaactgtatccttcgtcgactcagcacccttccaactatcatgtaggcccatggtagcagcggattttctgtctggtttattgttctcattctgagtctgcacagagactgtcacacagtaagaaagcaacacgtgaggtagtcagtgactggagtagcaaagaagccagcccgtggctgagcctggagcgttgtgaacattttgaggtcaagaataggcagataaaacaacacagaggctgaggagcaggcagataggccgggaatagcttaggggattccagataggaaaatgttccaaaatagaaaggtttgcaaacagtttgaaatgacgctaagaagccaaatcggtagaagacagggaaggatccatcggttttgcaacactgaagatcactggtgattttagccagtccagctcaggtggaataatggaagattgaagtcgtcagacggagggaagaaattttactgttcgagaaaaactctctgagaatagcatttgattaaataaagcgctctcaaaggatttatcttgaagtaaactgggatttctctgccttaggcactaacaggtcaacaagtgacttgacattcttaatttatctttaaaacgtgaattcccccctggtccaaagataacctgactttatgcagagtagactgacgaagcaaaaccccccagatcactgcctctttgtatgttaacaaatttcaacatagtagcctcaagttacacattgtacacttagaaattactgattctctaaccataggttaactcatcattcaatcagcattatttacataagaaagtaattgtttttttctcttcagattttgttattgttgcttttattaccagaataaaattgagcaaacattttctttaacattcctgctagagaaaagggatttattttaaaaaattcaaagagctatagcaaaggcagaactactttggcaataattttagaaaatgcaatcatttctagggctgggctttaaccatttgataatgcatcttaaatcaacagtgttggttggaggcattcttccatctcataggtaaagccccgttcgccttcttggaccttcagccctgacacccccccatccccacttaatcctcaatgacttattgaatcaaaattaaagactacccctgggatatgtccatgttataggagattattttttaatgagaaaaacaccaaaagtgcctacatatatctcattaacatgtcatgataaaaccttagattgtgatgggcgttgaagatgagtattggttagaacaagtgggatgtctggcttcttttttaaaaaattgcataaagatgatgattctggatttactacctaaatgtaatgctaattctcctgaaagaattcctttacatttaaaaaataattaaataactgtcaccctaatgattcatccatcagtactatttaggcacaggaatgacttcagttaaaaagatgaccacaccaatgtccttgccaagttttgctgcccttgttttgtttttggcagtctccatttgctttcctgtttcaggtgcaaagacatctgtgtctattggttccccttcagagattatgttcctggttagtgatcctgttttaagaaggaagttctctgagaatggcagacaacaaaatgaagcaaggggcttcaaaattataatgatcatttcagaagtataaattacactttaataacactttgaaaagtgggtgctctcgcacctgagagatatgtttcctcagtgagtgtcctactaactgatacttttagtgttagagtctgccctgttgactcccaacactaatttattaaatagttgctgacgtcattgttttaacatttatttctctaactttatgttaccaagaatttatagacagtaaatcattaaacatcatatatgatgaacacaccttttctcacagaactcaaataaaacataacttaaaatgtctacattggatataacataaattactctgacactgagaagtaccacataaaattatgtggaaaatgcatactcagaagtgcatcgtgtcatacataagactcagaggtgcactgtgtcaaaggtgtctttggtcctgccatattttcttgagactgacaagtttgcaaactaggcaagacttcacagtgaatggttgctactcccggcaggataatgcaaataatatctaacatatgtataatacaagtctgttcccaatttagaagtcaaatacagatgcaatggcatcagaatacaatggacaattgtattagtggtgcacgcacgtcaaaagttcatttcatttttagctacttaaattttcatcttaatttgaaaggataaattaatatttcctaatttaaaaaatgttaatgacatatttttcaatcttaagacatgaaaatagtgtatataaatctgaaaacattcaatgatccttcaattaaaaatggaaatgtcatgtaaacactgatttcccttcagcaaccccataggcattgctttataatcagatattacttctcaagtatccacttgatgcatagcttgtaaccagctatgaagtgttaaatatcaggctgtgaacatcatagacacagagaagaaacctgacgtatgtattcaaaactatttaaaatgcatagggcataaaatacataaaatatatcattccatttcaagtggattcagtatgaaacatgaagatgaatatgcatgacccttatataaaatgtctgtaaatgttttatctgggattactgtcagtgaaataaagggctgactcagcacatctgggtagggggtggtggggggagggggccgtgccctgcccgttagaagtttggttcttgacctgatgctgggaagtagcctctaaacccttggaatgtcctagcttatgagagtgtcttcgtttacctggggaccttaggccacagcagatagtctatgtgttcacgtgattaatggtgggggcctttggccacttggtccagccacatggtattggagcacccctctggtaggactgaagactaaggtcagcaatgtgggtggacagcatgcctgtgtgacactctgtgacaaactccagttaaacttctataggcaccgaggctcaggagagcttctgtggtctgcaatcctctgtgcgtggggtcacacgtcattcctgggagaattaatgctgtcggcacaactctactgggagtggacaaccgcaagtttgaacctgctgtctcccggactctgcccatgtacctcttcccttttttgcctttaaactgtctcttttcactgtcacaagccatagccatgcacataatgaccttcctgagctctgtgcagccttctatcaaattacttaactcgagagtggtactggggacacctcaaactgcacatccaacaaatgaaatgaaaggtgtgattagaactgtgctgcctactcagcctttctggattgagccatgattaaggcacacagtttgattgcttacccattagtgaatacagccatgcatcatgtgtcctgagaaatgcttccttaggcgattcttgacgttttgcaaacatcacacagtgcactgtgcacttgcccaatcctagatagtagagcctgctgggctatagggtacagccgcttgctcctaggctacaaactcacaccacatgtgactgtactgaataatgcaggcaactctaacacaatggtaagaaatttgtgtatctaaacctaactaaacattgaaaaactaaggtaaaaacactgtttaatgataaaaaaaaaaatgggatgcctatataagatacttactataaacagagcttgtgggccttgacgttgctctgggtgactcagtaagtggacggtgagtgcgtgtgaaggccaaggacatggctgtgcactgctgtagaaacactgtagccaggtgcagtggctcacgcctgtaatcccagcactttcagaatcctaggtgggtggatcatgaggtcaggtgttcaagaccagcccggccaagatggcaaaaccccatctctactaaaaatacaaaaattagccaggcaaagtggtgcacacctgtaatcccagctactcgggaggctgaggcaggagaatcacttgaacccggttgaacctgggagatggagcttgcagtgagccgagagtgcaccactacactccagcctgggcaatggagcaagactccatctcttttttttttttttttttgagacagaaactcgctctgtcacccaggctggagtgcagtggcgcgatctcagctcactgcaagctacacatcccaggttcacgccattctcctgcgtcaacctcctgagtagctgggactacaggcgccagccaccatgcctggctattttttgtattttttagtagagacggggattcactgtgttagccaggatggtctcaatctcctgacctcgtgatctgcccgcctcggcctcccgaagtgctgggattacaggtatgaacctctgcgcccagctgcttccatctcaaaaaaaaaaaaaaaaaaaaaagaaagaaagaaagaaaaaaaaaatgagacactgcacacttaggttactctacatttgtaacacaaaatattttcttcagtaataaattagctttaacttcctgtaagctgacttagtttactttttggctttataaacttctatttagcttttggctcttttgtaataacacttagcttgaaacacaaacacattgaacagctgtacaaaaatattttcagtcttaatatccttactctataagctttttctattttattatttttttgtactttttgaagttttgtgttaagaactaaggcagaaacacacacattagcctaggcctacaacacagggtcagaataatcaacatgacttcttccatctttgcatcttgtcccattggaaggtcttcaggagcagtaacaggcgtggaactgtcattttctaggacaacgatgccttcttctggaatccctcctgaaggccctgcctgaggctgttgtacaggccgggattacaggcatgcgccaccacgcctggctaatttttggatttttagtagagatgagggttctccatgttggctaggctggtctcagactcctgacctcaggtgatccgcccgcctcagcctcccacagtggtaggattacaggtgtgagccacctctcctgtccctggaagtaaaatctttaggagtctatctaagccagtcaaaccccttttacttaacctaccatctgttcctgaggaatgtacatgtaactttatgctggtcatgaaacggaatgtgaaaaacatcttttcaggaaatgttttctcccaccctacaaaacaaatcatgacgcagagatgctcttctccctagtcttgatcctgtggagaggtgaagcctggagccacgctcttgtgaccatcttgggagcagctggctcagcgaggatggcagggagtaaggcagagaggttctcctgacacttccacactttgagtttcatacgatcatatcttttctttattttttgctatatgagtttaaatgtcccttccaagactcatgttgagatatatagattttgttgccattgtgaggtaactaggtcatgagttctctgccctcatgaatgaattagtatcattattgagatgatggattgctataaatgcgaatttgtctctctctctctttctctctgcttgttgcccatctgccttccaccatggaataacgatgcagaaagaaaaccctcgccagaatcaggatcctcatgcttgaacttcccagactccaaaactatagaaaataaatttccttcctttataaattatcccgtttgtgctattctgttatagcaacacaaaattaactaggacaattgtttaacacagtttttaagctgtgtgacatattctaacttttactaggtaatttgtaatcagaataatccttacctaaaaacaggttgtctcacttgctagttgtgtatgcttgggggagtttcataaacaatctatgtctaagatcctttatctgtagaatgtggattcttatgagtttgggcaacataaagacctgaattcaaatgtctaaccaccttattaacttaaataaattaaataatgtatttgaatctattttctaacatttgataaggtaatatgacctaccatagcttcagaattgttcttctttgactataataaaatatacaaaactacctgacaagaagtatacaagaaatagtttgcttttttcctattttttaatactttagtaaaatattgactactattttgttacctagtatatactgggtgctactgttggcactattaaagtctatgattcaatccccccaacaatcatatgaaacaggatgacaactgaattacctctggcatacaggtgttaagtagggatatggtttggctgtgtccccacccaaatctcatcttgaattgtagctcccataattcccacatcttgggagggacccagtgggaagtaattgaatcttgggggccagtatttcttgtgctgttcctatggtagtgaataagtctcacaagatctgatggttttctacagagcagttcccctgcccacactctcttgattgccgccatgtaagacatgactttggttctccttcaccttctgccatgattgtgaggcctcctcagttatgtggaaccatgagtccattaaacctatttttcattataaattacgcagtctcaggtatgtccttataggagcatggcttttctaaccacacacagctatcaaatcaaggagctcagatttaaacccaagcaggttgagtcttaaacgtaagatctcctgcccctcactgatgtttccttccaatattttacttcaaacccagttcagcaagtcttggagttcagaactgggctttaaaacattggtagaaaaaattctatagataaataaataacatgtacaccataagcaatttacatagaaaatgtgtcatccatttacagtcagtttttccaaattgtctaaaacccagtgttagcttcagtgtgtcccaagaggctgtagccaggtatcagttattggtttgatgctgagagaaaggtcctagttttgcccaccgcaactgcacccctccaaaaaaaaaaacactgcctctgaaattctgaaacctggagacgtgatgataatgatgacaagattcctaaatatatttggtaattcaggagtagcagagattacagaggggatgcttgtccctgcctgcaaagtgcaatctggaaagggtcagaatgtgctacctttctcctgcccagtcatgtggaggagcaggtgaaacatgggcaagatgtacctagaaagaacggttctgtggaccagaaagtcgacacatgggcaaaaggcttgtggtcagaatacagaatgtagctgtgaactcaaaggacccacagaccaaacataccaagagagaaaccagcatgcataggtgactctgagactcctccctctctccttcctcacaccttgtctccaggaagataccctggaatataaagataaaactacaagaaaaatggggtagggaaaagtgaagaagggactccgaatagcctgatatttattttctgtctctcagcagtatgggaattcagaaattatttcaaataagagaaaggcagtgttgcattcttaactccctgaagttgtgagtgaatatttgtccccaatatccttctttcattttccacttagcattacgttcagcctactctcaacttccacaaattggaaaaatgcaaaggacttcattctagcaaaagattttcgcagctctactttaagccttgcagtaaaggccgctcaattcaagaggacagagtaagtcagaaagtaaagacacaggccttgaggtctctctgttggactagtccattgacaatgaaatttctatgaaataggttgctatttgaataatatactttattattactatttttgcttggggtgttgtttcattaagagaatcaggaaagtttggagtttaagaggaaaaagagagaatgaaagtgaatgagtgagggttcatcaaaattcccagaaatcatttcaccaacttatgctgaaaaaacatccttgataaatcagtctatgacctgaattgtctaactgagcatgaaaataaggacagagcactaaatgacagtaaaagacacagataacataataggatggatcagaagacctgacttcctgcctcaaccagaccatccagaagatatattacctagtttaaatcttaaaatcaattaatgattctaaatcccaattccctcatttgaacactgtatcaaaacataagtggaatgatgtatgtaaaccctaaggcactacgtaaacatcaacatctttgatttctcaatgatttttcttttgcatttattcactaatatatacatcttgttattcttcataatcttctaactactcatcctattttggttcagggcaatggacctaaagcaaaaatctaatcatattatttattttatcagctggaaaaatatgtgatatgttcagagaatatttgttatcttctttgtgttttgctaaccctagttaaaagccagataagaagagaaaatatttatcttgttcactattttatggctagcatctaatagtggttgggatatagtaggtgctcaataaatgtttgtcggagaaatgaattaatgcatgcattaatctaattgcataagaagcagcaacttattttaaaaattgaaggctctcccatgtagaggtccttttttccacctgtcccactttttcttgcgtaagacttcgctctgagaaaacttaatgcttgaagctggtgcagggatattgcagtcatgtggggaggcatcaatgtgctgagaattgattaaataaataaataaagatcaaataaattcactgaggtaatgagcctgttttggaacatttagtctccaggtttcatgttcacaaccaagattttatgagataattaaatatccatttgtagtttattgaaggcattgtcaaatattcaattatatcttctcaaaactatggtacattgtaaagaccagagaccatctttcctatgtcctcggactccttcctcaactctggaaatagttgctcagttttgtctaatcagttaatggaaaattgtgtaggttatctcagaaaaatgtggaagcataaactcatttttttccactggattggacaagagaaaatatattttctctgaaccactacaaaatcaaaggtggtctctgagacctcagtcgtcctgctacgtaaattagatattcctttgattgtcgctacaatgtttgataagaaaaaggagagtgtgtgtctataaaccagttgtgtagaaaccatgttgtccctgaaaaacattcattgtacaggaagtgagacattcacagcccctgtgtggggaagagacggcctcacagagggatggaaagaccagagcagggccttagtccatggaatcttacctcactacttttttttttattgttaatgatgtcagtatccaatatgtggcattaatcatggtttgccagctttgtctttatttgtgagggaaagcaaaaggcgacaaaatcgtatgttaaataagctttagaaaatataccatcattttaaatcctctattttgtgttccttttttcctttttttttttttttttttttttgtgaataatgtcctcaaaagttgtaatgattcaggactctgagaaagccttaagaaagttagactgaagttattgcagaaggtgctcagacagaccggttctctgaatctgcacatgtaacatgcaatgggtgatcacttgactggggtacattgccttttccagactttccacttggctgcttctctgtgactcatgggtccctgagcaaatccaggggagtaagtggcagtgattcccagcctcctgtgcaggtggagaacgggtgagtcactagcaatggaaccaacaatccccaagtggagcccttcatttgccaccttcgctaacgtcagactgagcagatcttagaagcagaaataaaaattgggttcttcttataacccacatcactcctactttatcagtaagtggtttttagctgaaagaacaggtaaacacttaaagtataactcggtctcttgggcaaacttcattatttcagcacacagaaagggagtgtatgaaagtcagaacatcctttcagaaatcatgatttatgcttcttatgtctcaagaggttatcacaagatttctgagagaataccagcatttatagtcacgtaggaatttcaaatacagcttttgccccaacagagggggccaggagctcagaacaggctgcaggctaaatggaaatgtttgggaccaggattctccctgctaccactcggtacccaaccactcactacctcctggttctcaaaaaaccatctgttgtgacctttgtcgatctcttccctcaaacctaccataacgtcctattattggtacagctaacttcatataaggtttcgctacataggcaatgtgtggaaactaattctgattaaggttagcaaaaaacacaagcactgagtgaatccctgacacagatggggagagagcagcaatcctaagagattagcagccccagaagctaggtttccccctcaccacatctgcaaaccttgatcacctggaacttctacttcgatggatacactgagggcaaaggatacagcagatacagcctacagccactcaaaatggaaactggaaactcacacaaatagacaaagatatgatacacaaatatataatatttatacataatatataatatatagaagatgatgtatataaaaatatgtattaaatggtgaaacccccaagaagtcacatacactcttaaggacttgactaatagtaaattcactgtgaaaaagagatcagaaagagtgaaaagaacttgctctttcccaccttggtgctgtggggagaaagaagaaatcaccgcaaagaatttataaccttaagtccactttcccatgagtttataacctaaatttatgatacctatatggctctaaagacctctaaaattcaagagatattcccaagtagtgacccaagcaaacacaaatcctctctggagaaaaactgcctttatccaggtcttcaagtgtctccaaagataaagttccaaggaacagaagtttgcataaaggatgaaaagcaattcacaaaccaaacgagaaaacctggcatcgtgagtggaagtaggcaggttaacggacggtcgatggagagatttcacaactgggcttataggaaagaggatacaaaagaagtatatttaacatatatctattagtaaaagaaagactagaaaacacgagtatggaacaagaaggcaataaacgcatttcatgcagagtatgtatatgaatccagtagaacccccagagatgaaattatacatccatatttgtgtatgtgtatatctatatatagattatacatatatatagattatacatacacacacatatatatataatgtaactttctgaagataaaaccactaatagttaaaataaaaaaatacaaattaggaaattcaggacacagaattaataaattaaaaaaaatagatgtaagaaatttttcaaaatgcagcacagaggaggaaaaaatcctgtgcatgtgagtgtcgacggcacgggagagggagagagacaggcatgcagcttgtcaggatttcaaaagacaatttaacagtcagggaaaaaccatgtgtaaagatattataagtgagagccacatccaggaagctcagggaaaaccaatcaggataatgaaaatggtgaccatattgtggtgaaacagcagaacaaagacaaagagaagattccaaaagtagccaaagagaactggatggaaaggagggacgggcaaagaaagaggtgaaaaaaaatgagagaaaaagcagaatcactgaagaaatggggtttacaagctgatgacagacctccagagtccctgagtgccttatcagaaatgcctcctctgggccggacgccgtggctcacgcctgtaatcctagcactttgggaggccgaggtaggcggatcacaaggtcaggagatcgaaaccatcctggctaacacagtgaaatccagtctctactaaaaatacaaaaattggccgggcgtggtggcgggcgcctgtagtcccaactacccgggcggctgaggcaggagaatggcgtgaacccgggaggtggagcttgcagtgagccgagatcgcgccactgcaccccagcctgggcgacagcgtgagactccgtctcaaaaaaaaaaaaaaaaaaaaaaggaaatgcctcctctgccttttccagctacttaatcacctcctagagtcattgttcacccaccagtaatacagagaaggggaggaatcaaaccacagggttaagttaattaagctacctattatgttaattagcttaatgaattagttaatacacttgatttgatttgctatctgggcaagagatgaacaaaacctaaagggatttgtgtatttagttggatgaaatgtggtagataggacaattctaacagaagagaacacggtgaattcatcgctgttgtttcaaaaacaactggaaacaaacatttgaaacacaaggaatcaaagcttccaacttttatctttaagaaagtgctccagggcagcccttctacaccagaaacatcaccatcacctgggaagttgttatcaatgcaaattttcaaaatgttaggcccccaatgtagacttactgaatcagaaactctaggggcggggctcagaaatctatttcaataaactccccaggtcgttgaggtgacactaacagttgagaaccattgctgttagagaatttaaacaacaacactgcctgtgatcaattttgctgaaagcataggtcttagaggcaaatggccttgtgtcatgtctggctctaaaatcagcaggtgcgagtgagaccctggagaagccctggaagcctcgcatttacagtttcctcaccttaaaataggcacggtagaaagaaaagagagcaactctatgtgctccttggacatcaaggcttttgctctgattagcaaaaagaagatggggaagatgatgaaagagggtgagaaagctaaaaatggaaaggtaggagattgaatctgaaggattgcagagctgtgaaaggaatgaacgggataagagatggctgtgccagacccctattaccttcagtaaagagggcagcaggttcaagtggctgaagaagagacccagagccagtgaatgagttacagggtttatttgtggggcctgtcaggggggtgcagtgccagcagacagaattgcagaatcacaatcgcttgtagaaagcgtgcagtttatacagcatttccacttaacatcctccctccaggaaccccgatgtggtaaccttcgtttcctaagagattgctgttgggtgcatctgccatgcagtgattagacaaaacactggtagaattgcccacattttccctggaaattccagggttacggatcactaaggctttaaatgaaaaaaaaaaaaaaaaaaaaaaaaagtcaattgttctttcaaactcgcatttcttcctttctgtcctctactcctcatctgcctcatgaagatccagcagccttcttaccatcttgaattgcacaacttctgtcctgaagcctgctaaggccatgttcaaagccaaatcaggatgagtaacataagatcaaatcaccatttcactcccttacttcactgagtcctgggccatgcaagaaaccaatgcacagtccaaagaagacctctctagaccaaccatgcagtaagtgttcatacacttgtctcaggaagccataacacaatgaacacaaatgtgttctcccagcagctgcaattaaaaccttctgagcaaagacctatcctaattgagaaaaatgctgtgattagccagattggggttgaagctcggcttcgggtgtctgggtaccttctggtctcagaggaaggggaaagacagcaaaccttaaagcagacatttactaactgaaaatgggacagtggaagaaatggggaaggggaaggaaggggaggatgtgtggtcagaggtgaagctgcaggagagatcatgggaagtgtcagtcttctgcaagggatcatgggaagagtcagccttctgcaagggatcatgggaagagtcggccttctgcatttgtagaaatcacagggagccactgctacagcagagactacggcattgcctttgaaagaactttacttggctctgcaaggaacatggaagctgctggcatctggaggcaaaagttaggttattataagaaaaggtgagaaaaacagaaaacataccaaaacaaagctgtctattcaaatgacactgggctacaagaagaatcactccattgtttaaataatgtttttatatacatagggcaaattacatatgaatactataattttctaaatgtttcccctttaactcttgaatattctattatcaacagtatcataaaataattaaatttagaaaaaaactagctataattgtatttatcgcaatttctgttatagcattaacaaaaactagaaatattctaaattcccaaccaaaaaaaaaaagattaagtgaattgtggcagagttacaaaatagaaaactcttcagccgagaaaaccttttgaagaatgcttattaacactgaaaaattcacaatatataaaatgaaaaaggtgaacaaaaatagtgatacattattttatcatatttgaataaaaattacagcacatgtacatagaaaaagaaacgtgatatgctgagatgttaactgtaatttttctcagttgtaaaagtatgaaatatactaaatatactaaaatatagaagatattaaaacattgaatatttttatatgtattttccaacttttttctatgcatgcattgctttgtaataagaaattaccatacaatctactttaactcaaaattaagaaccttgtttgtaaataagggaaaatcgcacctattataataatcatttccttctgaaatgtaaataaaaatctggcggtgtcatctgtagcattccaagggaaaggaccatttcacaatgcatgagcttgtttcccctgattctcagtaggaccgcccaaagtagcagtcagggaaccactaaaaatgagtaactttcttggttcctgccaaagccgtgctcagagggccaagacttgcattgtttcacacctcattagccctccttctaaacagcgctttcgacctggctccggtgcctcctctgaggctggaaagaacgttttcatggataaccaccaggggcatccgtccttcctcattgttccagccctgtcttgcttcccctgcctcctcccacccgctggctgcttgcctctctggctgaatttgggtcacacgagcctgttcctctagttttgatgagtaggcttaggtagggcagatacaaaaaaaatttaaaacctcaacaatgatgcatcatcctctctataactattcccaaattcaagggccagatacgcatttttgaaacatctcagcagctctttcctgccacttctggtgcttcttgcgtgtcagctcaggttttcttttgtgaagtggagagtccagcccttgtcatggcaatgaaaatcccaggaaggaataaatcataggaatgtaagcttgtaggggtggatggtcctccggtgcaactcaagttcaagaggcacatgtgaaaacctgcactctttaaaaatatctatgctgtgaaacttcagcaagggatgagtaacaactcagataaaaggagaccagggtggcagaaccacccaatgtcatgtgtgagcctgggttgtatccttggccaggagagaggtaaatatggcagagagagaaatatcacgtaaagtgaaatacagcatagaaagaaatataaagagaaatagaacacaaagagaaaaacagcataaagagaaatacagtacatagagaaatacagcatagagaaaaatacagcataaaaagaaatatagcacagagagaagtatatcagagaaatatagcataaagagaaatatagtatagagacaaatacagcataaagagaaatacggcataaagaaaaacacagcatgttggaaccactggcaacatttgaaatgtggtatgctgccatgtgattaaagcattcaaacaaattttgtgaatttgaaagttttagtacagttattgtaagacattgattttctttggagaaaacaaacgttaaagtattgattggagggagacacagagagtgagacagagagaaagagtgagagaaagagagagagatattgaaaagtaaatatggcaaatgtataatgttggtgaatctgagaaggcactttgtaccttttctaactattcttgtaactgttctgtgtaagtttggaattacttcaaaacaaattactctgtttgttttgtttgtaagagacatgtgccacttcataaagcagtgatgcttgctgtaaacagcaggatttttcgaggaggcagaacagattcttatttcttgtgcagctaatcaatgaaccagatctacctgcatggttggagatggaggacagatggatggatgtgttctagctgcaggaaggaggtgtctcctaaaaacagaacctaccactttactatggccccagattaagttagatacttctctaccatatcttaaaaatgtacatatgtgtatattactcttctcaccatatactagagacatgattttacttttactttgctattccccaaattattttcctcttttctctagagtaatatatttcaaatctgccctacaaattgccttgctgaaataatagttgttgctatattgaacaatattttggtcatgacagagaaattttcaaattaagactttgtgagactgacatgctgcctgctgcactaatgatgcaactcaaattgagattttaatactggagtacctacattttcagggacaagatggctctaacacagtggagtgactgctgagattttggacctgttgaaaagttgttgtacgatttactttttctttgatttcagagcacagaaaattgttttggaactttgttttgattttagaacagatttaatgactttcccaagaacgagtttctctagagcataacaggacaaactgaccttactttgaaacatacggctataccaaatcctataaaaatggtctaaaaagtgcctgatcatttacagaagttacatggctcatgtctgtgcacctgagacataaagtaagcagtatgcattgtatttaaaacctatctttacgcggcacccctctcagaacatgacatttctctttactgtcttatgttatgttgttaccaagtgtgactcagttcagcagtttctggtagctagtgttttctatttaaatgaccaagtgtaacaacagctatttttttttctttaacagaacccgtaatgtacccagccctgtgcatggtgtttgagattctctttgcgtccagcttttaaggtatgtactgtccaaggtcacagagttcatcaatggaagaacaagatttaaagcccagggttttttctggtctttctctagcactctgtcttactcagtgattcagtagcaatactgtaccattcagtttacaatgcaacctttatttagtctgtgaaaacaacttttcggcaatggcaggtttgtactgataccataagtcttccgatattttccctgctttatatattcttctgtaacataaaaccaacctggaacttaatattactatgtgagaaccaagaaaaaaacatgaaactcttacaaatctacctgcattaaattgactgttagaagaaatctaaatgtccgcttttacactgatattaaaattcatctgtattagttcgttttcacactgctataaataactgcctgagactgggtaatttatcaagaggctgaattgactcacagttcatcatggctggggaggcctcaggaaatttacaatcatggtggaaagcaaaggggaagcaaggcaccttcttcacaaggtggcaggaaggagaagtgctgtgcaaagtggggagagcctcttataaaaccagtagatcttatgagaacttactcaccatcatgagaacagcacggagaaaccacccccatgattccattacctccacctggtctctgccttgacacatgaggattatcgggattataattcaagatgagatttgagtggggacacaaagcctaaccataacatcatccataatattaaaatcactaatactaaattgtggtcttattacaatgtaagtataagtggtcagattttgcaataccttgctagatgttttctcaatgtttaacctatgtacacatttttttgaatactatctagcccagagctttgtgcatggtatatgtaacttaaaattacatattcttatttttaaaaaacaatcttaaatgctaggagaggttaaaaaaatgataaatgaggctgggcctggtggctcatgcctggaatcccagcactttgggaagccaaggcgggcagaccacttgaggtcaagagtttgagactagcctggacaacatggtgaaaccttgtctctactaaaaatacaaaacttagccaggcatggtggtgggtgtctgtaatcccagctattggggaggctgaggtaggagaattgcttgaacccagaaggcagatttgcaatgacctgagattgcttcattgcactccagcctgggtgacagagcaagactctttctcagaaaaaaaaaagaaaagtaaagaaaaaagaaaatgaatgattgagtttcaagttgagttaggaagatgagtatacctttacttacatgtgttaccatgctttaattagggaaaattatgacatggcaaaaagtcatacatacaaataaatactatgaataggaaaactcatcgaagaactcatcatgctctaggactaaattaagcttagctggtgggaccaggggctactgagccttcattctctactcaggctcctttccttgaatctgttatgttattacagattgtatactgctagttattctgagtacatatgatgcttgccatgaatgtactgagctcccggctgtggatatttaagagaacactaccatcacgctatgagaactgttcgaagtggtaaattatcaatgctggcttctcaaagaaagggcatcaacgactcaattcgatgacttcttcagcatttctaatgcaaaaatgtgatttttttctaaagagtttccaccccttttttcctttctcatgggttcaaacactggttataccatctccaatcctgacatctcccctgtatgtaactatgactatgtaacatctcttctggaatatcgaacgtcttctcagacttctggtctctccgactccgatcttgcaagcctgcttcgcccactatatttccctatagtaaacacctttatcttttagttccttagaccaaaaaccttgaagtcagccttgactcttttcatcatacagcttacccaccagaatatcccatgagctccatattcaagattcgtgcatacaatggccgtttatcaccatctgtcagtatcttgtcttgattacagcagtagctttcttgccggtctttgtactttcccctggtctctgttccctagaatgtattctcaacacagctcacatgatcctttaaacacctaagacagatcgtatcacccctttggttgaaacacctcaaaggattccatttcaccttgagtaaaagcccaaatccttacattgattcataaaaccagacaagatctagtccccacccccacacacttcacataggtcttctgtctcctcttcattcacaatatggaagccatggcccttcatggagtacctcgaacttgctgagcacgtaatgcctcagggtctgtgcacgttctgacttccctttctagaacactcttcctccacttatctgcatagctggcctcggtttctccaggtgtctcctccaatgtcatggtattaatgaggtcttggctggccaccacatctagaacactagaatagcccctgcccccctgcactcattgtccttctcatccactctattttacctcagagcacttagcagcaatagcgtgcttactatcactgtacttaacaccatcagagcgcttaccaccatcacagtgcttaccagcaacagcgtgcttactatcatcactatacttactaccaacagagcgcctaccaccatcagagcacccaccaccatcgcacttaccaccatcagagcacccaccaccatcagagcacccaccatcgcacttaccaccatgagcacacttaccaccatcagaatgcttactaccatcagagtgcttaccatcatcagagcacctaccaccatcagtgggcctaccaccatcagagcgccatcaccaccagagcgcctaccaacatcattacacataccatcagtgcgcttaccaccatcagagcacttactaccatcacagcacccaccaccatcgcacttacccccatcagagcgcttaccaccatcagagcacctaccaccatcagcacgcttaccatcagagcgcttaccaccatcagagcgcttaccaccatcagagcgcttaccaccatcagaacacctaccaccttcagcgggcctaccaccatcagagcgccatcaccaccagagcgcctaccaacgtcattgcacttaccaccatcagtgcgcttaccaccatcagcttaccactgtcagcatgcttaaccaccatcggagtgctcaccaccatcagcgtgcttaccaccatcagcatgcttaccaccatcagagcgcttagcaccatcacaaatacgttgacttgtttgtttctgtctccttcccaaacacaatggatgcattagctcattctcttgctgctaataaagacatacctgagactgggtattttataaaggaagcggattaatggactcacatttcagcatggctggggaggcctcacaatcttggcagaatgcaaaggagaagcaaaggcatgtcgtacacggtgacaggcaaaagagctcgcgcaagggagctcccatttatggaaccatcagatctcgtgagacttattcactaccataggaacagtatgggggaaactgcccatgtgattcaattatctccaagtgaccccgcccctaacaagtggggattattacagttcaaggtgagatttggctgggaaaacagcccaaacatatacctggaatataaagtcctgggggcaagactttgttttgctcactaccgtattggcagaacctagaacagagggtgcacacagtcagcactcaatacatatttaatgaatgaataaacgaatgaataaatgaacaccactaaagactgaaagccccttattttctcctgactgctttcaagtataattagcattgtctgcactattaatgccactcaaattatactagaagccaataaaagacacaaatgttttctatcagaaaacagcactcagtaaagactcattcatcaacgtcatgcttccagcctccatgcatatgctttattaattgaaagccctataaattcaaattttttcaagttgcatatatttttaaatatataaatatacaaatatatttaaaattgtaattatttccaaacttttcttattttttacattgtctcatataaatatcaaatagataagttagggatggctggaaaaaaattaaagaaaactaaagttatgggggttcttttgttgttgttgttgttttgagattcacttttgttgtccgggctgtactgcagaggcatgatctcggctcattgcaacctccgcctcctggattcaaacgattgtcctgcctcagcctccccagtagctgggattataggtgcccaacaccacacccggctatttttcatatttttaatagagatagggtttcaccatgttggccaagctggtctcgaactcctgacctcaagtaatcagcgcacctcagcctcccaaagtgctgggatttcaggtgtgagccaccctgcctggccagttatggggattctaaatcattcctcctttaggccacgaagcctgataagggccagctttttacagcccaagtcctggcacttgtggaagcctcctttgaggaatgaggactctagtgaaggaccggccacatcgcatggctgttacacagtgggtccccaaaatgacatatccctaactcgtgacacaagtttaatgaccaatacatatttgatagatttaaatatatatatttatcttcatttacattcccagaaatgactgtcttaatcctgacagcatcagtattaaaaatcagcacttgctcttgtgtctgaaactgacaagtttcatttcacccatgacagcctactgttgtcacatagaaaatgtgatttgaacttggatcattgatgtgaaaagcaaatgtcactgcttggaggggccaactgtataacatccaattaggcagaaatcactgtaataacgtctcttttctgttagagtagagggtgttgtcaggaaacagtgtaaccacccctcatcttcacaggacaccctgtgtgcacacacacatcactgaagacatcattctcagcagtgttttaatatttaccttcagtttgactgaattgtatgtaaaccttggttttcagggacttatttaaaatgacattcttagccaaaatttaagtacaatagaaatacaaagatttataaaattatgtaataattcatactagagtttgaaaagtttgatgtcacattgaaatcagttagttttagactgcgtataaatagcagagatgtaaagtaccctttggtgtagtccacatgcctgtgcacatagggaaaagataatggtacaggaagagggtacacaggagcttttaaaaatcaagaggagagatacctaaatccacactgttaggagaacttacaaataagaaattgtcatgattatacggagagtttaggagaagaaaaaattgtctacatactcaaagacctcccatatctttttcaaagcagggcagcctttgatttgctaggtgtgagagctccatttgtgatatgctaagtaagactggctgagattcgggtcagagccagcacagggacacattgggcatctctgcaggtgatgaagtgctccagggcttgagctgaacggggtaggactgggtgctcccactgggtctaccagctgcctcagggctaccatggcgcccaggatccatagaacacatcacctgctctacccacacccggacctgccagctctgcaacagactgggagacaggagctgggctccacacagttgagccagggagcatctcatctggcacttcctgctttttggagcctgatgcatctcaaactgaaaatgccaggtgtgaagaaagggagacagcaataacgctcaaatttttaaatttaattaaaatatatcagttaaagagggaaataatttaaagaatgttttttaaccaatttattttcattcaaaatatgaaaatacacattaattttccaagctttagctatagagctaaatctcttgcttttgactttgttccacagggaacacagattattttttggtcaaaaccaacttttaatgatcatctaaaacgtcaaggttttggttactacaaaacaaggcaagaatttaagacccatgaacatgaaggctatctttgtgcatgatccttcaatttcttaaaaataattcccacattgtttactgtcatcttccctacagcgaatttggcagtgattttcatttttcactattactctagtcacagtaactcttttaagataacatttaattagtttatagcatatttcattactctacataattataatgacaaacaatagtatcagaaataggtttggcataaacacagccagctcaggaccactgcacagtgcacctgctgggaaacccaactgtgtaaggtaccaagagagaacccccactgatgaatgcccgtcccaccaggcccctcaggcagggctgcaagccagctgagcctacaagatgactcaatggaggttgcgttttttttttttttttttttttaatcttccactgctgtatatccacccattctaaatgatttataattcagcacaaacatgctcattgggaaattagctacggctgtaggaggcaggaaaggtagagtctaatagcaagaaagaaagtcttccaatattttcaggactgatgcaaagactagttgacggaaaacctgtcagacttcatctttggaaagaatagaacatgcaagaccttaatccttgtgatgccaggaatgaagagcaggactggagccctccagagactctgattcctgtcccacctggctcagaacccctttcactgaaagggttggtgaaataagttttattctgcaaagatggacatctctctgggggaaataacatgagatatatttcaaataatgcccagcacccctgctacacacagatgctaccagaagatcatggggtgcgcagtgaactcattggggcgaaagcctctttaggaagggctgtatgtacagctcaagtgagaatgtttcctaccagagctattcagaagccgctgttagacataaccatgtgagggacccaggtaaacaggaaggaaaggagaaagtcaaacgtgagtttactcaacacagaaatactctctcagaagcttagggcgaaaggtatagcactactttcctagaaaagctttccagcgcggctgtttatttgatagatgacacctgctttctctttttttttcctctcagtgcatcacctatacacagcatttcttatctttgtgagagtgaaaagatggtgtttggtggacagaaatctgcatctgaagcattcattatgcaatagtgcagtcctcagtcttctaatccgcaaaataatgggtagatgctcaaatgagaacatgagatgggagaggagttttcttacgaagccctttactctcctttcttccttgctggtgcagctgtctttctattacaaaggctttaggccaggcgtggtggctcacgcctgtaatcccagcactttgggaggctgaggcaggcagatcacaaggtcagcagtccgagaccagcctggctaacatggcgaaaccccatctctactaaaaatccaaaaattaggcagatgtggtgggcatccctgtagtcccagctattcaggaggctgaggcagatgaatagcttgtccctgggtggcagaggtggcagtgagccaagatcacaccactgcactccagcctgggcaacagagcaagactctgtctaaaaaaaaaaaaagcctttaaaaatcagagactcactttgcaagccaatcagtgaattttaggacatggggatgtgacccactcatggccaatgagacatacaggaaagtgtctgccagggcatttttgggataaacttttcttctggagagagtccactaccgagttgctgcactggacattgtcattggagaatatggcatcatctgtccctagcatttggctacaaaaaaaagtaaatttacatcctacaggaagatgctgcaggatctatgtttacatcatttcattatgccttggggtataatcaacatacaaaagcagcagcatttctatatgccaacagtgaacaatctgaaaagaaaaaccagtcccatttacaatagctacaaataaaataagatacctaagaatatacctcaccaagaagtaaaagatctctgcaatgaaactataaaactgtatggtatcaaaggtctcaggcagcaggtgcaaactaagaaaatgacttggaaccaacccaaatgcccatcaatgatagactggataaagaaaatgtgtcacatatacacgatggaatactatgcagccataaaaaagggtgagttcatgtcctttgcagggacatggatgatgctggaaaccatcattctcagcaaactaactcaagaacaaaaaaccaaacactgcatattctcactcataagtgggtgttgaacaatgagaacacatggacacaaggaagggaacatcacacaccagggcctgtcagtgggtagggggctaggggaggggtagcattaggagaaatacctaatgtagatgatgggttgatgggcacagcaaaccaccatggcacgtgtataactatgtaacaaacatgcacattctgcacatgtaccccagaacttgaagtataataataataaaagagaaactataaacaaaaatcctcttgaaacttaccctggagcttctgtgcaaatttttctttttcctttttctgatggggagggaccttacatcattgttgattaatggtaaatacatcaaatatattctataaagagaagtttgggatttggagaaggaaaactggatttctcgtcttgaaatactcagagcataacagcgtcagcccagaggcattcagcactgattatcacaatgctagcaacattattatcatcaaataaaaaaccaactcaaaaacttcagcagcttatctctctcagaatgtaactccagaagatacaattttctatgtaaactgtattcaaatatgactctcaatgtaaaataaaagataaatacatggaataggcatgggagtgaaatgtatttttttcttatcaatgattgtatttgtgtataaacaatggatttagcatatagatttacttaaatcactactcaactttaaatacatctttgtaataagaattactctttttatttgtaaatcatcccaatcttaaaagtaaatgttagtaatgttttgttttaatgagcaagcacatatatctataatatatatattgtgtatatatatatatatttaatttaaagctttccttggtcgggcttggtgtctcatgcctgtaatcccagcactttgggaggccaaggcaggtggatgacttgaggtcaggagtttgagaccagcttggccaacatgacaaaaccccatctctactaaaaatacaaaaatcagttgggcgtggtggtgcgtgcctgtaatcccagctactcaggaggctgaggcaggggaaacacttgaacgcaggaggctaaggttgcagtgagccaagatcgtgccactgaacttcagcctgggtgacaaagagagactccacctcaaaaaataaaaataaaaataaagtcttccaacaattttgtttgaattatggttaataacattgaaggttttctcctaattccaggggatgtttcgaatgccttctgttttgccatttcaattaataattccattcttgacctaccaaataatgcatatttaaaatataactttcatatgctaggaatgacctaatatttgtagtgtgttcttctaaaatacttctaggtcctcagagcagtgtcatttaattaacacggcgccattgcatctacttgaaattagttctaatttccgaaatggtaatctaattatttcagaacaatttacatagatagcacataaatccttaaaataaaatgtaacttgttgcagattcatggaatcatttctacgaagcaaaattgtattctacggcaaggcaagggaagcccagggaggtgaaattgtgtatatttattcctatgagaacatgataacaaagactaccaaattgcagagatgatcaccttcttgacaaattgtgtagttattgttacaaagaaacaaattttcattttgcacttgccaatctagtttactacccactgatgaaatttttcacttagacacaggtaacgggtctcagtgtttagaatcattgtataattatctgagacactacttagttttcaaatctccgaaacacagaagcagatgcgtttcacttagccaaggtcaaactgttattctctttgccagctgtcctgggatgatcctagttctttttttcggggggttatcatattagcaaaaatgattcaactgtgaattggtccctttgggatttcccactagaggagaagggtagtggtgatgtggcaaagcagataacaagaaaatactgctgtttctgttaacaatatgggctttccaaacaagctcaaatcagttctacactccataatattaattcccccaacacccctatgaaaaatactggtaaagatcttgaattcccaatacgcaatagaactgggaagtaaaaccattcggcataaaatgacattcccaaatagactatacaatttcaacttctttagagaaataatgccatataaatctaaactatgaagatgaaatttccaagaaagagcatatcttcattgtgtaatctaaaagaattgcaataatttcaaacttttaagaagaaatccaactcacacactgctcgttctgaacaatacgtatctaatcgccaagcttcattctgtactgtccctgtgttcagcaacacgctatgaagtataaaatagaaataaggtaccatcgtgatgtatgtggctgacattttatagtttgcaaaatactttcaactacattatttcatttgtaatgagaggctattatactgcagtggtttagagtgtgggtttgggagcccgcaattatctacatttgaagcctctgctatttactgtctgtgggatcttgtatacattctttgcctatgtttttccatgaccttatctgtgaagcgggatggtaactgtgtccaccttacaggattattgacaggactgaaagtattagcgatcttcccagggaccagcacagaaaaagtaatccacgtatgttggcatttcttattgttgtttgatcatccaagcaaacacaggagtaagaatttatatgtaaactagggctcagatcaagtggcttttttttttttttttttttttttttttttttttttttttttttttttttttttttttgaaaaaaaacaaggccctgcagtccaggcaagagtgcagtggtgcaatctcagctcactgcaccctccacctcccaggttcaagcgattctcctacctcagcctcctgagtagctgggattacagggtccctccaccacacctggctaatttttatatttttagtagagacagggtttcaccatgttggtcagggtgatgtcaaactcctgacctcaaatgatccacacacctcggcctctcaaagtgctggaatcacaggcgtgagccaccccgcccgactgactttttcttaactcatgaggattagatcagatttggaattcaattgttcagactctatgacagattttttgtatacacagctgctcccaattcatagaagtttcttgagttcctgcacacacaagactgacaggtgtgaagcagaggtgagggattggcagaggtgagcgccagcacccagcgtcaactgctatttggtatgcggatgcttcctgccaccgctaagccttgaaatgctcagagaaggagaaaacaaatgctaggatacagccgggttccatctgttaaagcaaactaaatatagcctgaggagaactccgtactttcgtatatgactccttgtggatgaattgcaactaactgaacaggcagacaagattgagaacctaatttacgagtatgcatctgtaacaagagctcagccttggccagtcccagcagccatacttcaaccatttataccctgctgagcgttcaaactgtgctcaaacaaggcaaatgccaacctgcaaccaatccagctgtttctccacctcactgcagatttctgtatgttacttccctttttttgtgtataaatcttcttccaccacgtggctgtgctgaggctctctgaatctgctgtgattctaggggttgcctgacttgcgaaatgttcattgctcaattaaactgatttttttttcttttttgagactgagtcccactttatcacccaggctgcagtgcggtggcacaatctcggctcacggaaacctccacctcccgggttcaagtgattctcccgcctcagcctcccaagtagttggcattacaggtatccaccatctcgcccagctaatttttgtatttttagtagagacgggatttcaccatgttggtcaggctagtctcgaactcctgacctcaagtgattcacccgccctggcttcccaaagtgctggggtgacaggcctgagccaccatgaccggcaaactcctttaaatttaattcagatgaagtttttatcacaccaaacaagccaccctttagatcggtgttgaaggacgacacataggatttgtacaggaagatggaagaagacagcaaatttatagcaaagaggagtaagattgagggaagagagaaaatgagaacgggacacccagaggctgcgggagagaggagctacgcagaccttgatggaagaagcgggggatttttactcgaagtcgtagaaaacatgaaaggcaactgctcagtagttgtgtagaaacagagaaggagcatgcttaaagggacattagtggaacaccaggatgttttatcttcacaaaagatttaggctatagagatagctcaccaaggaaaaggtgtaaacatacaaaactacccttgaattaacagtgggtttaggaaaacacagtatgttcaactatgctcaatcccagatgggagcatttttattttctttctcattgtcactagtgagtaaaatgaactataaatgttgtaaacagttaaatggtttcttaaaatctctctctccccactcctcctctcctttccatctctccctaacttaaatatatgaatgtcaagactccatgccacattttctttatccagtctattattgatgggcatttgggttggttccaagtcttggttattgtaaatagtgctgcaataaacatatgtgtgcatgtgtctttatagtagaatgacttaaaatccttttggctatatacccagtaatgggatcgctaggtcaaatggtgtttctggttctacatccttgaagaatctccacactgtcttccagaatggttgaatacaccattttttatgcagccatgaagaacaatcagttcatgtcctttgcagggacatggatgaagctggaagccatcattctcagcaaactgacacaggaacagaaaaccaaaccccgcatgttctcactcataagtggggttgaacaatgagaacacatggacacagggaggggaacatcacacaccagggcctgtcggtgggtagggggaaagaggggggagagcattaggacaaatatgtaatgcatgagaggcttaaaacctagatgatgggttgataggtgcagcaaaccaccatggcacatgtgttcctatgtaacaaacctgcaggttctgcacaagtatcccagaacttaaagtaaaataaataaataaataaagactccatgccatttgtctggcagtgggaataaaggaaaatgcagatgtcagcaaaatcagagccccacagaactgcccgcaatgaagacctgaagcagtgggggcctcaggagaggccgacaaagaaaaggttaggaagaaaggctggtgcattttcatttccagcacagagaaagcgtgaacaacaaagatatttttaaacaaagagttgaagaggccgttctccatgaaagtgagagagtgctgatactactgacagacaggggtgggatgtgggcagtagaatatatttttcagaggtaggcatggtgcgttctgtttggaacatggcaagtttgactttataaaggggcacttctgtaaatttccctgactgcttttaagacatgtggacaggaaggactcaagagaactgagagattcagacatcgatttgatagccatagggactgtgaaaggaaaatgaacctcagggccccaaaatcactgagctacagggaaaagtcaagctggaaactgcttacggccaacctgcctccaactctattcaaagccacccctctgctcactgagataaacccatatctgattgcctcctttggaaagactaatcagaaactcaaaagaatgcaatcatttgcctcttttctacctatgaactggaaaccccttctctgcttccagccgttctgcccgcctttgctttgagttgtcctgcctttctggaccgaaccaacgttcacctcacatatgctgattgatgtctcatgtctccctaaaatgtgtaaagccaaactatactctgaccaccgggggcacgtgttatcaggatcttctgaggttgtgtcacaggcgcaacctcaaccttggataaataaactttctaaattaactgagtcatgtttcagatatttggggttcacagaaccaaggctttgttcaaacattactaaatcttattgtaaatcttcagccattggatggcttgagttaaagttcttaatcttaaattttgttattattattaaactttaagttctagggtacatgtgcacaatgtgcacgtttgttacatatgtacacatgtgccatgttggtttgctgcacccattgactcgtcatttaacattaggtatttcccctaatactatccctaccctagacccccaccccactacaggcccctgtgtgtgatgttcccccactctgtgttcaagtgttctcattgttcaattcccacctatgagagagaacatgcggtgtttggttttctgtccttgcaactgtttgctcagaatgatgttttccagcttcatcttaaaattaaaatattggacttcatacaatgaagctttttctgctcctggttcacttcaataacctgaatcagttctcttccaaaaccatgttattctgggcaaaatggaaattgctcagaaagcataggcagctcaatgttaatcatgcatagaatatgtaaaatatcctccaggattgtatgctgatggtgggtcaagagcgtgagtgtttcctcatgagagaaaagcaaagagactgaggagttttcctctgccttgtattattctgtctgtctccccaccatttcaaaggctccgccaagatcaggagcatcttttctcattgcttttgcatcaagaagctgaaaagagctggcccatcatcttatcgggatgttgaataaaaatatctaatgaagatgtccaggttaacattgaaaataaagagtacatcctgacactggtaaaactgtacacaaagctatcaagagagtcaacattaaaatagctaaaagtttagcagtaaagccagacatcataaacaattcagacagaatttcaacgtcacaaattccaaaaaatacatcacaatttctcagggtttcattttgtctctgtgcgtcaaagatttcaatacattctttaaaagtgactttcctattttatatgtatatttgatatatattattaatgtaaaataacataattatacataaactaccaatttctctgatgtttccatgacattcaagaaacatccataacctaagaggttaacaatgcttataataagaaagtttcaggtgattaggaattttgtatcatgagcattgaccaatgagataaaattactggaacaatattaggtatttgcatcttttactgatatattgttttgctaaataaaatataatttgtcagccaggcacagtggctcacatctgtaattcctgtaatcccagcactttaggaggctgaggtgggcggatggcctgaggtcaggagttcgagaccagcctggcccatacggcaacaccccatctctactaaaatacaaaaattagccaggtgtggtggcatgcaccagtaataccagctactccggaggctgaggcacaagaattgcttgaacccgggagacggaggttgcagtgagccaagatcacgccactgcactccagcctgggcgacagagcgagactccatctcaaagatatatatatttgtcaggaaaataattagtatcttgattccttactatcccacttaatattaaccaagtaattgactcagtagggttctaaataatccctgagagaaatattgaaaaattccacttaatgggacaaacagaaagataaaactcaggaaatgtgaaaccatcgctacatatcttatctcaaatgaattaaagtcattaaaatataggaaggtgtttatccaaggcagtagcttgaagctgaggctatttcttagagcacccctaggaatctcttgaatgatcaacccaaggcttaggctcctgcatttatgacctcagtgttggtttgcttttttgttgttgttttgtttttttgagatggagtcgcactctgtcacccaggctggagtgcagtggagtggcctcagctcactgcaacctccacctgccagattcaagtgattttcctgccttagcctcctcctgcctcagcctccacggagtaggtgggattacaggtgcccaacaccacacctggctaatttttgtatctgtagtagagacagtgtttcaccatgttggccaggctggtcttgaacttctgacctcaagtgatctacatgccctggcctccccaaatgctgggattacaggcatgagccaccacgcttggcttgatgctttgtttttctcattgttttccccaccacactggtgagactttccatttctattcctcacaggtcttatcttttctttagtctatagattgtgagaaccgatgtgaagaatatgcttcaaaagcaacttaaatgatataaacgcctgtccgtttaaaatgacatattcagtagagttcaagtaattgattaaaaatttgaaaatatctgattttaatgtatacttgctaaaataattaagacagaaatactgaatcacgattgatccttgctgttaacatgcacagggccaggatctacacatcatctattctttcaacaagccttttttgaaagctgcctgatatggtttggctgtgtccccacccaaatctcatcttgaattgtagctcccataactcccatgtgttgtgagagggacccagagggagataattgaatcatgggggcagtttcccccatactgttctcatggtagtgaataagtctcatgcaatctgatgtctttataaggggaaacccctttggcttggctctcattctgtcttctatgcctccatgtaagatgtgcctttagccttccatcatgattgtgaggcctcctcagccatgtggaactgtgagtccattaaatctctttttctttacaaattactcagtctcagataggtctttatcagcagcatgaaaatgaactattacacctgctatggtgcacatgatttaccaggtgtaagagatagagaaataaaagcattgcagtctaattgtaagagctcgaattttagcagaaagataactatggcacaaccctgaaggcgccaagctagaagtatgctcagatcctttcattccttcattctctaaatgattattgagtgcttggtacaagcaaggcaatcttgtaggcattagggatacaccagtttgggagtgaggtaaaggggggctgttcttatggagctcacattctaatgataagacaaatgtgcaaacatttataaacatttacacattatataatcatagtccctacattatattaatatatattaataggttttatgatatgtcagattataagggttatgtgaaaaataaggaaagataaaaagagagtgaaggggtggcaggtgtccccttgtgtaggatgtcatggagatgacatttgagaaaggtctcggaggagtgaaaattgaggtgtgtggagatcttggggaagagattttggatagcagccattggcaaggccttggggcactacagccctggcaaacaatgcagggccagggtggctggagccaactaggggatgggagctgttgggatgaggtcaggaaggacgtgaggactaggctgagaaagtccttggagacaacataaacacctgagatgattttgtgagtgacagaggagtcctcctccttatttgggttgctctggaaacccaggccttggggtgaagagcagttgtccacgcatggtgatgactgaattgagctgttagaggattagtagttactcattagagaaagtaaacaagagttctgaaaagcaaccttcagggagcaagtgtcttgcggaaaatcatggaaacagaagacccagggcaaattcatgaacagcaggcatcctggagtgtctgtatgtttaatcgtgaaatagcagtgagtagaagcagccaaggccagatcatcaaagactctgtatgttgcggagacaccactggtgccaattcacccacccatttcctccctgcgtctttctaacagagccccaatcccgatcaatatgagtgtctgtgcgcctcagagcaagctggcttctcccccagtccccatcccaaggatgagccttgctcagtctcaatcaggtgcagtcattctacccctgggctagaaggcaatggggagagagcgttgaacacaatttggacagataacgaatctacaggggtgtgcagaggggctgacctctgagatatgtttcccagctaataagggaacatagtaaaactgacatccgtccaccactgctggatctcattctgggtgatgagttcagcctgcgaagatggccctgtgtaaaggaagatatgaagtgagaggattaggaaggaggggcatgtcccacacaggccctgggctgtgcatgacggatggagtccccagacccaaattctgttttaaatatgtatttttaagataactcaggtagctacagtgtaagctgaagagatgagggtttattcaggtggagagatgatagagtttgggggatattacaaggagaacggagagagtttgtctgactgggcattgtacaccttggtcctattccttaccacaggtaatatgcaaaggggatcaagcctggtccttactacagaaaatatgcaaaagagacgaagccctggggagaagagacgatcctgaacagagtgtgcaatatagaagctcagtctgaggtgtccagagatcaaccaggagtcgaagtctagacacagagatggatgagttgggagctcaggaggggccaacgctagggaagacccatactgaacatcctgtatctactctagttttggctcattttgttgccttagacaatttgctgttaagtaaagttatagaatgaacacaattatagaattatattgctctggtggctatcagccttaatgcgggtggcaaagcaacgcctacatcccctcagccatagctctttgagaggcgtgacagaaacaggaaagatggggagaaatcattgagcaaccaggttagcctgtgctttcactggaaatctttcattaaacagacgttatacctttagagtttaccttaacctgtcttcaaaactaaggaacgaccccactagaaatatgattgtggaagccattaacgtacagaaaaattagttaattatccctcaagggcagaatggttaaaacaaggaaagcacgtacaaatgagcataaagttatgttttaattgaaaggctaggagcataaattcaaagacactaaataaggtagcacactgcatcaatctgagtgaaaatgtctcatctgtgttttctcatctgtcattttgtcattgtgttgcctgtttgtgtgagcaattatttccttctcaggcccatgcttcagagcctgccttgggcgggagggtccaaggccttgagcttcttgggctggccagtctaggggttcgtgtttacactgtagtgagggactccactgatggtcctgttcattcattcattcaacatcagtaattagatatcctctactaaatattgagaatacaagtcccaagttaatgaatcttgaatggagaaacctcaggttttcagaaggaggggaatgtagcctgaatgagactcttccggacagaaaatcacgacagggaagacaagctgggtattcgcccgctgggtacatcatttattaactcaacagatgttagctcagcacctattctgtgtgaggcgttatgctaggaactgggtacaaagaggaaggccaggaggacaggggccctgacctggctaagcctgaggctacacacactcatcagagccctcagggatccacgtgcagccctaacagccaattcagagaacaggacacagtgggtgatgtcagccatgaacaggaggggcccaggtgatgatcaagcacctccttccttcttctttcttaacatttgaggaaatgaagatgtttgagactttaaataacacacccaaggatataatttataccttattattttaagctatcaggtgcaattgcatacatttctaaataagttatgtaaaaggcagtgaaatgttcctagggtctcacaatttgtgatggttaatactgagtgtcaacttgattggattaaaggatgcaaagtgttgatcctgggtgtgtctctgagggtgatgccaaaggagattaatatttgagtcaatggatcagggaaggcagacttacacttaatctgggtgggtaccctctaatcagctgccagagaatacaaagcaggcggaaaaatatgaaaaggtcagactggcctagcctcccagcctacatccttctcctgtgccggatgcttcctgccctccagcatcagactccaagttcttctgttttgggactcgggctggctctccttgctcctcagtttgcagatggcctattgtcggaccttgtgaacatgtgagttaaaacctaataaactcccctttatatatatataaatatcccatatatatgtatcccatatatatatatcccgtatatatatcccatatatatatatatatcctatatacatatatcccatatacatatatcccatatatatatgcgatatatatatatgggatatatatggggatatatatattgcacatatatatggggatatatatatgggatatttatatatgaaggatatatacatgggatatatgtacatggttatatatgtatgggatatatgtatatgggatatatatgtatatgggatatacatgtatgggatgtatgtatatgggatatatatgtatgggatatataagtatacgggatatacatgtatatgggatatatatgtatatgggatatatgtataggggatatatatgtatatgggatatatatgtatgggatatatatgtatatgggatatatatgtatgtgatatatatgtatatgggatatatatgtatatgggatatatatgtatgggtatatgtgtatgggatatatgtatatgggatatatatgtatatgggatatatatgtatgggatatatatgtatatgggatatatgcatatgggatatatatgtatataggatatatatgtatatgggatatatacatataagggatatatatgtatgggatatatatgtatatgggatatatatgtatgggatatatgtatatgggatatatatgtatatgagatatatatgtatatggtatatataggtatatgggatctatgtataggggatgtatgtatatgggatatatatgtgtgggatatatatatgtatatatatatatatgatgtgcctggacacatcacaggcacctgataaatgctaacattagttatgtggaaattattacatgctgtattgtatttaatttcataaattgcctgaaaacttttatatctcagaagcatatagatcttaaatacatcctaacagtactatatatatagtcacatataatcatatatataatcatacacatataatcatatatatactcatatatatgatcatatatatatatatatgatcatatatatgatcatatatatatatatatgatcatatatatgatcatatatatatatatatatatatatatatatatatgattagttctatctctttagataaccctgactaatataccatctatttaggcttcacaagcctctgccttgctttaaggtgctgtgagctccttgggagcctcttcatcttattcgtgttgcatgcccagcaccggcaggctgcctgggacacaaaacaggccccttgctcaggtgctgttaaattggaaagagcagccctgggcttggagcctagaacttcagttcttgagcaatgacttgaaagcaggcccactcacctgtcaccacctctatcactgggagatggggcacccaccctcatttcctctgtcctgtgtcgttagcctgctggtcatttttgaaagaaagttttcgaccacacatttttagtttcgatatgttgcaatacttaaacaaaaataattgagaacacaaaagacagtaggttttatttaaatgaagaagcaaattaacaaagtcaacatcttatcttactttcaaagtgtatcattctaaaaggttgatgcagcgttcaaggttaggtgctgtctacttcctcttgcaaacttgttttctagtgtgaaatctctttatggtcagggatcttataagtttgatgaaattgactgagtatggcctgatttgttatttgctcataagattttttaaaacttacacattatattaaaccaaagagtcttaaccataaattaagaaatagtctgagaatcctaaggttctcccaatggcttctgaccttcccctttttcagttgtagtgtgtgtcggcatttagaacccactcttgcattctcaaccacagctcagaaaacataaacagtccagggtgtgctggtatcagagtgtgggagctgactttcaaatgttcaaaacacgtgtaggtctgctgctatttcagttttaaatatttagattatataaactttacaagaaatcaattatattaaaacagaggtaataatggtttaaagctcatggattcccaataatgtgtttacatttggccattgtctactcttgaaggtatttactttttcatccggtcagagtatgacatggtgcagtgtcactgggcatctgttcccaaggctgtctccagtgatgggcatggtggtggtttgaaattggccatggtggatgtatttaaaccaggcaaatggaagaaggctgcatatcaggctcttctcctgggagaaccctttgctaaacattttccagcagcacattaccatgggcaatagacttggagacgcagcttctactcctccttcaggtttttcaatccatgaaaatccatggtttttctatcttaaaaagccttttccaagctcttcaccccaaggagaatcaataacttatctcgttattcctatgccttattgtaagtacttgtgttgtaacacataccatgctttccttgtttaaggttcatttcatctctagaaagtgagcatttagcggtatgattgatatactgtaaatgttcaataaatgcttactgagttaataataaatgaatcaattaatacagagtaggaagatattaaaggaaactctgatgctatgtcattaatgggacacagaatctgaaattattcaaccacatatgcccctgtgcatgaaccacaataaacatttccaaattcgtttctattgaacacatgctctttgtcctctttttctcaaatccgtatcctctacaagcctgcttaacaggtaaactgaaaattcagcaagtactgaacaaaagaattgcaatttcatgattcagtattggaaaattagcaagaatatggagatgaaagtatttgaagacgtagcatcaactccccttggtctctgggtacaatgtggccctgacttatgacaagcaagaatgtgtttaacaacctactcaactgtgatgttcataaacattttacaggagaaagtgtttgcatcttcaatatttcacaaagagcctaccctctcagtatgcacatacttgattcagagctaattttaacttgaataactcagcctgtttgacctaacgggtgcgggcaacttatatataaagcatttacggtgtgagctatttttaacttacacccaatcagctggcttgctgcatgatatgagcactgcattttagtccacgaaactattggagctattccctcaagcatgaaagcatgaaggtgcaaacctacactgtgggcactggagtgcaacacgccatcattaggaactctctggagggccaggcatggtggctcacccctgtaatcctagcactttgggaggccaaggcaggcagaatgcttgagctcagcagtttcagacgagcctgggcaacatggcacaatcatgtctctaatccaaatacaaaaattagccaggcatggtggcacatgcctgtggtcccagccactgtgggagaataacttgagcctgggaggcagaggttgcaatgagccatgataatgtcattgcactccagcttgagtgacagagtgagactccctctcaaaagacaaaaaaaatctccctagaaactgtccatttgtcaatgttgagcaacattcataatgaagacttcgagaaaatacaagaccctgagttgtctctagaattatcaaaagcagattgtattatggttgacttcattttgttagttgactgtaacccatgttgctttattgcaaattaataaatcacccaaaataccacattctttgaacttaccatgtaaaatatcctataatctgaagattaacaaattatcatcacgagctaagtagaagccataatttcctaagcatttctcattcaaatcaagaatatttaaatagaaaataccaccatggctattatcattattattataaacaaaaaatgatcactactcttaaaagtattggacagtataccgtgaatcattagataatttaacaatattattaattaaatgcttactatgtatcatgtactacattaagctactgcaaaatatattataactccagattctagatattaatatccttattttacagataataaaactgagtcaaaaaggacttgatttttctagccatataaccagcagaggcagagaatgagatgagagccccagtcttgctgattccaagtccctgcccttcatcccaacttcactcttcaaaaaatgaaaggtaactatagttttcaaagaggtgaaaccaattccaaatgaggctgcactgaagttatcagggcactttgcagtaaagactatcctttaaatttgaaaaaggatggacaacgtaagacttgtttatatcctggaagataatgaacttatgcaacacgtcaccccctaagcctctgtaggccaaaaacataaacaggcacaaaaaggggttaacatcagtctccctggaaggtttttaatgcccagtgatgcagggatttaggtggatgtattaatatccaccttttggaaacctgacgaataccgtcgaccataaaacgccatcttgaagagatgcagtggcctcccctcaccactttcccatcatggctcaagtgccactttctccacatgtctttccccactagtggctccttttctcctcacagaaggcctgaccacacctgttctccttgcagcacctgttggtcttcattgacctggctggcatgtgcgtgccattcccctgctcctggagggttggcagcactatgcacatcctcacgtctccactgtctaacatgtcattgctatccatgtagcctccatagtaaggcctcagcaatgtgggcttggatatgctatcttgttttgtttgctaatgaacaaaggaagtcttctggatggaaagaccaaaaatccaagagaaggtgattgcaatggactgaatatttgtgtcccaccaaaattcatatgttgaagccccaatctccaatgagatggtgtttggaagtgatgctttcaggaagtgatttggtttacatgcagacacgagggttgataccccatgatgagattagcacccttataaggaaaggaggaaaccagggtgttctctgccactcaaggacacaattagaagatgccatctgcaaaccaggaaacgggtccttgcaagactctgaatctataagcaccttgatcttggacttccagtctcaaaactgtgagaaatatatgtctgttgtttaagctgcccagtctatgatattttgttatagcagccagagttgactaagctggtggcatttccaccttatgcaaattttctagactaacgctacttctcatgattctgtcttgctgaagttctctctcagcactgtcccatcattggagagtaatgtacctgagtattattttctcagcccaggcctgccatcttcccagtcagagactctgtaatagtttactggtttggccttagtatcttatcatttatgacaaatataggcataggaagtcatcatttgattagcacctgtatctcttaattaaatatatgcatgtgtgtttataaatgcttgttataagatactattatacctagaataggtaaattgtttattttcttctgctcaattttatagtcttctcctcgtttgtccatactgcattatgtgttgaagtaaatactaaccttggggtcagacatgtacagttttgatccctggccctaagtatttaccaactctgtggccctggggcaagttcctaagctgtattcttttctgaagagcaggtggaggtgggtggccgcccgccaggcaggattgttgtcaaaactagatgaaaacttatataccaagcaccatgctggacacgccacaggcacccgataaatgctaacattagttatgtagaaattattacatgttatattgtatttaatttcataaattgcctgaaaaattttatatctcagaagcatatagatcttaaatatatccgaatggtacacatgttctcccttaccattaaaatcatatacacggatatatggaaacttttcctaagaaggttgccgtgagcttgtgtgttgtgggaccacgcacacacatgtgggtagagtatatgaatcaagttccatatcttaaagatgactgtccatttctatcaaactcagtgtgatcattgaaatacgtatataataaacatagcaaacacttggaaccaacccaaatgcccatcaatgatagactggataaagaaaatgtggcacatacacaccatggaataaaggatgagttcatttcctttgcagggacatggatgaagctggaaaccatcattctcagcaaattaacacaagaacagaaaaccaaacaccacatgttcacactcataagtgggagttaaacaatgacaacacaaggacacagggaggggaacatcatggaccggggcctgttgcggggttgggggcaaggggagggagagcattagaacaaatacctaatgcatacggggcttaaaaactagacattgggtagataggtgcaacaaaaaccatgacacatgtagttctatgtaacaagcctgcacattctgcacatgtaacccagaacttaaagtaaaataaaaataaaagaaacacgtatataagacttatagaaatacacacaaggaaaacaccgcttaaaagtccaagattaatagcatgcatcgaaaatttctctcccaggaaagttatggttccaactaatgattgatgtaacaaaatgacttaataaccatctataccttttaaaagtaattcttgaataaataagcagttatttgcctcccacacaagaaaacatacccagttcaaggccaatgcatgggaaacaaacctgatcccacagtacaggttgtcaggaaagtcctgggtgaatgcacagatctgagcaccacagaagacatcaggagacacagggaatgcccaggtgtccccagggtggctgggctcagcgagaggcacccagaagggtttggagatgtcttagattcacgaaagcctaagattggccctctgagtttagaacctctcttttaagcaaaacctccagctattgacatgaaaagatatctatcctttagggctctttggccagagctgggtaaattcccctgttttgttctggaagtctgtcttttggaaaaaagccctaaactttgtaaaacggaaatgaaaacttctatccagagtatatgtgcaattttttaaaaccagtagatgacataaaactgcatatttcaataacattctttaactctaaacccccttgctgaagccatttcagccctttttttccatcatgaaacacctcccactaatagagctgtttgtattagacaaaataagacaggaatgcacttgaggagcagaaacactgacttggtgcagggactcacagcctccatctggggtgtctgcctatcttcaaagcgttctgtcaatatttaaagacagtgggagggtggttcaaagatggctgaataggaacagctccagtctacagctcccagagtgagcgacgcagaagacaggtgatttctgcatttccagctgaggaatgcagctcctcaccagcaacagaacaaagctggacggagaatgactttgatgagctgagagaagaaggtttcagatgatcaaacttctccgagctaaaggaggaagttcgaacccatcgcaaagaagttaaaaactttgaaaaatgattagacgaatggctaactagaataaccaatgcagagaagtctttaaaggacctgatggagctgaaaaccatggcacgggaactacgtgatgaatgcacaagtttgaacagccgattcgatcaactggaagaaagggtatcagtgactgaagatcaaatgaatgaaatgaagtaagaagagaagtttagagaaaaaggaataaaaagaaatgaacaaagcctccaagaaatatgggactatgtgaaaagaccaaatctatgtctgattggtgtacctgagagtgacggggagaatggaaacaagttggaaaacactctgcaggacattatcaaggaaaacttccccaacctagcaaggcaggccaacatgcaaattcaggaaacacagaggacgccacaaagatactcctcgagaagagcaactccaagacacataattgtcagattcaccaaagctgaaatgaaggaaaaaatgttaagtgcagccagagagaaaggtcgggttacccacaaagggaagcccatcagactaacagctgatctctcagcagaaagtctacaagccagaaaagactgggggccaatattcaacattcttaaagaaaacaattttcaacccagaatttcatatccagccaaattaagcttcataagtgaagaaataaaatacttcacagacaagcaaatgctgagagattttgccaccaccagacctcccctaaaagacctcctgaagaagcactaaacatggaaaggaacaactggtactagccactgcaaaaacatgccaaattgtaaagaccatcgaggctaggaagaaaactgtatcaactaatgagcacaataaccagctaacatcataatgacaggatcaaattcacacataacaatattaaccttaaatgcaaatgggctaaatgctccaattacaagacgcagactggcaaattggataaagagtcaagacccatcagtgtgttgtattcaggaaacccatctcatgtgcagagacacacataggctcaaaataaagggatggaggaagatctaccaagcaaatggaaaacaaaaaaaggcaggggttgcaatcctagtctctgataaaagggactttaaaccaacaaagatcaaaagagacaaagaaagccattacgtaatggtaaagggatcaattcaacaagaagagctaactatcctaaatatatattcacccaatacaggagcacccagattcataaagcaagtccttagagacctacagagagacttagactcccacacaataataatgggagtctttaacaccccactgtcaacatcagacagatcaacaagacagcaagttaacaaggatatccaggaattgaactgagctctgcaccaagcagacctaatagacatctacctaactctccaccccaaatcaacagaatatacattcttctcagcatcacaccacacttatttcaaaattgaccacatagttggaagtaaagctctcctcagcaaatgtaaaagaagcgaaattataacaaactgtatctcagaccacagtgcaatcaaacaagaactcaggattaagaaactcactcaaaaccacacaactacttggaaactgaacaacttgctcctgaatgactactgggtacataacgaaatgaaggcagaaataaagatgttctttgaaaccaacgagaacaaagacacaacatgccagaatctctgggacacatttaaagcagtgtgtagaggaaaatttataacactaaatgcccacaagagaaagcaggaaagacctataatcgacaccataacatcacaattgaaacaactagagaagcaagagcaaacacattcaaaaactagcagaaggcaagaaacaactcagatcagagcagaaatgaaggagatggagatacaaaaaaacccttcaaaaaatcgatgaatccaggagctggttttttgaaaagatcaacaaaattgatagaccactagcaagactaataaagaagaaaagagagaagaatcaaatagacgcaataaaaaatgacaaagggtatatcaccactgatcccacagaaatacaaactaccatcagagaatactattaacacctctacgcaaatgaactagaaaatctacaagaaacagagaaattccttgacacatacaccctcccaagactaaaccaggaagaagttgaatctctgaatagaccaataacaggctctgaaattgaggtaataattaatagcttaccaaccaaaaaaagtccaggaccagatggattcacagccgatttctatcagacgtacaaagaggagcaggtaccattccttctgaaactattccaatcaatagaaaaaagagggactcctccctaactcatttcatgaggccaacatcatcctgataccaaagccgggcagagacacaaccaaaaaagagaattttagaccaatatccctgatgaacattgatgcaaaaattctcaataaaatactggcaaaccgaactcagcagcacatcaaaaagcttatccaccatgatcaagtgggcttcatccctgggatgcaaggctggttcaatatacgcaaatcagtaaacgtaatccagcatataaacagaaccaatgacaaaaaccacatgattatctcaacagatgcagaaaaagcctttgacaaaattcaacagcccttcatgctaaaaactctcaataaattaggtattgatgggacgtatctcaaactaataagagctatttaagacaaacccacagccaatatcatactgaatgggcaaaaactggaagcattccctttgaaaactggcacaagacagggatgccctctttcaccactcctattcaacatagtgttggaagttctggccagggcaattaggcaggagaaggaaataaaggatattcaattaggaaaagaggaagtcaaatcgtccctctttgcagatgacatgattgtatatttagaaaaccccatcatctcagcacaaaatctccttaagctgataagcaacttcagcaaagtctcaggatacaaaatcaatgtgcaaaaatcacaagcattcttatacaccaataacagacaaacagagagccaaatcatgagtgaactcccattgacaattgtttcaaagagaataaaatacctaggaatccagcttacaagggatgtgaaggacctcttcaaggagaattacaaaccactgctcaatgaaataaaagaggatacaaacaaatggaagaacattccatgcttatggataggaagagtaaatatcgtcaaaatggccatactgcccaaggtaatttatagattcaatgccatccccatcaagctaccaatgactttcttcacagaattggaaaaaaactactttaaagttcatgtggaaccaaaaaagagcccgcattgccaagtcaatcctaagccaaaagaacaaagctggaggcatcacactacctgactttaaactatactacaaggctacagtaacccaaacagcatggtactggtaccaaaacagagatatagaccaatggaacagaacagagccctcagaaataataccacacatctacgactatctgatctttgacaaatctgacaaaaacaagaaatggggaaaggattccctattcaacaaatggtgctgggaaaactggctagccatatgtagaaaggtgaaactggatcccttccttacaccttatacaaaaattaattcaagatggattaaagacttaaatgttagacctaaaatcgtaaaaaccctagaagaaaacctaggcaatactattcaggacataggcatgggcaaggacttcatgtctaaaacaccaaaagcaatggcaacaaaagccaaaattgacaaatgggatctaattaaactaaagagcttctgcacagcacaagaaactaccatcagagtgaacaggcaacctaaaaaatgggataaaatttttgcaatctactcatctgacaaagggctaatatccagaatttacaaagaacccaaacaaatttacaagaaaaaaacaagcaaccgcatcaacaagtgggtgaaggacatgaacagacacttctcaaaagatgacctttatgcagccaacagacacatgaaaaaatgctcatcatcaccggccatcagagaaatgcaaatcacaaccacaatgagataccatctcacaacagttggaatggcgatcattaaaaagtcaggaaacaacaggtgctggagaggatgtggagaaataggaacactttgacactgttggtgggactgtaaactagttcaaccattgtggaagacagtgtggtgattcctcagggatctagaattagaaataccatttgatccagccatcccattactgggtatatacccaaaagattaaaaatcatgctgttataaagacacatgcacacgtatgtttattgcggcactattcacaatagcaaagacttggatccaacctaaatgtccaacaatgacagatgggattaagaaaatgtggcacatatacaccatggaatactatgtagccataaaaaatgaagagttcatgtcatttgtagaaacatggatgaagctggaaaccatcattctcagcaaactatctatcgcaaggaccaaaaaccaaacactgcatgttgtcactcatacgtgggaactgaacaatgagaacacatggacacaggaaggggaacatcacacaccagggactgttgtggggtgggggtagagggaagggatagcattaggagatatacctaatgctaaatgacaagctaatgggtgcagcacaccaacatggcacatgtatacatatgtaacaaacctgcacgttgtgcacttgtaccctagaagtataataagaaatatacatataaatatataaaattaaaaaataaaataataaaaaataaataaaaaaataaagacagtgacccctgtgaatagcctgtggacccagaatatggatggatcagtcaaggcaaagttctttcattgtgttctcttatttattcttttatacaaccacgagtgagctgtttattctgggcactgcatccttatcactaaagtaattacaggcaatggtttgaaactatctgcctaaagggaattcagaattagaatcctccatttctggaggggtgttcataggtacctgtcagccctcctctcacttggagggggaggtatttctgcactgtgccaaaaaatcatttgaaaccaaaagaaaaatgaaatatgtttaaagcacttttttgaatatcattcttctgccaggtcttccgctgaaaacatgtgcatactcttttaatttaatacctataattatcctgtgaggttgtcatctcttttccacactagacagaaagaggctcaagctcctacaactagtaggttcaactcaaacccaggtctccagacctaaaatgttatgttcttccagttaaaccacatctgctttgtgttaacttgataaaaccaatgtttgcgtaatcattctaagatgtaaagaatattcatgaatgttaagctcgcagtttgcttatttttatttgatgtttattgatttcaaaaaatgactgttagaccactaagttttagcaaatttaggacaatgcacaccttttgcttcatgtgattgagaagtatgaagtaactcattagaacacattcaaattaatggactaacaccaaagagacagtctttctattttaatgtagtgatagttactctaaacatgaaaaaagcaactttaaatgtatagatattatatattatataatatataatttatataatatataatgcctatatgttataatttatataatatatatttacatgttacatgtaatatatataacatgtaattatatataatatataacataatatataatatataatttatatattatataaaatatatagctatatgttatatattatatataatatataaattatatattatataaaatatatagctatatgttatatattatataaaacatacaagcatgttgtatattacataatatataaaatgtataacatataagtacatatatacaaaatatatttttttcatctgcatgactcatagtacttaacaattttatttagatataggttttgggatttttctttgcttgctaattatgaacatatattttatcttttttactggccatctagaaacaaatggcactgtctttctatatcatcattgttgaacccagttgcagatactgatacagtcttttttttttttttttttttagacggagtctcgctctctcgcccaggctggagtgcagtggcgctatctccgctcactgctagctccgcctcgcaggttcacgccattctcctgcctcagcctccagaggagtagctgggacctgatacagttttaaaatagagtcagagcttgacggcagcctaattttagtcaccctcattctccttgctatagatcatattccaaactagtatttccatcacgactcttattacattcagaattcttacatactttattgcagttctaaattctcttctgaaatttgtaatgatgccgggaagcacttggccaaagtggacaattaaactgcctttggaataacctgtggtaggaaagtcaatacgggaatcaatatttttggactgaagtgagctccacttagaaggatcagcatcatccaagcccagtttttgaaataaaaataagagatgtcttcattataaaacgatttactgggttcattatagaaaatgcatggctggatttttaaagtgttttgatgtcatcatttcagtcacatttaaattgatggataaaatcaaatccaaagttgcaaaattgaagccactgcccttgttttacaccaaaaatagtgactataaaataaagttgcctcagggctaattgtacccattacgttgagtttaatgactcggcagtctagttgtctttccccctgtaaaaattttttgaatcttcattacacatcatcaaactgttacctaaacaccaggggtcctgtctgggtcctgctgctcactgcacagaatgccaatgactgagatcacgattactgccaaggaagaaggctttaatcggatgctgcagccgaaggagatgggagctcagactcaaatccacctccctgacctactaaaattaggggtttatataacaggaagaaaaatgtaacaacgggttacaaaacaggagtgaagcatctggcatctcattgcctggatatggtgatctggtgagtttcatttctttgagactgtttttagaggcctgggggtgcttttctgaggaaggaagtcaaagaaaatcaatgcaatttcaagccttaagatcagaagggtcaatttctttctttttttttataacatgttttattgctttatttttaatttctatgggtacattgaagttatatacatttataaagtacatgagatgttttgacacaggcatgcgacgtaaaataatcacatcatggagaatggggtatccatcccatcaaacatttattgttcgtgttacaaacaatccaatacactcttttagttatttttaaaagtacaattattttttactatattcaccctttcccattttgctaccaaataaaatatattattctttctttctttctgtattttgtacccattaaccaaccaatgctccttgcccccacccctcactattcttatcagcctctgataaccatcagaagggtcagttttctatgtttatcaaaaagaaaaaaaaactgtctatgggactattaggtaggtttcaaaattcttatttgaaattaagcttgggcttgtttctgtgaagttagagtgtgggtcacccccttgagttactgacttcgtggataatcagagcgcttggaatacaagctaggaaaggcagtgtcaagagacgtgtcattgacagctaacactgtgactttcaggaagcgccttcacttctctacgcttgtcttcacttttctaggatagggaggtgccgccacactgacgatgagagttgcatcctgcgtgacttctctatttgctggtggatgggttaagaatatgccaccccaccatatgctgctctggcatgtttaaattaaagacgcttaaaaaaaagccagttacaagatcatgtcattctgttcattgaaagcaggagatagaattcccatacgaaatatactgtcttgataccaaaagggaagcagtgttcttatcatcaagcacagaaaactgaagcccagggatatctatacaaacaaaccttgctacactaacacttatccacctggtcacttctctagccgatcccttaccctcgcccaagtcccttggccttgccacgtttcacaagcaaatattctttgtccaagccagtctatcagtggctggttgtaactgtttctttggatcttcatttccttatgagggctcccaggccacatgaaatttgcattaaataaacctgcatgcttttctcctgttaatctttcttatgtcgatttcattcttgggccgtaagaggacagagtagagctttgtctcccctacactggggggtgtcttttccatatccacatagaagaagcttgttcaaacgtatcaggacattcaggagagatgtgactggtcaagtaggggtggatggcagatgtaaaaaaattatgaggatgtgacagtattggatatcaaataccaaatgtatgtccaataaaatgcaggatcctatactaatttaaaaccagaaatacaagcatgatataagcatcacacctctgaacgcacctccgtgcagctcataggaaggcaaccttccatcttggtttgcccagggcaggtccacattcactttgttgcttttaagtccagcttagcatttccaggaccaaaaaagtctgtggttaccccatgtatgatggatgaaaaggtgatctgctccatgtaaggctgcagaaggctgactctgtcccctttctattaaaatccatggtgagcagggatatggaactctgcatttctaattttaggctggaaaacttgcctctcaaataaattatggaagcagagcctttattgagaaagcaataaaacagtaagatctatttacaaaaagcaaccatctcaattttaattttctctacttttcttccagatattctctgtgtaaatgctatatttttcttccagtttcaatgaactgctcttgtagggatctctttgaagatttcagtgggttccgagcactgtgcccttgttcatttgtgctgagtggcgcacgctaggaccgaggctccctgagccccaccgtgctaactgatggctggtggcctttggaagcacgctgctatcttgaagacagcagggccttgagtaacggccaagtctggcctgtaaaaacacttgatctttgctccacttaagtctctctcgagaaaggtagcactgctctctcagtccactcttggtctccactcagtgaggaccagagtccgtactgatgacctggggacagagcagctgtgagctctgagtaaatgcctctctgcacctcctaccaaccctttgtttccttttccatcatcatatttgcttatctgaattttaaggcttctctcttttaaatctgcaaattttcagcgtgaccgaaatggattgctttgctcactgcatctgctttttgttcctcaggaagttcagcaggctggaaacaatgaccacttagtgtgcttatctgcttcgaagtaattgcaataccttatatttagacacaataaaaatacatgagagagctgggcataaattggacacaatgaatacttgttgcatgcgtaagtgggcaaagatgatagtataattttattcaaaattacaaatattgtctcttttcttttgaaacggactataatagaggtgtaaaggaccaattttaaatgtgctaagccttacaaatgccagtagaaagtttaatcatccagtgatatttataaaggaggaattgagaaatagacagaggtgctttgaatttagattttagactttgaaactgctacatgatttgaggcaaatgactcatcctacgtgtctctgttccctaatgtcaaatgaggaaatgtagttataatgaaaagttactctttatcacatgtgcaaaacttaactacaatgcatgtgcttaataaatgttagcaatgctcataattattatttatacaataaaatattggggaaaaggccacttagcaaaaatacaaattctagatttttcagtgaaatgaaatttcgtggcagttctgcaatatttctgtagggcactctgaatttctttctcctcaattaaaaaatatttactttaaaagttgctgggtgaaactgtagcataatacggattctgacatgctagagtatactgtaatactatagtaaataaaacagtgtaatagtggttaattaactgatagcaatcaattaaaaagaatagagagatcagaaatagactcacttagatctcagacaaaggagcaaacttaaaaagttaaaaaaagtgaaaattaagtaattaaatgaatgaaatattatgaaattaaaaagggttacttcactttcgaggctctgcatagagttatgtacaatattctgattttataagcaggaatctaagggtcatctaagtaaacatgtgactgatacacttattcccaactcatcataaaatgagaaaaataacagcaaccaaacaactccatgctttggtttaagttgtgagacaacgcgctctaaggttgggaacatgtcatgactttcagggagctgcacacaagttcctacacacctccccaccttctaacttatccacagttaccatgaagtgaatcatggaacttgcagctgagcgtcaggggcctgtggctaacattggactaagccatctccagatgatctagttaactccagtattgtcctcccctcataccacccttgctgatgccatcagaaatgccagagtccccttcggttatacaatgtttcaggaagaaaggaaatggcgggatagttagaagtaattatggatagacgtagaaagattcttgaagacagaatagtgtttttattctcactctgctcatacatttccattttcttcttttcccggaggagccatttccattgactgtgtcttcaacattcacctaaggacagttcagttcactcttagtccactgaacagaaatatttagagtgtgcttactatgtggcaggcctggttctgaaggccttacacgagtcatctcctttaatcctcacgtcaatcctatgagtaaagtactataatcaatccctttttagtgatgaaaacatgatcactaaataaagcagaggcccagagttataaagtgattttcacaaagttacagtctattcattggagacaccatgattccaaactactgggctcagaaagaacatgagctttaaatcagatatttcctccagcatttcatagggatattgattcaaattaaataaagctgcaaataatcacgttcatcaattaagtagtaaaagtgctatacagtgtcaccagtaagtactgacatatgcctaatattttaacaaggtaagggtggtcagtaaatggagttcttgctttagcaaacataaaataataataaatgtaatccaaacattgatctaggctgcgcgtagtggccaacatctgtaatcccagcactttaggaggctgagaccggaggatcacttaagcccaggagtttgagaccagcctgggcaacagggcaaggccctgtctctacaaaaaatacaaaaattagccaggcatggtggtgtgcacctgtaatcccagctacttgggaggaggctgagtcagaaggatcgtttgagcccaggaggtggcagtgaccgaagatcgcaccactgcactgcagcctgggtgacagaacgagactctgtctcaaaacaaaacaaaacaaaaattacctgaatctaaaatttgccagcctttgataaaatatttgaagcaatttcttctgtatgtgggtaaactgtcacagtagtgttcaaggcttctcaacatgtggggcaatacaatgtctgtactaactaggggacgcctcccaaatagactgttagtcatcatctacttttcaattagccaaccctggcaagtgtttttacatcagtgagatgtgattcaacggtactgtgatgatatcatagcttccactctcaaaatattctttcactaatttgtccttaggggctgtgtggagttgtaggaaggctgagaagtacataaagcgcatagctgatacatctttgccacagtttgtactgagatactcttaaatgttttcttacttttataagataaagtttaatttataaaaaaaggaatagtcatattctaattttctaaactagcaaaattgaggttctttgaataggtggtctaattacccaaatacattgatttcatttaatgtataaataaattaaataacaacaaataaattgaataattaaataaattaaagtaaaagtcggccccatgatttgactggttaatgcatgtttgtgtgtgagggtggggagtgctgacgggtttcatctttaccctggtactaaagtatctttttctctctaacacacatggcgacatcctctagcaaaactgtatcaatgggccgggcttggtggctcacacctgtaaccccagcactttgggaggccggggcaggcggatcacctgaggtcaggagtttgagaccagcgtgaccaacatggtgaaaccacgtctctacaaaaaatacaaaaaattagccgggcacggtaacaggcacctgtaatcccagctactcaggaggctgaagcaggagatcacttgaccctgggaggcggaggttgcagtgagccgggatcgtgccactgcactccagcatgggtgacagagcaagactctgtctcaaaaaaaaaaacaaaacaaaaaaacaaaaaacaaaaacaaaacaaacaaaaaactgtgtcaatgaagagaagattggcgcttcctttatgcaacacagtctgtaatttctatttcaatgtttcactgcaaggcatctagaaacttggcctagccaaggaggaagctcaggacctacctgaatgaataattgtatttacacataactttataatcttccaacctttggcttctatcctatcctaacaaaaatatataacaactgacagtgttcctaagtaccctttcgtggcaggcactgggctaagtattttttatagcaatgtaataaacaaataaaaccctataaggtaaatattatcgctattttagaatttgagaaaatgaggctcaataccattttttacacatttatttctctttggtttaaaaaaaagaggcagtttcagtgatctaaaaatatgatgaaagagagtctgtaacttgaatattttcaggcagaatttgaatctatgacttctatggcttcaagattaagcatgtttcactgtgaaaacacactccaatattattttaatcaagagctctcatttcactcccctgaatgacggtctttgtccagctcatgagacaggatgctgggcatctggtctcatcatcagcagagccgtcactcagcgatctgcctgctccgggtgagatctcagtcaacttcgcaatcatcctctgactcatctggagaggcctggggaagccactgcatccgggtctcctatcccagccgctaatgaccatggccctacaacattgtttctcctgactttacgttgttatgccccatacacctcagtgtcctgggggcaaaatccttcacagcccccttagtcgctatcctgcgatttcaccagcaccaccacaatttgtatacaccccactgaacttcaagttatgaccacatacccaaaagaagagactcagagaaacagactcaggaaagagactcgctgctttctgtggagcttgtcacttctaacgtgcctccttcgacctaagccaccagacatttatactttaacaataattttttttttttttgagacggagtctccctctgtcacccaggctggagtgcactggcgcgatatcggctcactacaaccttcacatcctgtgttctctcctgcctcagcctcccgagcatctgggataacaggcatgtcaccacacacagctaatttttgtatttttcgtagaggtggggtttcaccatgttggtcaggctggtctcgaacccctgacctcaaatgatctgcctgcctcggcctccagaagtgctgggattacaggcataagccaccacgcctggccacaacaatttctgagaatgaacttttctgaggcccatgtgccttttactataggctattctgagacctctggaccctaatatgcatggcaaaaatattattaggcattagtaatgtttctttggaaaaatgttaatattctaatggtactttgatctttatatcctaacaaaatgccattcaattatcaaaatagaagggtaaaaaaaagtgatcctgtttttttgtgtgattaacttggatatgacttctttatcatcaaaagtaacattaatattatattggtaaactcttaagaaggtttacaatattaaagttcttcttagtaataatcaggaatacatttattctagatgttgaatacaaatcaatacatagagataaatagataccaatagatagtcacccacactgtgtcaagtaatttgctatagtgagtaaaattggtcaggagtcaatgaatcaatactgttcatcaaatgcttgtcacgacaacaggcataatatgttctgggtatataaccaagtaggatgcaaggtcacttatcaatgagattatattctaggagaaaatgaaatatatatatgataatttttttttcaattattgtcagatgtccaagaaatgataaaatccgagtaatgtggaatataatgacttttgttaagagtgtgggataggctgacaattgtgggtgggctgacttagctgggtattgatacgaggagttgatactgaaattgctggtcaaattatggcagcaggcagccgcctggagattcatttatccattatacatatcgttactgagccctacaatgtccccagcacagttctacagtgaatagaacactaaaatccccacccttattccatgagagagacaataaacaaaataaataaatgtgtacatatatgtagttattaggtaataaaaagatataaagagaaaaatgaaacagaacgggaattagaaaatgtatgtgttgtgtgtgttatgcttgttatggtgtgtgtgttgtatgtgtgttttgtgtgtattgaatatagatgtgtgttggcgtcgtgtgtgtgtgtgttgtgtttgttatggtgtgtgtgttgtgtgtgttagggtatattatgtgctgtatgtgtgtttcgtgtatgttgaatatagatgtgtgttggcgtcttgtgtgtgtgtgtgtttgttatggtgtgtgcgtcgtgtgttggatataggggtgtgtgtgtgttgggtatgtgtgttgttagtgtgtgtgtgttgtgtgtgttggggtattatgtgttgtgtgtgtgttgggtatgtgtgttgtgttagtgtgtgtgtgttgtgtgtgttggagtgttatgtgttgtgtgtgttttgggtataggtgtgtttgctgtgtgtggcgtggtgtgtgtgtacatgctggagaggggctcacagatctcaccaacaaggtgaatgtgtccatagatggggcagggacctctgaaacccagggaggccatagctctgtcatggagtccaggaagagcctggtcatgctcaggggtccacacctcacttcctagacgtcggcttccaggagcacagcagcatgactgagcagacagacaggggtcactcaggctgaggattttcccaaactgacacccagaagactgatcaacagctctgcctgctgcacaccagggagtaactgtgtcaggcagacagctgcatacatgagtctgggaaagacggccaggccgaaaacaccatctgggaaagcatgtgcatagagacagtctttaagatcaggaggccgggtgagatccccaggttcaggttcagtggaaggccaggcccgagactccccaccctgcaaaactcaggagaaaaggaaggacccagccctgggcatgagagggaggctgggtgggtggacacagcagtggaggaggtgctccactgaactgctgtgggctttagagggaatgaaaggggagaacctggaggaagcaggtgccattctgcttcgaaagcaacaccaaaaaagaagtggaaagagcggtccaagcagaagtaacagaaagtgcagggagccaggggaacgcggcaaggaatgagccaggacatgaagcaataccggatcctaaagaccatagaaacctgctggattcattctgggtgtgaggggaaatcgcacatcattagcaccacgtgtagcttgccagttcagtatgtcaagaaaagtagtgaaaattgtatcctacctgagtttttaaagatgattaggacattagacgaagacatgaaagggaatttggaagagaaaaagtcacgtggaagaaagaacatcacaaaagaattggaggccctgcgtgtgtgtgtgtgtgtgtgtgtgtgtgtggttattgaagaagtgtagtacaaggatattgcaggagcacagggggacatatttccaaggacctcgaagacactgtctgaaaaccaggtttatcttatagatgcaataaacgctggaagactttggaacatgggcaaggatattaatccatctaaaattatagtgccgcgatgcagaatttgcaagctaatgccctttaccaaaaaacacttaatttcctgtaagaaatgacaaataaccacaaaaaaaaataatgactcaacgtgtcctgtatgctaaaactcacttttattaggtacactccaattaatcctcttggtagattgaatattaatataaaatcatgagaaatacaaatctggctttaccttatgataattagcgtttatcacagatacagaagagaacaataatataatatttgctaattgctttccaccaaataaaagaataatattattttgaaggatgatagtactagaggaaaatgttcacgtgtttcacaaaagcatccagaaaggaaatttaggtcgaaatatattaaaaataatgattagaaagattctagcaaattgtatttaaaagttactaaaacagcagtttggctggaaggaaggatgacagctaaaccctagtctgagcatattcaatacatgatgaactggattcagattataaatcaaccagcaaacacttttccaacttaaaatagcattatttgtttcatttcacagaaattaccattatattttttacaaggtatattcattgtactcatttgatatctttctaattattttctatctttgtaggaacaagacaaatcagaccttccaaaaactacacttgaagatatgggatagttttttccagtgttagaaatatgacttgtggaagacctaccatttgtatatttgcacacgtgcaaaaaaaagctgttaagattttcttatgggggacagggaatgagacatttcctacatatcagttaccttgaattttcacttgaagccatggttttcccagatacataatgaacgtatcttcttcggatgtcacatggttgatgttattccatatgcccttcaaacagacagttcaaaccataaaataggcaatttagacaggcacattgctcttcctgcaagtattctaataataataatatgcagtgcatgcaaaatatggtgccttccatctccgaagcacttcactaattacccaatgtgttcaccttggcttatctctttgacttgtcgtatactttcacatatcttcaaacgtgacttagttttcttctctgacataagctaccatggactgcttctgcacatctcttctctgtgaatataatgcaaatgcagtgaacccaacggatgtgacgaaagaaatgctaaagcaaatcaatataatcatttggtgtaattaaatgatctaatttaatccaattagtgtggtaattaatttgggcagatcaggaaaaaaatgagcgctttggaagattgaaacgtcatcattatataaccctgatgcacattaaagctcatccattttgcagataagacaacagtcagtaagggaagtccaattgtccattttaatcgttaaagtataggatcaagttataaactagatgtcaagaatatggaaataaggtcaacaggagtttctaaaatatatttcttctactctttatcatttgaattaaaatgtattcccatagtttaaattcccttatttctatattagtgtagctcatatgaactcccatgaaaatagatttatgaaagagaacactttatcagtcactttgccttccatatatgggccacgtggactatagagtttgggactgtagatcgtaggggccccaggatccagtaggtcatgggttctggtgaatgtggtcacattcctcttccattgagggcagacacaaggtagcagcttctcctgatgccatgaataactgcaggcccaatattgctaggtcatcaataatcagcataatcatcattcagtctaaattggcttttttgtttttgaaacttttcattcagtgaggctaaattatcaagtctgggcaaaacttatttctctccagaaaatggtagtcagtttcagtttcatgattctgtaattctgtaagcactctaatgaaaggatttaaccagaaaacattttcggttttctccttacacctttaaaatgtgttttaaataaaaccaggcttaagagatatgtactttttctgaattccctttgatcatctgagttcatcttgatatttaactcttggtctcttcgttatgtttatatcaaggctaattaattatcttgctgacttagtttgcttgtgtataaaatggaattctttaattgataagaaagcttcattgattagtttttaaagtttctgactttagttactcactaacaaagacttgctcatgtaagatgattttattacaagaatatagcagttcccccttctgactgctgctggaattgttttgactctgtgggcgccaaacatgaatcattcataatcctccagaggttcagagattgcctcatccaattacataggaatagaaagtaatttagttattttcttatataaaatttgatgaaaattcatgtgttacaatgcacttctaaaaagtagtgatggaaatgctaaaatttatacttccttttttaggtctgccatcatctccaggttgtttctcattcactatttgaggtaaaagaatgtgctctctagccattacgcaaagtgagtttttccctttagtgaatcaattatattctttaattgtatgctgaaaccacttgaaaagcattttacttctatggttacaattcaatttaaccacctgtaatccaatcaggctatacattgttttatgtattttaatagatcctttttttctgtttatttaaaaaattatatgatataaacggtatgatgaataattgatgaaacatcttgttttgcttctagttcccagtgatgctgttctcaaatctatctagacagcagtccccttcacagcaatattttccatagcacttgaaaagatattttagcttctgcagtgacaaacgcctgtttagaaagtggaagcataatttacttacctgactgatgaagcattttttacaatctactacatttgttttatatggagatgggtctttgctaagaaaacagggtctttaacaattgcaaaactccattattacattttatgatggagcaaactagattagagcaattctccttcttgttttattaagcctttatactactgttagaggttaatggcgctattatttttcctaccgtcaaaatctgctttaaagcaagacctacagcacttagtgctagaaatctggcacacggattagcaggcatgcctgcttctgcagcagtgttagaaatcactctggcctactaccattcagataaatcacacgttcctaatacagcactcgcgtccctaaaagcaagacctgatgatgagaggcatttctggcaatctagtaacacgcctggtattccttaataatattattgtgaagcaaaatgtgtttctcacagatgagtaaagaggatcatgttcattactgaagattatccatatgcggactaatagagtgaaaatgtatctggttatctggaaaattatggcctgatgaaaatgtccgtgggaaaatgatttctgaaataaagtttctgagcttgaaactacataagcatcatttgcaattgattggattaggggacatgtcacaacttccattctgtggtatcctgtgttctaagtcaggcatccaggctgatgaaggtcctcactccattctcctttcctttcatcccaccctccttgtacccacatcccacctcaagctctggatctagcgaagcactctgcagaaaggcagcatgcattcgctgaaattcttcaaatgaccttcctaaaagcaagcatgtctcagccattgactcagtaacaaatgaactccttcagcagtgggatggaggaaaattagtacattacactgtgttttctgactgactagagcacacaatgtagactgacaattagtttttattaccagctgctatcaccttgtgacagaaacttgaaaaatttctcataattttcctgtttccttccatgcagtggatatcatgattctgaaactagtgtgttttactgacatggatgaattatttaattatttgtgcttttctccatacaacacataacattttgataatgggcacagttttctcttagccagtacctagcaagtctacagataagacatttcagccacggaggaagtcctttaaagaggacttggtggcgcctcacatggccctgctttcctacggctttccatcctctatttctatggatttctatattttatgggttgatctactaatattttgaaagatagtgaatttccatttttactcaatcatcagtaaatgttactaccgttatgacagcactctgtgtgacaaatatttactggtgatctgaaacactataagactataatttcccctggagaaggaacagatgctgatcatctttatgacagcttctggatgctccgcaacgagggactgttgaatgtgtgagtgaagatgtgaaatataaaaatctaattgaagaaaaacatgagcaccctcttcccacacgacacaccatcccataactacatccctgggttatatcccatagctacatccctgggttatatcccataactacatccctgggttatatcccataactacatccctgggttatatcccataactacatccctgggttattcaattcaccacctgagcatctgttgtgttcctgagactcttataaattcttagtagagatcagagaacaaagtagaaaatatgcctgtcctcataagaatgatacaaagggctctgtggacgttgggggaagagtgggagtggggcgagggataaaagacaacaaatatggtgcagcgtatactgctcaggtaatgggtgcaccaacatctcacaaatcaccactgaagagcttactcatgtaaccatataccacctgtaccccaataacttatggaaaaaatacgaaaaataattttttacaaaagaaaatatacctgccctcatgtagttcagtttatattctactgggagatgtgagagaaatgaaatgaacagggttactttatgtgtgtgtttatgatacacactcaaataaacatacacgtatatgtatatgtaatatgttataataacttaaaaaacacaaaaacagagcaagtaacagaagaagatagaaggtgtggatgctcaagtcaacagccataccaccctgaatgcacctgatctcggaacctaagcagggtcggggctggttagtacttggatgggagaagttgtggatgctcaagatacatgatatttagttagggtgatcagtgacagctgccagagaaagcgaattttaagaaacgatgtgagggagggaggatgtgatacggcttctttgggacattatttcaggctgaggagagaggagagcaaagtccctggggtgttgagtgtccaatgtcctcaagaaacagcccagaaaccaagaggaccaggatgcaagggtgggagcaaaggagttctttgggtcttcataaggaatttggactcgttctgcctgtgacgggaaacgtttgagggtctggagaagaggaaggatgtggttctactgatatttcacccagatccttctgattgcagggtgggactttgtcagggcagggagaggctgaggatgacatgatgatacaggtgaggggcgacggtggtttgggggtaacgagaaaggcttgggatatgtcggggggcagtcagggctcaccaagaggccggagagaggggtgctgtgaaggtctagggactgaatggtggaagtcacagacttcttctgtgagaggtaagagggagagagatgcctgttagacatcaacgtgactcccaagtaagcccgtggataggaagttctggcccgtagaagagaaatgcaggttaagccacgtaatccacctcagtccattctggaattggatcatctcgggacaactttccgaagatgaatatgagtgagctggttttcttctctctttatttctcatggtagccctattcatgataattcatgacttctctttttctttgtctcagcttctacagatcccagagagagaacagttgcgaaagtctgtccccgggctgaaccgaagctgctgctggcggttatggtgctaaactcagaggctgacatgagggcaaaagactcttcaggatataggattaaaccttattttttttttttagcatattggaatttaacgattaagagaagattacccactagtgtattttatttgttcataaattattccaaacttaagacaactaaaactacgaatattataattataagtagataaatacaagtggaaaattattttctgaagtatattttgcaaaatggttcaatcagtcagggtatttacaaaagacaatccaaacactctacagttataattacatcattaagtatatacagtaattgagacatcactttatgtggccttctaaaaacagagatacaagttttaaaatctgcccttccaaattatgcctgagccacaacaaaagccagagggagatggaaccactgtgtgtcgttatgaaggacaagagtccatcagttgcttttcattaactgaactgtctctttggaaactaggggcgaatatcattctgttttgcttcaggtctcttttttttttcttttcagggtaagaaaacattgattgcccaatacaaacaaagagcaaggaagtgaacgtttatggttaaatacaggagaattccaggggcatttattttataatgttgtgttgttatttttcccaggggcataaaggcaatgcattagagtgctcagttttccacatttaaaaaatcatctttttattaaataatggttctggattaattgccccatcctgcatggctacaaagtgttgtaactgcaaatgctcctccgtacacagcatgtcccatcagctcatctgagtgagctacaacaaatcaatatcgaattgggcaagtcatttgtctttaactttacatgtggggaaaatctctacttcaaaataacaaccaatgttttgtttatctttcttcctagagatgtatatattttggagttagaagggcatccacagattatctactttagtaatcctcacattgagagctgctaaaactggtttctgccaagaagaatgctcagaagaagaagaagaaatgacaggtactgttaccatcattaaaaaatagagtgctggccaggtgcggtggctcatgcctgtaatcccagcactttgggaggccgaggcaggcagatcgcctgaggtcaggaattcaagatcagcttttccaacatggtgaaaccccatatctactaaaaaatagaaaaattagccgggcatcgtggtgcatgcctgtaatcccagctactcaggaggctgaggcaggagaatcgctggaacctgggaggtgcaggttgcagttagctgagatcgcaccacactccagcctgggtgacagaacgagactctgtctcaataacaaacaaatatatacagtgtcagtttaataatttctttggtattgaaataatctactttcagaataaagagcagttcaccatttcagggtgagaaagaaaatgggggatgggtgcttgctcagtttattccagatgcccttttggagacataatattgcccatttacattgcactttttccaagaataaaataattcaaaatttagagcatataaaccacgtaattataaaatacttagatatttaagatattaatgactatcttaatatctttgggtttttcttcaaacattactgattacaagctggtgaaaaaggaaattctaaatcttctcattctacacttaatgttgagagtcgccctcaccgcacagaagagttgaaatatctctaaagactacagtcgcgctgccctatgtggttaggttttgtgcatgttaatgatgaaatgaattgtggagggttgaaagcaaggctgtgtaaagaagctgatgaacgtgggttcccaaagcaaaattcacaaaagactcatcagattaggaggcataaatgaaagaatctatagggcttttgttccaaagcacagagattcctttctcccttttcattcattcattcattcattcattcattcattcattcattcatcagtagatactggttgtgtactggtagcttgggctgtcaggggatgaggaggtatggtgtgtgatctgtgggtcatggatgggaaaaccccaaactttcaaggggctcatcttgaactaaaggtacaatcaaggtaggtctggtagaaaaatttcactggcctagcaggaagaagcagaggaagagatgagcctgcaggatgtgcacgacttccaaacacaggcactttcatctttcaagtgaaaaaagcaggagtttgttttaaatctatggccagctattacatacctgtataaacttaactctcagctgggcatggtggctcatgactgtaatcccagcacttaaggaggccaaggcaggaagatcacctgaggtcaggagtttgagaccagcctggccaatggtgaaaccccatctctactgaaaatacaaaaaaattagtcggacatggtggcacacacctgtactccctgctatttgggaggctgagacaggagaatcacatgaacccgggaggtagaggtttcagtgagctgagatcctgccactgcactccaacctgggtgtcagagtgaaactccatctcaaaaaacaaaaacaaaaaaacttagctctcttaagtcttataattagagcagtcctccatcactgtggcagaagaaaaaaaccagtcagttagacagtgaaggctggttgttggagatgcagccggcctgaaaaatcacagctacaggcaaaaatagagcagcctgggaaaagtcagtctgcacctggacagatgagcaagcaggattcagcacagaagccttctgttctttgcgtgattagcgagctcccaggaaaaatttcctccctttttcaggcatatacccagtgggctccataggaactcacacagggaggagggggccttcctaaaacaaatccacagttatacaaacaagagaagtggtactttgtacttgcctagggacataaccacaacaacataaataaggggtagttatgcagacagctttacagattagaaaagtgactcaaacagctagagagataagaggagtttctcataaaagctttgtaattcagctgtcaaagcagcaacccatttgagatcccctctgccttgtgaaaagctttcttctctcgcttattaaactttcactccaacctcaccctttgtggccacgccccttaattttcttggtcatgagacaataagcttggataacaccttagacaaccagaccactgaccttgatctgtttaattatcaaactgcaagtttcctgaggctgtcagggaaattctcccattccttgtcatgatctctctctttttcttcctgcacttgctgaactcttgctgatgccctgacagtgagcagaggggagggtaataatgaacaggactttgggtggatctgatatagtcagagggcatggatttcttgctttgcccagtgtttgtttttacttttattttttaacatctagaactttgggtagaacttgccctctcgaattcaccaaaaccttgaacattttctatcaccatgacagggtcccaccaggaaacagatgtcatttggagaagaagccagtcaggcaaggctactttcaaaggctctgtttgcaaaagggtgaatctggggacaccaccagggacagggcagtggcaggggaaggagtcgccactgagctgtggctgctttctgcactgaaggcaacaaggggcacaagttggtgctgaaatccagagggacatgaacgcacaaggtcaccctctgcaaagagctgtgacctctgatttttgtgccttggagcagagacagcttcagggggctgcaggaggcagctcagccttccatccataccctggtgcttcccacgggcagaatacaggagctgctagcagtgtccacccctgtctggctttggtgaagccagcactggatgaaaacttcttaacggggacagcctcacactctacagtgaacagataattccctggccactgctgtcacttcttttactcccaggggagtcttctgaaaaagaacgatcataaacaaacaaaaatgtccagcttacagaataaaaaatactaagatggaagcaaacagagggggctgtggaacaagagctaacagtgcctgcagaccctgagctagacattttccataaatcttctgtcatatccgcaacaaaacccttagttggggaaaggattatatcacttctgcaagagaggtttgtgtgcttggatctaatctctagaatctcaagaactgtggtctcccagaggaacccagatcttggggtgaagcagaagtggagagactcaagttaatggaatggcttgaaaaggaatgaggcctccactgaaggcaccagcacttcactccctgcagacagaagatgaaatcctcatgtcagcaataggcatgtgggcagccagtgtcaccttgggtatcaagaacgtaaagcactttcatactcagtctcctacagatggtaaaggattcatgaggtgctgaagaggaaacggggctcatggtgggaacgcctaaggcacgcatgacgcgctggaacgtggcctggcctgtgcctacctcccctaccgttcgccccgtgtggttcacttccctccatttactatggaaggctcctaaggtgaacagaatgcccactgcatgccacactctgcaacaggcagtttacacccctcttgatttatcggagtgacaaccctatggaaaggattactattttattaataattgtgtaagcgatgacatttgaacttgaataaggcatatacttgcacagctattgaatgcttgcctgtcgcttcaaaccctatgtcctttcatcagtgaaacaatttcattttctctgtcatacctttctttggaatgacacattaccattgattaccttcctcatcttagaaggctcaaggtttccattcctcattttccctaatgattaattcccatgcttgacaaatactttaataccgttaaaagaaaggacagaacgctaataccaaatgagtcattatgcatatgtcaatttgtgttcagatgaggacagaagagatattctccttattacaaaagaaaaaaagctctgcctcaatcttacagtagcagaaaaatctgatgcccaaatgatcggatatccaacctgatattgatttaatgtaagagtttggccggatatgtggttctacattgaactttagatcatttgtgcagggttttatcataaaaatcattttcaaactactgtaaatactatatctccctctacagaacattctatactaaaagctaacaatatcaaaatgttaaaattttatttttaaaaaaccctttattccttctactgtttctcagatttttttcccttcagttttcccatccttttccaatctaatttcattaaagggtgactggctgtgattattcaatagaaagtgccatgcaaacatttacagattgattttttttttcttttggaagtgggagacacctaagaccagaggggtagtcagagtatggtagctcctctctgcctctgaggcccaggggacatgtttacctctctgtcctctcaacctgcgcaggactgagcacagactatggattattgtcacacaagcaattgtcaggaaatcctaaagtgataaagatgtaggtcaatctatagtatcgttgtcaaaagattgtgattgtttcttttattagttttagcagaatatttgttgcatataaaacctcatgcagaagtctgctctagcatgcagatgtaaacagaattgacccgagagggttcagatgtccatcccagcccttccactaattgctaggcaacggaaaaacaatatgcacagatgcaaaacaccggggacaggcgcacccacagagcaaggctagaaacatcacatgaaaagattgccagggaagcatagaaaacacaacccaatgggtagaaagtcctagaagaagcgtgagcagaaaacggcccctacaggaagtcaacccacttggtatctcagtagacggtactcatctctcgtttgtaagaaaagcaaaccctcagtgaagctggtacccagtaactgttatgacatgtgtaaggtcgtgtggggagcaaaaccagtggagagctgactgcacctgcagagaaagaagggtctgcatagtgagtctccaaggagcacataggctgttggctttcagctaaaggacaaagggcccttctggcagagaagcaccatgacccagtccaggcatggtcagggcttcctatggctgagtgatgacgatgggcatttaggagaaggcaccaaaatggcaggtgtgggagacaccttcattcctcccacagctattgatctggtatctaccaggtcctgggcacgtgcaaaagtcatcagccagacatgtctgcagatcttgttttctctttggaaggacgtagacattgcccgaaagctactttactctccaggcagtgaatggtcaataatatttcaatagacaaaagacaaaaaccaacttctcctttgcagagatcagtctggtctggtgtgtgtggggtgtgcaaggacggagagagactggtatgaaaatgactgaccgtgtcacatatacttaagagagacatctggagggtccagtctcagacagtgatcagggcagacgtgacacatggttaggagttagaaccaccacgacattcctccgtaacaaagtgaagttagtgcatgttctttctcccagaaaatacttttggatatagaaaagaaggaagagataacgtggggaaggtggtgggtgggatcgcttcttaactgctccattctctcctctgcttacaagggcgtatcaatcctcagatagaaaggaaagggactcacagacagagtttttatggcttccatccttgctgggcagcatcttgactcctcttgacttcaactcaatcgcctttttcactggaagaaacaaaaccaagccattagcaggtaagacttggagatcataaaaccatgttgtatccacacagcacttccagtcataactgctttctatcaacccccgaaaatgggaaatgttctaagaggtgaatgataccaagtcaatgaagtcaaagagcttgtaaataattattgtgaggctatcaagcagcaagatcacatcttacagcatcagtgtcggaagctaaaaataatacgtgctgccactgactttacacatccaatcctatttaccactaggagtggcagattccaccaatcattatcattccccaaattgttcaggcagatcactcacttcatgtatctatcctgactacagagttgtctaagtttgctataatcatgaaaaaaagtttagataaaaaggccagttgctcattcatgtattcatatattcatttactcacagtttagcgaatctgtgtgggtggggagcaagtagaggaaaggcatgctctacgtgctgtagataaagtgctagacaccaccagtccctccagacgctttccaggctgtgcaaaaggcacagaggtcctggcttctagcatcatcattctgagagttaaatatgtttcttgatgtactacggcctgcattaaacattttaagaagtttcattttttttttttggtcacttacggaaaaaaaatgggggatgcatcttgtgattatagaatataaaatgttatgatcttctaagctatcccacacttggctttactaagtgcccagtggaaacatttctgaggtccccatatgagactggacctacagcagctgcgagcaggcagatcggctccaaatctttgcttacaacagggtggccccatgacctaggtaagttacttgcctctgagcctgtgactctatgtgtaaatagctgtgagggttagttttatgtgtgaacctgactgcaccacaaggtgctcagacattgggccagaggagattctgggggtgtctgtgagaatgtcatggatgatattaacatttgaatcagctgactcaggaaagaagatggctctccccagtgtgggtgggcctggtccagtcagatgaaggcccaaatagaacaaaaggctgatctgccccagtagaggcaagacttcctcctgcctgatgggctttaaattgcagcagcatgtttttttttttttttttttttttttttttccctgctttctgctttctgactggagctaaaacaccggctttcctggtctccaacttgctgacttacccctttcaggtcttcggtcttgtcagcttcataatcatgtgagtcagttccttatagtaaatctgtgtgtgtacgtgtgtgtgtgtgtgtgtacacatgcacataaggagattcatatagatatgaagtatatacaggagacccctgaagcatacaaggggttggggcactgaccaacccccaacccccacacacagctgaaaacctgattatatcttttggctcccccaaaaacctaaatgaaaatagcccactcttgaccagatgccttaccaataacataaacagttacttaacatatagactcatatctacatatattttacgcattcatgacacacctttttggatttttttcctgatatttttaggctataagagttgtctgcaagttttttgtttttaattgtcgcaaatttccaaaaaatgcttctatacattcattgaacagagtctaaaaataagtggatccatgcagtttaaacctatgctgctcaagggttaactgtataaataaatctatctatacacactcaggcacacacacatacccacgaccaactggctttgtttctctggagaactctgacgaaatacaatgccaggatgccaagactgtgtaaggctggagacgatcaatgcaccatctttagtatggtgtcctgagcccagccaactcagtaaccgactgtgtgtggcagtgattgttactcttttcaaatcactgacattcagagggctgggcttaggtggacaattgccctttgggactgtcttccctcactgatgtcactaagcacctgcttcctctctggtcttcctgtgcttggcccctgtgtattctgacacacctggagaccatgcctcttggactctacccctcagagtccctgaaaccatgtgttagcctctttgcagcgacactgtgcagtatttttcacttcaggaggcatcctccaaccttccaaaagccatctgagataggaattatgacaccgccagctcatatcaggaagcaaggctcacagatgcacagggaagactatgcagaatttgaactgaaatcttccagccccaaactccaaacctttccacgtgggctactggctggggagcatggagacaggagggcagggctgcaggagctggtccacctggaaggaggagggtgagatcccgaagcaatgccgccagctgtgcttctgtatcatgccttgaccttggacttcccagtatcaagagcggtgagaaacacatattatgtctaaactgccaagtctgagatattttcctatagcaaatgtttgctatatttcctatagcaatattttccccaaaagacagcacttctcctgggtattttaaaagggtaagagggagaaacgagagactggaaggaacatacaaactttgaggagcttttcccaacagtgtagcttagcaatgaagaaataagtccaatgtggttacatggctggaaaaaactgttgtcatcagagccatgaatagaccacagggatcctggcattgactcttgtggaagacgaggaggtgggccacccagatccccctccaaggaagggctggccagagggtggctgttcatcttcagcccgtttcagagaaagcccagagacagacagtcacctatcccaggctcacaacgtccagcccaggtccaaccccaaccaaagggcgctggttcatgaacgtcctgcactacggaactctcagagagggacttgctctggtgcaaccacggcacctggcgtcttcctcctcttctcttctgcctcttcatgtgtgtgttttctcatcctcatctctgtgttgtggtgacaaatatcacaggaaagggaacacgagatggggtatctgcttccacttctgcggttctcctggtggcacactcagaagtcctctgccagctctccccaggataatgctttcatccaaaatggcaaacgtatcacccccactatcttgtgctgaaataactttatcttgaagttactcaggagagaggagatgaatgcacaataaataacaaataagaaaatcaatgggaaataataaagagcatagaactcaacgcaaatgtcactcaccctaaacagataagacaaacagagatctgtttactcagaatctaaacagaaaattcgagtagtctctcagggacgatcaaggtatgcgaatagacaggacctatctgaaagctggatgagctaataaatttcgtactcttgcaaacaagtgtttgatgctctgtaaagctacgtctccactagggaatatatgtatttatttattatttttcaacaagacagtgttatactgatgtagactatctgctctcctgagttgtaatttgtttcaagttactacgttctcttattggacagctctgctaatcttggcaacgttgtacaaaaagggaaggtgacttgtgggtccagggtccacccggtgtctggacacttctccccacacgttttttgggttctcctcttttcttccttccacacccttccctcgcctcttcctccctccaactgccctcagagctgagcagagattttcatttgcaaagaaacaggagagagagagagagagagagagagacagacagacagacagacagacagacagacagacagacagacagagagagagagaaactagagctgcaggaatgcaggagaaaggtaagtcacctatggcaaatccctgcaatagcctcttctttctcctgaattaaactattgagtcattcattctcagatcttcgaatgaatgataaaaatatttcgtgattgatgacaaaacatagcttttgtgtctaatctcagacctgctaagtcacaatcttcggaggtgagcttggtttagctttgttagtccagttatctagttttcatatgagtttctgttttgttttattgtgtggaagataacttcaatgcacgccaaagttagtctcacattccctggtgtctgttgggtaaggtgattccttagtaattcagattcaacaatttcaaatacattgtggtctacagaggccagggctgggggacctggggagatgctggtcaaaagatggacaatttcagtttgacagaaggaataagttcaagagatccctgatacatcattgtgactgtagttaataacaatgtattgtgtgcttcaaaggtgctgagagttgactttaggttttctcatcgcaaaccaagaagtatgtgaggttaaaaaaaaaattccccaaaagcaacaaacaaaaacttgaaataaatatgacgaatctcttttctgataacaacatttaggaagataaattatgggggaaatatttttagtttaagggctgaaaaatcaaaaaccaccacaataaatatacctaagggatacattaattttgttgtgtcatttactttagttttccttttttctcctacatcagctgccttcactataatctctaagtggttaggttaaaactcactttctgtaggttgtttgaaaatgtgacgaaaccattactatatttgaatggcagtggattcttattactgtttttaaaatggcaataatgtaagaagtgaatacaactattgctacttgatgccacttctttctctgccctctctagctggagcgtcctgccctcctctgtagcccctgggaaagctcagcctgctcccctgtccctccctgtaatccctctgccccagcccccacagccagacatctgccttcctcaagatccactgaacttccaagacctctcttaggaaaccaagtcgtatcttctgctcttaatacacccgtaccgtccttcattagataatatgactcactgtctgaaagaagctttacctataaagggagatcagataaccccaaacaaataaataaaatgcaaaattctttcaaacaaatgtaacgtactcaatatgaggagatgccattgcaaatcctcacaaatcacagaggaaattgttttgtgtatagagaccaactacttgcaaatttgaagaattcagagtttgggagaaatgggtgaaaaatataaatcttgtgtcttcaacttttcattaacttgcatgtttactgtaattttatcaatgcctcttccaggcaaaaagttttatttaagtactgcaccaaaagaatatttactactattggtagcaataatattgaaatctttgtaaatccttagaattgcaagggctcactatgcagatagatagatagatagatagatagatagatagatgtccacatacacacatatgtatataatcatgtatatatataaatgtataaaatataagtatataacatataagtttatacgtatttagaaagttaataacatattacatattatatatgtatataataagctccatatataacatataaatgaatctattaagctcccaatgtcagacatactattgttctctaatttaatttgtcttacaattatttaatcaatagatttctgttaaatttgagaagtaatcacattccataagctactaatcttttatatttaccttttctttttatagtatcacagcaaatggaatttccaattccatcatatatattaacttacatttgggaaaacagtgtatttagacttttttgaccaggcatggtggttcacatctgtaatcccagcactttgggaggctgagacaggggatcacatgaagttaggagttcaacagcagcctggccaacatggcgaaaccccatctctatcccaaaaaaaaaaaaaaaaaaaattagccccagccaggcatggtggcgggcgactgtagtcccagctagttgggaggctgaggaactagaattgcttgaaccccggaggcagagtttgcagtgagccgaaacggtgccactgtactccagcctgggccacacagtgagaccctttagtttctcaaaaaaacaacaacacaagaatttttttaatggcttattggttatttggagcattttttgtctagtttatgattgcaagataaaaattaaactgttcttgaattatctcagagctttatcaattttttaagtgaaacatgttttgaacacaacacacctggagaaatctcaatggtttacattgtttcgcttttactctaggactctctttttctaggagcatttacactataataaattattttctaatattagaatttagaattgctttcaaaatgtttaacttattcattaatagacacaattacataatccccttcccctccaaattttaacatttcttcattagatttttttgtgttttacactgaggaagagtcatcgaaattcagatcaccttatattttaaacacacatttaattattttttgcaaattattcatcaaagtacctgtatagttaaacaccctaagacccattaaatttctaagtaagcgttgagccaatttcctattctctgctaattattgttaacgtgtgatttgtgctgatacactgtaaacatcagtaggagctatgtctctactgtggttgttttcctgaaggatggaaccatttcacagtctaaaacctgagcctccaggtctgccctaaagctcatcaccttgaaaatgtggttccgtcatttttctcctcttctgcatgatcattttttcttttctgcatgattaacccaattataaaaatgtgttgttccatttcccatctttacaaactaagacaaagcaagcaaccttttttatttagttttagctttttgagacagagtctcactctgtcatccacgctggagtgcagtgacacaatctggactcactgcaacctccacctcccgggttcaagtgattctcctgccttggcctcctgagtagccgggattacaggcacctgccaccaaacccacctattttttgtatttttagtagagacacggtttcaccatgttggccaaactggtctcaaactcccgacctcatgtgatcctcccgccctggcctcccaaagtgctgggattgcaggcatgagccacagcgcccggcctgcaaacagctttttaaaaggcacacggcctgcagacagacaggaatctttccctccacattcctctgcagctgctgcagcccctactccctgtggacatgatggaggaaacccctcagatgaacggttctctttgcatctcttcccattctctcttaaatctcatcagctgtaatttctctgttgctaaatattttggtcgaatgtccaccctcctgttcactctgaaacaatcagccacttcctcctgaaagcactttctgccctttgcttccagaactccaccctgtttgggttccttctaattcactggccgctccttgttcacagggatgggtgttgcctatggcactttactatttattgccatactgtggctggaaagtggtcctgatccagaccccaagagagtgttcttgaatctcatgcaaaacagaattcagtgggagtccacagactaaagtgaaagcaagtttattgagaaaatagaggaataaaagaagggctactccatagacagaacagtcttgaaggccgctggttgcccatttttatggttatttcttgatgatatgctaaacaaggggtggattattcatgcctcccttttttagaccatatagagtaactttgtgatgctgcattcgtaaactgtaaactgtcatggtgctgatgtgagtgcagcagtgaggatggccagagtcactctcgtccccgtcttggtttcgggagatttgcgccggcttctttactgcaacctatttcatcaggaaggactttatggcctgtgtcttgtgctaacctcctctctcatcctgtgactaagagttccttaacctcctgggaatgcagcccagcaggcctcagccttactttctccagcccctattcaagatggagttgctctggttcaaacgcctcttgacaatatggttcaactttccatttaactctgttggtcacttatccgatggaagtatggtagtcatctaataaaacattatcatcatcggaattatcaagagtaatagttttaaaaaatattttgtacatggtactaaaatgctggagtacatcctatttaattccaccaaaatgttataagatttatgctactcctacaatcatttacaaaaaaataaaaaattgaggtacaaagaacttaaaaaataaaggtcacaaagcttgaaatggtagaagcagggtttgctgtggtgaagtctgatactagaacctgctggctttaccatatctcaacagtctgcttcagaaattatagccctgactttaaccacaccttacacttaaaatttttattttcgtcgataattattacattttttcattgataattattacatttcaaaattatattagtaaacgtacctttccattatgctacattttttaaattcagattttgattaatcaactctttcaacgcttatctcagaagtattttaatgaacttgtatgtcagttgtttaaatatgattaaacatctattaatattagtcccactataataaaagatatacactgagtcacacagtattaattttgtttttcttttccatgaaatgctttttttatcatttattgtaactgtgaaatattcatgaagatattgttgtaggacgttccccttagttcagctaaaaacagggtccttgtcacatggccatgaaagattaggttcacaggttattgcagaatatttgagaaaatttttaaataatcaagaagaaaatgtaactgtgtaaacccatcaccacagacaaccactgttagaacgtttatgtatttattattaatgctatgtgcattgtatatataagttgataggtgaagacacttaatattggtagaataaaaataaagttgttaatatttattattctgcctttatgacctctttgaacagttttcctaaggtatttttaatagattattcataatgtatttaattcctttatcattagaaattagtttttctcacttactacaattgtacattacaccaatcacctatcaaattctgctcagtttccaagaataatttgctagaactagaattctttagtcaaggctgttaatctactaggctaaactgatttctagaactataggaccagtttacttcacctgatgtaaataagaatatcttaactaaagcctctctgcccacattgttttagtacataaaagaaaatgttcagtaatttggtggttgaaaaatgctatcttatttttattaacatttaaaataatgcgctattggatcattctttgggataaatctattattgtctcatggtctgtacattacgagaagcgagttgttagtacaataactctttctttttttaaagtctggaaacagttgttgtcttcacaaggttattttgactgcagctcccattgtcagcttacaaatattcaggcattcctgcattttttttattggatttttgatgtccttgaatagggacttttgagaaaaactgacaaccaagttttaagaactacattatcaaattttatttctacccttaaatcagtcagtgtcctttccttggtcaggaaaatcatcctctgaaagcctgatgttataagtcatcttttgcaccaggaaagacagaggtacttacttacaatgtgaaccatttgtactgttgatattcctgattggttatcagaatcttttaatttaatgtcgcttaatagcagcactaaattaaaagataaatgtctcatatatgaagttatagtattacatgaatcattgtgtcaaggtagtatggaggattagcgtgagaatgtccacaaaaccttgatgactgaactctttactaatgtaaagggtaattagcataagatgctttactggaagaaaggcaattaactattcatctcacgtttccttaccaaatcagggaccccatttaaatcacgtatttccctgtgatttaagttttcagacataagcaggatttaacttggaagcaggtggaatttaaagattgttttacttagtcttgtagtgatctatcggtttacaccaccggagccaatttaaaccttttccctccaaacagagggagaatagaaggagcgagaagataagaaagcgcaaagggggaggcagaacaaggggtgagacaacgcgctcagaaacaacattcttcctgcactctacgtattgagatgtagaaaaccctcctgaggtggaaaacagaggtgtctcagacgattcgcaaattccaagaaagattttgtgtcctgttctattaactcgttcttcttttctatacttcgttgcattaaagtctttgccactataatttcccaaatttcctactgggattatcaaaagccttccaaggtgttcaccttgcaaggtgaacaacgtttttacaaaaaccccagtttcagcaaaaaggccactgccctagaggcccagatagctgagctccaatctcacccctgaaatgttctgaaatcctgagccacagcctcggattttttcatctgttaaaagaagggcttgaattaactaccctaaaagtctagtttctcattctttttccaggcacataatgcagaatctcaagaaaagtgggtggtatttaactcagaacaaagttcccattttccctggaccattcattacaatgaagactttgggaaaattaacttcagtgacttcttttgacatgtaagagcaataatacatctcttgcaagagtgctgtgatgaacgaaaaagatgctctatgcacagaggaaagtgcactctgggtagggcggtcagatgagcttggggaagtccaggggtgtcattcacatagaacacactgtagcccccataccagccacatattatgtacaaatatatactggctgctttccattcctcctgtgtggaaggcatttccagttctacgtgtgtccagcttttggatctttaacaggaaaaatctccctcacagtggggattttgaagttagttgtaagaaagacttaatcattgttctggaactcattagagatgtcaccttgccaggttaaaaatgcctctaaatcgcagattcctcgtgtgtttaataaagatgatcaccacctgaccctcagagctgtggtgaagattacatgacatggcaaatagaagcacctagtgcaatgtctagcctgtgtggttacacaaagtgcatggaaaatacttctcagaaaatgaagaactttccaagtctttgttacattcaacgtggaatgttaatgcaactctttattcagcttttcccgttaaacttcaccgcacacaggaagctggggatgaacctctccactccccaagtaagacgtccatggagttggaaacatgccacgtcatcttcacttccaatggagaaattggcacatcttaccatttaatcaatcaatagagcttacagaagaaaaaagaaaggggagagagaggagaagctactggaaagtgactttggcaactcctgatactgcttctgccttttctatctatgggaataataaaagctgtccaggcacaacaacctcactgtaaactatttcctttaagcacttcaacagaatacatgtgtcctttcagatctgtgaacaacacattcaacaataaccacttcctttctgctgccatagaccttttgttgtctcaacactgggggctaaccttcttaaacaggggtgacacttcacagtaggagaaacctcacagcattggtggtcaaagtctttattcttacacacacacacacacacacacacacacacacacaccagcacatttctccttcatgacccatgggaagcttaaatgatacctagttccaggcatgtactctaagccctgggagattcattttacagagcaaagctgtaacaccttcagatgctgacacgatccaaaacagcttcaggagatgtgaacatctaacgtttgagactttttttttcgagagtctcgctctgttgcccaggttgaagtgcaatggcgtgatctcggctcactgcatgcaacctccgcttcccgggttcaagtgtttctcctgcctcagcctcccaactagctgggattacaggcacccaccactacacccggctaatttattttttttgtatttttagtacagacggggtttcaccatgttagtcacgctggtctcaaactcccgaccttgggtgatctgcccgcctcggcctcccaaagtgctgggattacaggtgtgagccaccatgcccggccagttgcgacttttgcataatgggaagatcaggtggtcctgaaacaccatttttttttctccagcctctgcgtgattttcaaaggaatgcaattttatttgtgaaactcctaaatccaatcattttttttccttttataagcagcaatgcccctcaaggatctgagatgagtggccacatattcgggtgtgtaagtgagtgtgtgtggctgtggatttttactagtgacggcagatgaaagtgaatcatcaacgtctctagcccaggtttttaggatcagtcccatgtttctgattcctcagaaaacatcaaacagttagctggcacatatgggactgagtccattagtttaacatcggtcactaagatagcaaggtaacttacagcattctagagcatggcacaaagagaaacatattcttaggatttttaaattattaaattccagtggtatttcaggttcaaacttattttctcctttctcagtcctaccttaattattcttattttgcaaatacctttattttgctgttttcctcctcatggttttggaagagcttctttaatttcattaaataacatgttaaatgaaagttaatggggtgaaaaataaaggaacagaattctaaattctttacatgaggataatagaatttctctctgaatggtcaatcttcatcataagccattttttgagaaattaattacagggagttttctgagaggcgctgtatgaagaaaatagcagagaatgaagtgcccgttaagtagctgactgtccacaatgggaagtactgatgcatctacatgccacaggtgcacccaaggccgtcctcatccctcacctcctgctgtccccaagccccccacaagccagtacacatgggtggagttggcacaggttgtacaagtagagatgtgtcagaagcataaggaagaggccgggcaaagtggctcatgcctgtaatctcagcactttgggaggccgaggcaggtggatcacttgaggtcaggaatttgagactaagaatgcaaaaattagctgggcatggtggctggcacctgcaggcccacctactcgggaggctgaggcaggagaattgcttgaccagggaggcagagattgcagtgagtcgagatcacaccactgcactccagcctgggcgacagagtgagactccatctcaaataaataaataaatagatataatagcttgagctttcataaaatctaagacgaagttgagggtcactttaggaatttgaaagcacagtagctaagaaatcaacatataattaaactcctaatcttaaataaatattaaaaagtgcttgccccaacctcagacagatctgaaaccattctctcctgaaaagcagggtctgtcttacctttgagtttttctctgatctataacccttcttacctcttgtcaatgtctccaaaatactgccattaataactcaccttaaaaggaccctggtgggaaaagtccccattagtaaaactgtttggtccaggcatgaaatgtgtatattccgcacagagttcggtaaattgccctaggatcaatttttctggattctagattacaagcgaaaactcttgtcgttaggttttctaatattagcattaatgctagtcgttagcagaatgcacctgcacttctgctgtgtaacaaggaacgatgctggtcttgaggaaaaatatgtttgagattccccgatttcagggatgaactagctgctttttcatggaacaccatttttacttgagagactagcaaactattgtgtgtgtgccagtttttcttgccacataaattactaccaacttaagagcttaaagcagcattttatcatttcccaattctgcaggtgaagctcagctgggccctctgagctgggtctaacactcaaggaactagcgcagctgctttcttctcttagagtcctaaggaagaatcctttttgacattcagtcaggttattggtgaagtccaattcggtggttctaggactgaggttcccatcttcttgctggctaatgaaggggccactcggggcactcagggaagcttgtggccatggacccttccctgccttgtgacccatccatcaacaatgcaacggggactgtcccaattcgaatcctcctcacactcaaaacctcttctcaggaaaaagtcccttttaagggctcatttgattaggtcagggccgctgagcaccatctccctttcttaaagtcaattgagccataagctaatcataggacagagaacacatcatattcactcaaggagggtgcattatccaagagcatagatcatgggaaactaccttaggatcctgtgtattctcttcagatattccgaaaatcatagttgggcatttagtcatatttacttaaaaatgaacagtcagctattgttacctaaacaattattagatagtctttttgccaatgatgaaattcgggttttcaagaaaatattagaattttagacaagtagtgtctgtctttgtaacttcccaaaacttaaagactttttttggtaagagcagggtgatattaacacgtgtgcttttttacttattgcacaatatctaacttatttttagatacagacactaacatttgaaagagatgcataaagtgaacccatgatttcaaaatgaccgcaacttactgctaccaaatcacggatgagtaaaaatttcattcaaaatgcaaaatagaccaacacgttttactataataaagtgcaaaaagttgacttatatggatgcagattccattttgtagctaacttttaagaaatagccatttgttaagtttaatgttgtgtgaaagaaaaatgtccactattatctaagagggatattaaaatacgcctctctttttcaactttctatctgtgtaaacacagattttgttcattgacttcaaccagaataacagagcacagcacattaaatacgaaagcagatatgagaaaccagcctctttcaccatgccagacgttaaaaagttttgcaaaaatagaaaacaatgctacctcttttactacttttttttttttattattatactttaagttttagggtacatgtgcacattgtgcaggttagttacatatgtatacatgtgccatgctggtgtgccgcacccactaactcgtcatctagcattaggtatatctcccaatgctatcccgggtttttgtttggtcaaatatacttattttcataaatatatatgttaatttctaaaggagtattgtcacttttaaatgaagtgataaacatttaaaattttctctcaatgtaattctgaatatattaagtattggtagctatataacctttaaaaaatgaagctgtttgggattttcaaccattttcaaaagggtcctaaggctgaatgatctgagcacccttcctctgggctgggagaggaattagggagggggaatgagaattggcctctgggtcactcccagtatgcaggaaggacatttaccctgggctcaaccatgagaattcagggagtccatgaaattaaataggaaaagaaatgcatttttatttacactgccttctaagtgaaaattagtattttcttctgttatgagtgtaagcaaaaagccataagaataccagcagtactttgccatcagcagaaactgtaggtattttcttatcacattaacggtgatggcagatatcagaagctttactttaaaattcagactattgtcgctattagatctgccatggtaaagaagcacatgccccactatgtacaaattctttttaaaatatgttgatgactatttcaacgcaactagctttgtttggtatcctaatattttatacagctataaacgttattctgggaagaggcccattaacctctccagacgactagaggagtgaggcaggaggttaagggccctcagcatagcggtttggaaggtgagttttcagcaaaggaggtagacacagcagatagataggaaagggactaaaggagggagctgtgccctgaaggcaaggaggtaggttcaaggaaatgaaagtgaaaagagattagtgttgctaggaaggccctcaaggtgtgggttgagaggtaaccaatgagtttggcaggtccagggccatgaagacctggacaagtgctatttcagtcatagggcaggacaaacatatccctgcatggacagggaaacaatgacaaagaacctggatgaccaggatagacatcacttgaacatttttattttttaaaaggaagcagagatttgggaccaaagctgaaggcgactgtggggccaaaggagaaataccggtgctgattttgtgggtgatatgaatgtgtatgtgtgtgtgtatgtgtatgtgggtttgtgtccctcccatgagctgcttgtattaagtagaaacagttgaggagagaggaagcctgatggcttaggagagagaaggtttcagggaaggagtgatgtccaagcaacaggatggagtgagcagtggaggacccggtctcagatgtggcaggggcagccaccactgcaatgagagagtaggcagagggccacataccaactgctgtgttgttagtgagggcagagtggaaggacttgggaacacgtgaaaaccattgatctaggaatctttcaaggactgtgactcagtatctcaacccatgtattccacttgcagtggataaaaatacatctaccattattaaacatgcccttgaaaagatggagcctactccttctttctttgatagtggcctggacctaatgactcgcaagcaatgaacagaaaaaacagtggaagtaattgtgtgtgactacggagaccgggtcactgcaagttcctgctggctctttctctcttgaagaattatgcagctctcaggaaatcaacagccatgccatgagggtactcaagcagccaccgggaatgccacctagtaagggacctgaggtccctgccaacagccatgcaggcaccgaggcgtcctgccaatctccacacgaatcagctcttggaactcagcctccgttgcctgcagccccagccagcattgactgtaaacccatgagaggctgggaaagaacagcccagctaggctgcacatcgtctcccttaaaaaatacgtgagctcagacacctttcttcattaggccaataataattccggtaatttatttgtagcaatagaactaatccaccaccatctttcaggctataatataagtctctataattagaaaggatggaatgagattggtgacaaggacaggggtcagcaggtattgaatgtgtagagccagatgggatgctttaaaccagagatgagaggccaactctgaacacctttattctcttgcatagtttgggtccagtgtttttgaatcttcatgttttcaggagaagcaggaaatctggatattcatgtgaagttccctgtgttacgagggtaggtacatcaatccttttttatgttccatcatacaggtgacatcagtctgtagttctggtttgtgagtggtacgaggtgtatatttacctatgggcccttgaataccagagggaacttgccagtccagttctcattcctgagccttattcttagcatgccctctgatggaaatgagttgtgcaaatatctaatgttttaataatcagtttgagtcactgtaaagcaatgtctccctgcccaaagatagatttcctgtcccgttaaaaaacatgaggaaatatctgtttagcatcatacacagataacctaacaattaatgactaaactctgaagaattacatttatgaatatacataccaccagtaaacactgtgaacacaaaccctcaatatttgcatttattttctcttagttactaatggtagctatccttttttctctctatataaagataatggcatttaatgttacccaacttactactatcccataataccaattatttatgatattaaacatggttaaaaagtgtttcattttaaaaccatacttagagcaatgtgaatgtttaattttaaattgtgtttattttcaaagttgcgtttgacaattatcacaagaggaaaactaacctctggaaagtaattctacatacacatacctttgaggcagtcagctcatctgcagagcctcccgcctgaacggtggcactgcagttcccataaatatacctacagagggtgccagagagctggcagccccgcccaggtaccaagtggatacctcagctcagatgggcttttcctgtctaatattctaacatgagggtgaccaatgtgtgcattaaaaatgaataaagagtaagaagctagagctctcatgcactgctggtgtgaatgtaaaatgaggcagctgtcgtgaaaaaacagtatggaagttcctcgaaaaaatactaataaaaatgagcatatgatactgcaattcgacttttgcgtacacacctgaaataatggaaagctgggattcaagtagatgtttttacactcaagtttaaaacagcattatttacaataaccaaggaggggcagaaagactgtccataaacacatgaatggataaagataatgtgatctgaccatataatcggttataatttagtcttaaaaaggaaggaaacgcaggtacatgccacagatgggtgagctttagggcagtgcgccaggtgaaatatgcctgtcacaaaaggacaaatactgtatgatttcatcgataattagatacttagagtagtcaaattcaaagagcggcagggaggagggggtatgggtaatgagagtttaatgggtgcagactttcagttttggaaatgcatggtggtggaggctacacaacagtgtgactgtattcaatgcccctgaattgtacatttgaaagggtttggctatgacagtgtccgcacccaaatctcatcttgaattgtagctcccataattcccacgtgcgatgggagggacccagtgggagataaatgaatcatgggtgctgttgcccccatactgttctcatggtagtgaataagtctcatgtgatctgatggttttacaaagggaaacccctttctcttggttcttattctctctttgccgccaccatgtaagacatccctttgctcttccttcatcttccaccatgactgtgaggcctcccagccacgtggaactgggagtccattaaacctcgttcctttatcaattacccagtattgggtatgtctttatcagcagcatgaaaacagactaatacaacatctaaacgttgtgaagatggtaaattctgtgttaggtttatcgtaacagagtagcaaataataagtaaaataataaaacttagcacttttctttcaaaataaatataaacgtaggtttgcctatgttccaagagcctttcagtggtgtgactgacttgcacattaaccaaagaaaaagggcatctgtggtagagaccaccatcctggagcagtcgtgtggggagcacagatggaacagaaggagaaagtagaaagagtgctcttgtaatcttgcaaatgatgcaagttaaaatggtgggcatggtctgtcttaagttatggagctgaactattaatacatctcaaatgtcaaatatgaggtttattcagcacattgactgataatgcccccttaatatttctaacattagttcttttactgaagcagattcatggactaaggcagggatactggcatccacgtggttttcaatctatcaccgactgcattttaaatcaataatcccaaaataatgcaaatgagtgccgttcgaatatctgcagggctgaggtggtagagtgtgatgctactgtcctctgtggggagccccgccaaaccgaccagcaaaacttctaatccaaagtctggccgtaattctccacgtgatctgaacatgtcagccagggaagtaaaggtttcgagctaaagtagacaactttcagaaaactcacttgtggaacatttaactaactcgttcatgacaagacttactgccacgcaataagcaatgccgtcttaaaaagacctcaggtcaggcacactcttccctgcctttttaatgactgacggcttgctacaggaagtgttcacctcctggcacagggctcgtgcagggcagatgctgtctgagggtgggcttcggagtgagactttgccagtctagctctgccaccactcactcgccttgggctcagttgtgctcagtcagttcttaggcacaactctctgcatgttaaaagagggatataatatccgccagtagatgaaatacatttcaagtgcttgaacatagaggcaatatgtatccccagcaagacagactgtggaacctgcccaagaggaatcgaagtgggccttgacaatgtccagaaggtatcgggtcagtaagacttcatgacaacctgctggaagccattagcagatcttagtgtggaaagacggtgaactcaacttagaggaagcgatgggggctaccagcgaagtgtttaaagatgaaactcgcctcttcttctgctaagtccctatcacttccaccaaagctcagaggattttaaaagctctcaccacaaagacataattatttcaggtgatagatatcctgatgaccatgatttcttcattctacagcatatttataaacaaggcaccttgcatattccatgtattgaagcacgtatcaaaacatcacactgtactccccaaatctacagaattattatttgccaattcaaagtaaaaaaaaaaaaaaaaaaaaaaaaaaaaaaaaaaaaaaacaaaaacagaagaacggatacataataatgtttcaaaaagttcagaggagaaaaatctttggtcgaagcgctgcaagtgtttccacaggtcctctaccttaaggctgtgattctgctctcaccccaaaagaactttcccgtttgcaaaagtaaactacttacaaggagacaatgtgatcatcctgaaggcttcaagtccttccattcccccaaaatcatgtctccaacaggtaggcagagaatgaggcttccagtttgattccccatatggttaaattcgagatgagaaaataccttgagcacatggagccccttggatgcatcatccctgactcagccattccttcatgtagataaatgaacacactgatgcattctcctcatgctcccaaaaaaatttaaggagcgattttttttttttttttgccctgtgtctgatcaccactgagctgggatagagcaaacctctaggttagcagagcaaagactgctgtctaagaaggctctcaagagatccattatcccttaattgactgatgctgatttggccccaggttagtggtagggatcacagcgaggagaggaaagtgctaccgccaatgaacagctttgcacacactatatggtttcagtgcctacatgtgcacctctcacttatgtcatcctctaaaaagcttacatttcttctgacagattgaccttcaccagcatttactaacctcaccaaaaggcaccttgtttattccattaaacagacctagaaacttattcacagttctatgcagataggaccagagttatgtgtcactcagaggtgatacccttaacctaatattttgacatgttcaaaaacaaccccattcatgttatgccagatattaggaaattatgctagaggtgataagagagagtgcttttagccactataatacgtagaccaatttgctgcttcaaagtgccatttcttgccaaaggttgcttttgtaaaaattattttagtggggaaaatttatttcaaacatacacaaaattacagataaaagtgaattgaacctacagatacccatcactcagctgtaataattatcacagctatttttcctacgtccttatacactttcttcccaatcaagtttattgtcgagcacaccccagaacataaatctatatatccataaatatttcagtatgtctgttaacacttccatcattccaaagtaaaacctcttacccattaagcagtttctccaccttcccactgtcctccttcccccagcaaacaatgacgtgcattctacattgaccagcatttatggagatacagatgcatctccacaaacagagtctctctgaatgcctctcttgaaagaaagagatggaggaatatttcattttagtggaagttcaggctaatacagggagaaatgttgcttgtcttggtaagagtgtgggattctttacctggcatggtcatgataatgactaccagttttaaccccttcaattcaatccgaaacttgcccagccactgttggacaattcatggataagtgcttgacccagtgcagccagtatggctggggtgatttgattccacccgtgaagaatctaaaataggtttttgaaagtgatatgaactttaccaaccaaggctaaaatggaaaggatgcactgaaagaagataggaattatgctcggtactgggaggtcagcaacaattgaggaaacaaagtataaatgggtcagaggcttagagcacagaatttacaggtagagagactaagatgatgagcaataccaatattaatggtaacagcattaagtgcttatgttttggacatgtgatgtttcatttactcctcaccacccatgagtgagtttccatcattatcactgctttataaatgaggaaactaaagcttagagcagttgaataatgtgaccttagtggttttggacctgaggtttgaaaccatacaatggactccaaaccctgggctctcactgaactcagcagatatttaaagaacagcagcaacattgtaagaagagcagaatgcatgctctccacattttttagacaaaaaaaatgctccattcctatgaccaaagagcctaataaaatggatgccaccagggaaaggagggccttggaggagagggctcctagcggaagccacgggcaagccctgagttcaggtcactcgtggtggttgccttgggaacagagtctttccgagaggactctatcaatttagcagtttcgcccgaggccaccctgcagggcaattactcgatacaaagctgccctctttagaaaggcttaaaatctttccgctaaaaataattttgatcaagtcatttaacctgtgtggatcacagcctcaccatagtaaaccaatgaaattttattgtcaaggactttttctagctgtacccttcaatgaaattaataatgaaccaagtcatactggaaggactcattccttaggaatagtaatttaactacaaaaaacaaaaagaaccataagctcaatagctataagaggaaaatatttgctgagactctgtataatttcttagtacattctactaaacaccctgactttatgcccaggcaacgcaccatgaaagctgcatttcagcaacccttgcctttaagacctttttggtttgtttgcttgtttgaacagagttcaatcctaaattgattttttttaagacagaaaaaaagaaaagtaaaaaatgccccagatgaactgaaccttcaagagtaacacctgataaactcaatgcttaattactaagctgaaacgtccatcccactgagtgattccgtttcacctggcctcatctcaggtatttatcgagtgattcaagactattttgaaatctgttttaaaagagatctatctatctatccatccatctatcatctatctatctatcatctatcatacaactatttatctatccattatctatctatctacttacctacctacctatctaccaacctacctacctacctacctaaagatacgtgtgccctgatcaagggaaatctgacttgggaatatgtcagccgaagtaaatgctgctgattggttttataaaagtgacacaaactttaccaacagaggctaaagtggaaaagataaagtgaaagaagttaggaattagactcagtaccaggaggccataaatacacacacacacacacacacacacacacacacacacactctctctctctcatacatacacatacatatattacacatattaatatatatacacatacacatatttatatatgcataaatatacatatgaatatatatacacatacatatatgtacaaatatatatacacagacatatatattatatatataatatatatataaaatataatatatattatctggattagatgatagaaacctgtaagaatgtacttttgatttggtgtatgtatgcactaatcttcacttattcaatgttttgctttcaacggtttcagttacccacggtcaaccgcgttctgaaaatattcaacgaaaaatttcagaaaaaaacaactcttaagttgtaagttgcgggccattcttcgagtgtgatgaaaccctgcaccgccctgctgcatcctgcctcggtcccgaatcattcctctgtccagaaggtccctgctgtttgcaccgcctgcctggagttgggagtcactcagtgcccatctcagggactggatggacgcccatggggttgtggtgtctgtgttcaagtaacccttattttacttgtacttaatgatggcaagcgggtggatacttgcatactgttagaactgtttttactttattattagttattgtttatctcatatgtgccccgtttataaattaaactttatcatgggtacaaagtacgagaaaagcatagtttatgtagggtttggtgttagccacagtttcggccatccactggggtcctgaaacttatccttcaaggataagggggggatgtctgtacgtgtgcaagggtgtgagtgtgtatatggcagtgaataaactcaggaagaaatgcaagctgtttaaaaatacaaagaatttttaagtgaacttcttatccttgagttccaatgtgctaaattaatacttaataaagatatttaattatttaaggatactaccattaccaatatactacttaaaacattgagctgatgcatggaattggaagcctgcatttcacgatgagaatgggagccttcggcttcctactcagcaccattccatgtttcatctcccagtgtctccctagtgcttccaggcggggtctgctgcatcttatttattactgatagccaagagactgatgagggctgttcgacagcatcgtagaaaaatggatttgcttctgcctggaagcattgggaacactgctcaatttaaaatacagaaactctgccaggtgcgatggctcacgcctgtaatcccagcactttgagaggctgaggtgggtggatcccttgacgtcaggagttcaagaccaacctaaccaacttggtgaaaccctgtctctactaaaaatacccaaaatagctaggcctggtggcgggcacctataatcccaactactcgggagtctgaggcaggagaattgcttgaacctgggaggcggaggtcgcagtgagccaaaactacgccactgcactccagcatgggtgacagagtgagattttgtctcaaaaaaataagtaaaatgaaatacagaaactctcctaatgtggctgcttcttctgtaatcagatctctctgctctctgcaactgggtgctgaggccccgtgacggggataccttccttctggttgctcccatgaaacttcatctaatgccgctgatgctacaatagggctgtactgaagcaattttccgtttccagttagagacataactcttcttttacttcatccaaaccctccagagtagcctctgttcttgttttgagagcaatagctcccctgtggtgtgcaaagagaggagtgaggagggaatgctgtttttgtaaaacaaaataggtgatatgaatgtggacatgggaggacacacgccagccaccacaacgatgtgaaacaggtacatttgcaaaataactcttttcaatcaccagcatttccttcagctgatacattcccaagtcatatttcccttgatcaggcacacggtaacgggcaagttgcccctggctccttaatggctttctgtctgatttggatatttagtgatattactcaacacagatccaaaacttggcttatacatcatatatggcaagataaaaaacaaacaaaacacacaaacacacacacacacaaccagattctgcaaatattgactcaagacttttaatcctggaagttgagcaactgtataatttacaaaatccttagatgattccagaatgcatctacaaaatgcaggtattaggcaaaatgttttagaagtctctgtgtcaatatattcatgtttccctgtgtattagctactgattctgtccagttacacagtaaaaagcaaattctgcctttagaaaatatgagtcagcatgacttgcttcagtgtctgacttcactactcatttaactctctccacaggtaagtctgaatctcttggtgccctggttcactcggctgagaaatgggctgccctctggagaggcttgctatcaggattaaattcatggacaacagaaactcgtttggagcaaggcctaccacacctctagcctttacaatgttgctgcagataccacacatgctccttgctaatctggccaattacactttctatcagtattcattttgaaaatatgcattgatttcctaatttatgcctagaatttttctaaatatatgacatagagttataaataaaacagacaaaaattacagcctcctaaagctttcttgctagggaaagaaaataaacagtagacaggtaaatgggtaaaatacatggttttcagtgggaataagtgcggtggattaaaaaaaatagagggaatagaaatacaaagaactacctaaagcaggtgtgaaggagattaataatataaattctacgtttccaacactgttgtatgcagtttacatacattaaatcttttcagtactcataaaaccctgtaatcgcatcacatctgcgtctaatcatattctatgtgtattaacacaatttgattctcactcaacatttgtgtgtgtgtgtatttttttgttttgttttgttttgtttttgacagggtctcactgtgtcacccaggctagagtgcagtggggcaatcacgactcactgcagcctccacctcctgggctcaggtgattctcctacctcagccttccaagaagctgagacacaggtgcaaatcaccaccatgcatggctaatgtaaaaaaaaaaatgtagcaatgtggtctcactacgtggtccaggcttgtctcgaaatcttgggctgaagtgatcctccctcctcagcttcccaaattgctgggatcactggtgtggaccacatgagtagaatatcatttccagtgtgtctaccacctgcctcaccatggctcccaggccctggctcctgcaacaccaggcaatggcagagtgaatctttctcatgccccaggtcttccatcacctgcgacctggcctgactcagcttccgcagaatggagctggggataaggacacacctgcttcacactgcctggcttcaaattcacctttaccaatcattaggtgtgtcgttttgcctcagatcctcatctgcaaagtgggagtggcataaataggccctgttttgtgaggctgctgggatgttacgtatgtctacatatgaatgggtgaaagccatgcctggcatgtagaaggtgctgtgtgcatcctactagaacattccgtgtgaagcattctgggtaaggtttctccctgagccctctcccctacctcctgtcatttcctcccaggatctgatacacaggtgacattcagcacacgactgtggttacatgattacgtccaattataaagtgctttaagcggatttgaaagtcagtgttcatttatattatagtcatgtaactacaatagtcccatattatattttaatcttaaattagatgggaacagagacaattagtttaataaaaattgcatttcctaccctaatcacaaacaatgactatcgggagaaattatcattgattttttgctttctagagataagccgattgggagtaatggcctataagtttatcttgctaaagtaaattgatgtgacttccttcaggaggcaaagacagctgaccacaaacctcacattcctaatgtgacccccctttctctatcacattcttcattgtgcaatctttatttctataatgcttttactgataaagaaatgcaaattattttagaattaaagttacagaaaaattaattgttaaatgccatcatcttgctctctgttgaaaaatttctctgttgaacattttttacttacactgttactggtttctttttaccaatctccttgcacagagtagcatatatcctcctatgtcatttaaaacactgtcaagagagatcaccctctcagttactaagctttttttaagctaccttggttgccccaacaatccacactgaccaggaaaatcaattacaatttcttgtcttcacgtttctgacttccaaattgaggcagtgatatttaattaaagattctctgaccacattcatttaagctcccatgaaatcgtctgaaatcaaaggagacaaataaaaatagccaagatggtagtatttaaaactaccaaaacataacccatttaatgttaagtcagccttatttagtctttgcccagtgagaattccctcaaactctgacttgcttgtgttctaaaggtagataattgtcaagggaaattcttaaaagaaacaactaaattacttgtaataaattgcagaagaatgcagtgacaaactaatgaagtgaaaaggggccatgtctccctttctggtgtctgtaagtttcaaacactaatgtaaatgattactatagtctctttccattagcactgtgtgggctctaacatacacttttatttactaaatacatttagtagacatgtgtaataaaaatatatgccctttgatctatacatttaataagcacagaaataaattatatgaagtagtgaattttatgctacttaaaaagcaagagagccctaacagaaaatagcgacgatcacagtggaaggaagagaagtcttagatatttgtatgtgtattttgcatatttcaatacatcgtacaatgcatacaggcattggggcctggcaaaaataactacaattgtacattcttctcataaaatatgcatggtggttgtcacaccttttatttatttcaattttgggggaaaatgacttgaagctcatatgtgcagtgaatacataatttaagttagagttttgatcctggtgatcagaaatgcaaatactggtcctgccgccaaacatgaatgcccttcccttttcagggctctgtgctcttgtcacggggatggcaaacatcctcaggtggcagcagtcaccactgaggggaccaagagaagacatgccttagacagggcttagataacagataagtctttctactgaatgcacacagacacatggaaggtgccaccctgtggtcaccaaccctaatttcaaagacaaattcagagtaacgtaaaataaaacaacctccgtcaactgggtgcactatacagataggctcacacgcgtgacaccatgtttctcttcatctaaaataggcatcaataaatgttacttattagggcattcatatttcattcatagtctcgaaatctgtaaggcctccatggtcttccctctgtccttgctgaatgcgcatatttgtatgcacaaaaaggtgtgttcaaactttagacatgatctattcagagatatatattgttatattgtaactatgtctttcttttttctgttttctagttatgttcttacatttcacctgacacaggtttaatttcaaaatagtggggatttattctataagtttacattttatttagatcagagttaattgtaagtttaaacaatgtttgcagttaaagtatctgatgcatgccggatactgtaaggaatgcaatccccactcctgtcctcaaacttttgtcccaggcattctgttctcatcctttgaaacttctgacaaagctgtagattgtctttagaaagaatacaaaattacagctagacaggatgaatctgttctagtgttctatggcaccacagtgtgactgtagttaaccacttattacacgtttacaaatagttagaagacaggatttagaatgttcccaacacagagaaataataaatgtttgaagtgatgcacccgttaattactctggtttgatcactacacatattatgtttcaaaatatctctctgtattccacaaatatgtataattattacacgtcaattgaaaaaaagggaaaactgattaaatctgggaatgcttaagtttttgaaaactaacacattaagtctctcaaaaggcctttctgtgctgaacatttacagttcatagggaaatctgttaatgtttaaattcctgtgttgtaagactgtaccacatggcataatgggtattataagttttaaactattgatccacagttatcacaaaaatagcaacagatgctacagtcagctgagatcaatggaaaaaggtaaaaaaaaattcaattttgttagtaacaaagaatgcagacattttacatttgggacaattaaaaaagcagggaagttgaagaatctccagtaaataatgctggttgcagccttcaagcaatgaggatattttctctaaaaattacagagaaactaatgccagagttcgattctccttcatgatccctatcattaaaattgtcttggtctcttctgggagtcattgaaataccaataaaattcgtagccacttacaatatgctgtttttcatagagtaaaagatgcaacaaaggtattcattttacaaaattttattttatttttctttttgagatggagtttcactcttgtcctccaggctggagtgcaatagcatgatcttggctcactgcaacccccacctcccaggttcaagtgagtctcctgcctcagcctcccaagttgctgacactgcaggcacctgccaacatgcccagcgaatttttctatttttagtacagatggggtttgaccatgttggacaggctggtctcgaactccttaactcaaatgatccgccttcctttcattgggcagcacaaatttaaagaataactgatgataaaatgcaatgctgaataagagccaaatgcctggtacagaaaaataggtagacttttgcaggagaactcagaagtgggagccatccttctgcggtaaaatactcagaggagggttcaccgatggatgtgatatacagacggaaaggagaaggatttctgccacagggaaagttatatggcacacacaggaaggaggacgagcaggggctgaggtagtgtgatttgatgctggtaaagagacaaatgtagggacctgggatgtagattttacgagatgtattggggaagaggagtcgaagcaaacaaaacaaactgcaaacgaagagtctaaaagacttggtacctagttccacaaaggaaagcaaaggaaaaagtgaaatgaagaatcactgtgtttaccttgagcatcagcttagggaggctatgcaggcaacagagtgcccagtggaggagagtatagcagagaggatgaggcagagccctactcagcttctgtgcccaggggtgggaggaaactgggatcagaagaagatagagggggccaggggtagtggctcacacctgtaaccccagcactttggaggccaaggtggacggatcacctcaggtcaggatttccagaccagcctggccaacatggtcaaactccgtctctactaaaaatacaaaaattagccaggtgtggtgataggtgcctgtgatcccagctacttggagtttgaggcaagagaatcacttgaagctgggaggtggaggttgcagtgagctgagatcgtgctattgcagtccagcccgggcaacagagcaagactccgtcttaaaaaaaaaaaaaaaaaaaaaaaaaaaacatacagaagaagaaggtagaggaggtatgactccatgcggtagagtttagtaggtcagagactaaatgtttaaagaggtttgcagcttccctttcaagaagtttgacagtgagaggggagaccgaaggggaatgtatcacaggatggcatatagggccaggttatcccatccagcttctgaagttaatcattttgtgtacctacatcatgacagagggagtagcaattttacatatttaccaagtaaaatgtacttcccatttccttttgttttacagtttttagtaggcacatttatttctatccatttatgatatgcattttttgacttcaagattaactgtttgttagaacctgaattattcagtgcaaatagtgcagacagataacttctagcaaaactgaaaagtaataaggatttctaaacttctaactgggaaattaacactacacaaaatttctcctctctgagtgcgcattcttactgagaaagaagaaaatacccagtggtggttgaatttatttgtgggaatatgcccatttctctatgaccctccatggcccttctaccctttctttctcaaatgtgctcaagtcggctttagcaaactcttgtggaccaaaggtaaaggttccaattccttaccatgtgagtcatattctggcccaaacctactttttcataattatttcccacaaatggcaaatctaattccactttttccaaagaatcttggttttttttttttttaaccctgcaaattgcctttcgaggctggaattctctccttttcttcccagcttcacactcattcagcacattcttgcctcacatcctggtgcacctggctctgctgatgaggaatcctgtccatcagtctatttgtctatccacctagtcacttctatcgcctttctgtaaagtgagtcttctatagcccaccattaaggagaagtgatcattccaatctggatgttctgtagatagatttaattctcacctagacattttattactcctaagatttcaggtaaacataacgttcatacaaatgtttatgaaatctggtatccagggagacagtccataacttacattaacatttcagtggcgaatctgacccgaatatttttcaagaactataagtaaaattgtaaactcctgcagaaagagtcagtaaatttttaattgtgctcctctatctaatgcttacaataggcctgcggtctatgatttatacatttttaaaaacatttctgatggatagttggcactgcactgaaaataaaataaacctgcctgtggacatggtgaagaaagtgacgcattgcctctgccccgggccagtagtgcttcaccctaggacgtgcccaggtccacttttccttctgctcgtcctgaaggacgtctctcccatacacctacactcagagtcagcactccagtttaatcacctgagaagcttgcataggatcagagagagagagagagagaagaaaaaaaacaaaaacaaaacgaaacgaaacaaaaacaccaacaacagcaacaacaaaaaacaaacagagaactcctcatataaggagacccaacttcttcactgtgaagagttacttctgcgtttctaaatgtgttatgactgcaatggataacagagtatttccgtgcgaatgcgctgagcagcctcatgtcgcactcatcttcttgacaggataccacgaggcacagactacacaactagtggaagcagtaaaatccacgccacccttggaacatacgcctagcacacttgtctcacttgaccgccatggtccctgtatggcagctgtgcttagctccatctcactgctggataaacaaacctttaaaggaactgagagacttgctcagtgtcatgaaggtcttcaggctccaaaagccagcatctctctactgtgctacacgactcttttcatgaatgcagagtgttctgccctttttttgtggttttattttgctcaggcattgaaatattccaggaattattcaaggaacatgaagcgaattctgcctctctggagatggctttcctggatgctggaagcaacaaacaacttgctgcttttgctctttagaaaaatagataatttgccgtccacacataaaactgcattgcgtggaatagtgtgacattaggatggtgttagaaaataataagtattatgtggagacttctgaataagtaattgatattgacttagaagactggaaaaagtttcttcaaaaagaataatggaaagaaacaagggtggttgcagggtgtgaaagaaaattaaatcttgggacctcaaactcattacgccgaagggaaaagtcaagctgggaactaggtctcgaaaaccttccttcccctttttggttcctaaatgaggtgattacaagatgaaaagctccacacttctccgtattttttcccataaagacattcctagtgagctgcaagatcgttactcccaggtgtttctgttaaaatttcaccatggcgatgtaaattgataagtttatctttacagctgccgtcactcccttgcccaccagacacaaatgcatatctgcttcctcctctaaccaatttcgtctatgttatcgtatgtaaaatccagattccctgccttttcctctgcaccatttgtctttgtcaccttacataaaaaattggagaatcactgacccagacagaggcatgaatgattatcttcccctacccccgttacatgaaaattgtgtatttctcaatatcctgccctttccccttcaatgtggagccctcacaatcctcttccgagaaggacatagacctgtctccccagcatgcatccttccctttggcaagtaaacctcctgaaatgattgagacttgtctcgtcacttttctggattgacaagggcatggaaggtctggcgggagtgggagttgaggacagggatgacgtgttcaagccgcagcaggtgtgtgcaacaggagcatgggaagtttggaatacggatcaaaagatgagtttgaaaaggcggatggggacacagcacggagagcatctactctgcctgtgataccctgtgggcttccactgattactaaacagggcacagcaggaccagatttggaacccaggttaatgaattacatgaggttttattccatagaaagattttaaccaggaaaaaagtctaggaaactagattttaactaggacttctaaactttttggaggcaaaaataaataaataaataaataaaatagatccaaagattcgtttctttattttcatgtcagactcccatgactagtttgtcaatgtaaatgtggatgactgtggtggacagcttaacatgtgcagtgtacattgtaatgcttcaagttccaaagcacatgctatttacaagcgatgcctacagacaggtagcaaataaacatgaaacgttgtctgggctatgaaatgaagagtcagtgacttacagcattagggtaatgtaggtactctcaagacttggtgtatatttctctagaatgaatgacattcttatttattttgtttcatatatctatggaactgaacattaagtctgataaatgctcatcacagatagagtaagggatggtgttcaaacatgctgagcgctttagttgagtgggcctgaagcagactgaggtttctaagggctttaatgaggacagggctgaggccttttgtagtaaagcctagagtagctggggctgggaggctcttaggattctccgggcagtgaatatttatcatctgatgcaaataattcaacatgttaacaaccattatggacatacaagctgaattgtagccctagatatgtgtcttgagaaagcaaagctcttactactttcaaaacaaatttcaaaatatctatgaaaaaccattttgaactctatcatttctctgttatattttttggggtagtaaattgtagactatgccatggtcaaaagttaactacaaggctcccctggaggagaatatgccaccttcacaacaggaaagaacatgatggtcagctctgcaagaacctggttggaatctcatgagcctttaaaaactaccactgagactgagctgaccagcaggagggaaccctctgagacatttcttcaaaattgctctgacaaagaaaggtcttacaaacaggtgagtaaatgccaacttgacgtaatctgagacagtctgaggaaaccaggttctgcacgtgtacaacaggaaactcgcccaggatctaatcatcacaattttcagtggttgccacattcatcttttgctacgcttgctcctcaaccattttggaactcatctctggattcattctgagcactccactgagactctgaagcatttgtcttttcacaaggggcatgaatccccggggaagtcaggcagctgctggagtaaggacgttaacctcctcagagtagattccttatttcattaagcaacagcttcgccattcaatttcagaagcctgattcagatcattaagagaacaagcaatgtaacctgtgcctttgaaggtttcctggtttccctacagctgtgaataatctgtggtttccccacattatcatgtaggtaattgcctggggagcagtcactacagcagctcgccaacctggtcacagcagcaggccggggggaaaggccagacttcatgaccagttggtcaatgtaaatgctgaagactttggtggacaacttcctcacatgtacagtagacacaatcatgcttaccgttccaaagcacaccgctacctacaagaggtacacacggacatttagcaaataaacatgaaacattgtctgcagatttggccaacgatattgcctgcatgagacagagaacatgaagaataagagcagctcagggctgatacgctgaaaagaatagcagtttaggactgatatgctgaaagccagaataagttcttcctccacatcacaaaactataaactgcgggaaaacaatttacgaagggattgataacctacctgaactttattcttgaagcataagaacttaaaatctaccagtcactgccaagtattaatctgttttaaatagctgagatttactggataccattgttggcccccaattatccaatgtcaaccacatttcaaagtttagagaaaggaaggatttaaagtggttttatatataacagtaaacgtttgtcatgcattaatatttcagagacacaactttaaaataaatcaatacataaaagtgcactgaattaaaattctggcatgaactcaaatgttcatgtattccattagtctgcgtgggatttttattcattaatttaacatctctgatgaataatatttcatatctttcttaaatttattctcttgtttcaacattagtaagaaattatccccaatatctactcaaaataattacaactaatatttaagtgtatttctcctatccttaccagatacccagaagctgttcagaatgaacttttacatttatgactttttaatataccgagagaaacaaaataatcatgcctgttttatcttctttgatgaaggtcaatagggtggggctaagaaattgtcatcacatggccagcccaagaggactgagtacagtgggtcaggacactggcctgtcagctttctgcctggaacaggccagtctgagaaataaagctgtgactaaattacagctatccgaaaaagttcctcctttcattaggaattttatttcataaaaataactcactatccaccacccctcaactaaaacacgttctgatgttaagtagtgggagcagtatgacaagtcggtggagaaacacagttgtaaagactgacatgaagccaagagcacagcagcctgtactcacatcctggttctgccatttgcaagctgtatgacgagagccacagcccttaatctctccatttctcgcatgagagttgaagcttctttctgttctgccatccaataaccccatgccatccaggagggattctctaggtaattttatgtggccccatttgcaagcaaattctaaacaatccatcattttctttggaagagattgttctgatcatctttgaaaacacttttttcacagaaatattatgtagacacagtattttttttttactaatggtcatccatgcgaacacatagctttgcaaattcctgtttttcatataaacaaatcatacgtttgttttttttcctttcatgaaatattgtatgtgagagtcatccatgtcgttacatgtagaggcagtttgtctctttccaagtttgtttattacttctatggttaatgaacatttaggtgattctcagtggttgacaatagcgcttgcatctcctctggacgttctctgtacctgttgtgcctagctgctcatttctgttggacacatgcctgaaatgttccttatgttcagcttgatggtaaaacagttttctaaaacggtcgtatcaattcagatttccaccaatagtgcaaaaaaaaagtcattgttttgttctttatgttttaaaatgtggaatttcaagctgtttgttttagttgctttgggctggggaggcattgagtctgaggaaggtcctcagtgtggcgagctccctcccacttcccagccctagaaaaaacccttgtcccacttttcttccgtttgtctagaagtccaccatggttctccaaggtggacgtgattatttctattttataaaacaaggtagcaagacacacaggtagaaggggtactggctaatcgtaagtacttaatgaaaagtgcagagtaagagtcagtcgcttggaacccatagatggacactttttccaaaatcttaaaacttgtgccattgagactttacaagaatcttttgttctgagagaaattaaagtagatatttaggaaaagtggttacgtgtttctgatttgaatgagttatattattaaaaactattttttttcatggaggtttagtggttttaagaattatttaaaggttataatatatttcagtaatttattttgattgaaacaatacttcatgcatccatacctacctaatagttccctcaaatacaagatagcaagggaggtccactgccatggaaacaggcaggaggcccatgtggaggtttctagacactctgcagagcagtggtccgtggaaccttgaggggaataggagcacttgatttcctccattccttccgctaaacgtaactgagcactttccaggttctagataatggttgttattatttttacactgttttaaaaggagaggcaaccatgcatgccaccagaatccaggtatactcctagatagagctctggaaactgcatttcaaatctcagaaaatgtgagcattggagaatggggaatgcatacgttttatccaaattagaattaacctgggaacatggggctttcaataactcaaaatgcctttctaataacatgaaagtcttcatttggtataaaggtcttcattttaattaaaagggaaaatcaatagttatagggaactataacctaaaaacaaactaattatttgtgtcaacacaagctttatcgccactgtcagggtttcccttgatttatgagatgaatgttccctataaaaattggaattttattacaaacacttactttcatgatgatttatcagttacagaaaatcaatgggaatttcattttatgaaaattgtaattttataaacagccgggtaaaggtgtgtaaaactggagcccaacacttagatgactatttagtagtgagggggccctcatggttcaagattaatatattttcaaaaaatttatcttgtagacactgaaaacgtctagatgatggattgtgcttacaaggcacttatttaattataattaatgatggaggcaacatataaagaatgggctcaattttcagctgatttaaagaaataatgtgtcctgcataaatcttacattcaaccacagcccaatatatacagcagatattgcaaatatattgtgggtttttcccctgcgttttctactacttttgttcacaatgtcattttaaaagtgaatagattttaagagtagcaactgtagaacagttttacttgtcaagcaaccttactactgcttctgacatgacttgatgatataattggagaggtgaaagtcaaagaagaaagtgtaagactccgagaataaagaatttggagatgaaagttaaaaatgtaagggaagagtagaaagaatattttatgttggttgtcatttatttgaccaagaaaagcaccaagttaaaaagaatatattatttgtctttgagaagttacacaattctgtccaagcatcatacgctggaaaacaaagaagtttctcatagaaagagaccaccagtgggctgatttcatataaacgaatcatacggtttatgtttttttttcctttcacgaaatattgtatgtgagagtcacccatgtcgttacatgtagaggtagtttctctctttccatgtttgtttattacttctatggttaatgaacactgaggtggttcgcggtggttgacaatggtgctcgcatctcctggggacattctctgtacctattgtgtgtagctactcatttctgttggacgcatgcctgaaatgtttcttatgttcagcttgatggtaaaacagttttctaaaacggtcatatcaattcagatttctaccaatagtgcaaaaaatatagtcattattgagttctttatgttttaaaatttggaatttcaagctgtttgttttagttgctttgggctggggaggcattgaatatgaggaaggctaggaaccacaaagggtttcttaggaattccagataatctgcaatcgtatcaatccaagtaacactgacggaatttttgttctcttacaaatgaccataaatgataaacgtgactacaataacgttaaaaagattataatatatgcgaagcataaaaatgtatgttctttttaaaatgttcttctccactttatatgtatatatatatcttatatatatcatatatatatgattcaggttaaatatacgatatatatgattcaagttgtttgacaacatttggaaagatgaaaataacacaataatgtttacattatgtaagttttcactataattattattgttgtcttattagtccccaaatatcaatcgactatgctttttttttgtttcgcaatttttgttggcacaaataatatcaggctttccttctttaatgtatttagttcagataaaaggtacaatacaatttgggcttcatgctttttaatctcggtatagacaagagggaagattcagctgaacaaatgttttccctgcttgacagaaggtttcacatttgccctctgaaggaacaaacttgatgatcttactcgcaaaaaaccaggacagccccgtgtggagggctgggtggctggcagggactctgagaagggcccatctcatcctaagctgttgctctgtctccagctgtccttaggtttgttctagaatcagcaacagcaaccatactggagcttccattccttggtaacagttctgccctctggatccagaaaaataatcgtagtgcctttctgcgtactgtgcaccatgcgccctctaagattcctcacatcctccttctgatgggtcttgtcatcttcctctctctggtccttcttcttcttcagagggtggtgtctagtactgaacctaaccttccacaggcagtctgcgtaaatgtggttttaagcaggaagtcccctgttcaatgaggaccatgtggtaatgaaaaaaaggtaacttccttgtaccgtgttgtcttggagctgaactttaaagtcagccttgaaatgtttcctaatgcattactgttaagccaggcttacctctcttgataccttcataccttttgaccgttttagaattaaatgccaaatttttgactcctctctccttatatatacaattgaagtgtgtgtgtgtgtgtgtgtgtgtgtgtatatatatatatatacacgaacacacatctacatctatatataaattatttatatatttcttatataaatataatacaataaatttaattaaatataactacatacagtttatacatataaatgtttatacttaaatatataattaagcatatattatagaatatatataaataatgtaattataatttatgcttctataatatatacaagaatgaagtgtgtataacgtacgtacagtttaattctataatgtagttgtattgtttatataatttatatactctatataatactttcattaattacatattttttttaacttttaaaatcaacgtctgatacatctaagtgattgctattttctgccaaccaatgagtttcttatatctaccatcttggagcagcttcaaagttgatattccatttttaacctttctttcaattacagatacaaatgccaagttcactgatcaggtttgagaaacaaacgcttagaaatttttctttaattcactgttgttcagttactgagagctctaggaaaagatcaatttacattttagagacaaatctgttaatcaacctaactgactataggatcagtccattggccttgtaaatattgacttatggttatgttaaatctggtacgggatggacatatccatagataaggatcactgaagagaaagtgcagacagaatttctctaccagaccacatggagtcttcctcattcaaacccacccagcctgggtgtgcacccacctcccaccgccaacacgtccatcccacctttactccattctaactacagccacagtatatggcagtcacaagataacggcagatatggggaggtatggaaaaggaggatcggcctggcctggctccaggtgaagggaaagcacattaatttcactctaataaaatttcagggcagcttctttgcaaccaaagaagatcaagctaagaaccttccggcaacatcagaaggcaatctaagatggacaatgttcctgatgaagtctaaaatatattttggcgctgggtacggtggctcacacctgtaatcccagcactttgggaggccgaggcaggcagatcatctgaggtcaggagttcaagaccagcctggccaacatggcgaaaccccatctctactaaaaatacaaaattagccgggtgtggtggtctgcacctgtattcccagctactcgggagcctgagacaggagaatcacttgagcccaggaggtggaggttgcagtgaggcaagactgcaccactgcactccagcccagacaacagagcaagactctgtccactgccacccactccccgcctggcaaaaaaaaaaaaaaaaaaaaaaaaaaaacatattttgttgaaacgaatttgcccctggattctgaggcaggaagttctgcgtacatcatgtgccccagggactgggtggcaaataaagactgctggttccgatgtgtacttctcagcaccctctgcatttcattccccgcaactgacccttgtttctctactggtcatcctgaaggaaacgatgaaagcattatggattttaaaatgtgtaagataacagatatttagaccagtttgttgaaaaattactaaaatctccagcaggagctataattagatccctttgcattctgactttcatgggaggtatttacaaactgcaaactgtctccgtgacctgctagttcctgcagcatggaggatgctgtaatttctctggcactgcagggcttggtgtcctctctggcacatggcaggtgttcagcgaatgctaccttaatggggtcaacgttctcatcgtcacaatgtggggaaagcttaggcactttgattgggaaggtccattattttcaaagtcatgttattttaatttggaaatcgaagtggaatggtttttaggagactgcttaataaactgaatagttttttgctgtgttaataaggattactcattattagaaacatacaggaaatgatacaatatgatctaggtataaaccttagaaaccagagagaaaaagaacatttcattaccaagctctgtcctaatgactacagactccccattttgctcagctgcaggaaatccagaatctttcttttaagattcattgtgtgtaaattactgaatcatgcatttatgtggtgtgaagaccttttaggattaaaagtgatattacaatactttttgtgcattttcatgcaacctatatgctatagcatgcttaacatgaatgtaaatacaatagccaaactgctgtggatatttacagattagatgcataataattaaaatcaatgataataaatagctattgattaaaacttagcaattgttccagtgtatcaagaaactatacatatcctgtatactgtgatagtgatatagctttactaataagttcccagctgtcgactatatgatttccaaagataactgtgaataaaagaattagaaaccattttcaagctatttatccaactcctaaaatttcatggctagaaaggatcaaaatatattacgctctgttttttttttttcttataagatggagcatccttaccttggaactgagcgttaaatcctttgcgtcggtggttgctgtcagaggtgaaatggagtcgtagccaattcttgctactgataactggagaggggaggttcatgccagttagcctagagaagagaaagaggaaaaaaatctcccttgtaaaccaacagagcaaatgtcctatatcaaacccgctttgaaatccgattacttaaatccttcatcttgagatgcttaaaacagaggccatgtattaattgactttgaaccttaaaacgatcaagatgattttatctttgcccaaacataaatgctaaatccctagatggaatgaatgttttcaaaaatatttgatactttcattctcctttattaatggtgaatgcaggaggaggtattcttttgatctcttagttcttttcatcaagatcttaatcacaatgaatcagaaaaaaggaaaagaaataggaaaatgataaaattctgtgtttcacaatttgaagacttagtaattccttatttatttatttatttatttatttatttatttattttgagacggagtctcactgtgtcatccaggctggagggcagtggtgcgatctcggctcactgcaagctccgcctcctgggttcaagcgattctcctcccacagcctcctgagtagctgggattacaggcatgcgccatcatgcctggctactttttatatttttactagagacaaggttttgccgtgttggccaggctggtctcgaacttgtgacctcaggtgatctgcctgccttggccttccaaagtgcttggattacaagcgtgagccacggcgcccggccacaagacttacgaattctatgtaacctgaagtagacgccaacaaactgtttctcatgcttggtaacaagctatattcccagcatcccatttgcaggactaagaacctgggcctttcctaccaaagtaaagaagaggaccatttatgagattgatgacaagaactgcaaaagagatttgaaatggaataaaattatgttttaagaaagcagtgcattcattttaaaaataagatgcaatcaatttctggttaagctgtttaaaatatccatttcactttacaacgtgcagtttagttgtcagaaacaatcatgtgttttatttctcactattgaaaaccttatgtgcttactaaggaataaaagcattccaagatattaaagctcctgcccgttagaggcgcaagggacacatttagtttttcagtggcataagcatcactggattaggatgcttctgatacaggattgcgtgctggctcgactttgtgctaggtgaagcaacataggtggatcatgtttatgaacctctgttacccattgtataaactggacacgaaaatacctgtatcaagggtcgaaagatgatagagatgcacatgtaaatgtacctgaagcacattctccatgtgctctacaagtggttgtgcactgaataattattttgcatcttggtaacaaaatctattttcaaaatgatgcttattagtgtagataatctgtaagggtttaagcaaattgcttttagcaggaacttgaactgtggtgctgcgtgtgggcctgcctgtgagcgccgcagctgcttggtaaagctgaggacctgatttctacacagacgatttcctacgaaatgggtcacctgtgtagagagcatttccctacttattctattacctggaagaagcaacaccagatgaaatacatagtcaagctttctgatgtcagggggctctattccaactctcaggtttaaaaatgtacaggatccactttaagttaaaagccaaaccttgactgtaaccaattacaacagtgtttatgccactgtttgaaataatcttctgtaagagaagtacactgctcagatttgcctctttgcttggatttatgtagtactggctggtgacagctggacacagctgactccaaggcatatttaatcacctttttttatttttctggtgagattatgttacaaattctataggccacatacttatttgcctaatacggagaatgtctaaaaaactagattcaaaaacccccagtctgtgccactcacctgtacttactgaacttacaggtactttaaaaaatcattgtggccgggcgcagtggctcacacctctaatcccagcattttgggaggccgaggcaggtggatcaagaggtcaggagatcgagaccatcatggcaacggtaaaaccctgcctctactaaaaatacaaaaaattagccgggcatggtggcgggcgcctgtagtcccagctactcgggaggctgaggcaggagaatggcgtgaacctgggaggcagagcttgcagtgagctgagatcgcgccactgcactccaccctgggcaacacactgagactccatctcaaaaaaaaaaaaaaatcattagtttctttgtatattaaaaatcaataattatttttatacacacaaatatcacatacaaaaaacgttaaattcaaacatagaaaatttaaaaactacaaacacatagatatacactgaaattaagcacagaagcaagcctaccttttccacatcagatacgatcctaatgtaaaatatatacatagctaatagtatccaaagccctcaaaatactgcactgatatttattcaatcccctgtaagtttccatttcatatggtgatagaagactatgaatacaaaagatcagcgaatgtaggaagctgcatgtacttgctaaacttttcacaaccgcaatcaatgcttgttttgttgctgctttgaacatatatattttctcactcgcattacttatgaacggttctgactgaaaaaaccaggtggaattttttttttttcttgagacagtgtcttgctctttcacgcaggctggagtgcagtggtgcaatcacagctcacagcagtctccgactcctgggctcaagccatccgcttgcctcaacctctggagtagctagagctatatgtgcacaccatatctggatagttttgtaatcttttaattttttgtagagactgggggtctcactatgttgtccagactggtcttgaactcacagcctcaagaaatcctctcacctttgcctctcagagtgctgggattacaggcgtgaaccactgtgccagcctggaattgcactttatttgcatgcctacattaataatgatcacaaataaatcccctctctaccaccacctacacccacatccactctttaccctcatctgtatttccaaatacctactcagaacaatgatagttttgtgtcagtcaacaggatatttctgtaaagggccagggagtacgtacgtatttcaggctttatgggtcacatggtctttgttggaaattgttcaactttgcaggtgtagttggcaagtagccataaaatggcagtgggtgtgttccaataacactttatttacggacactgagattttaatttttatacaatttttttgtgtcacaaaatagttactttttgattgtattttttcagtcacttaacaatgtgaaagccactcttagctgatgggccagatttggcctgcaggtactagtttgctgacccctgctctagcatatatgaagcgatttgtaaaaacagacccggtgcagtggctcacccctgtaatcccagcactttgggatgccaaggtgggtggatcacctgaggtcaagagttcaagacaagcatggccaacatggtgaaaccctgtctctacttagctgggcatggtggcaggcacaggtaatcctagataatcgggaggctgaggcaagagaattgcttgaacctgggaggcagaggttgcagtgagttgagatcacaccatcacactccagcctgggtgaaaagagcgagacttcatctcaaaaaacaaacaaacaaacaaaaaaaaccaacaacaaaaacaccgagctggaagataaacagatgatgcatagcagcctagtgtaattcaggtttaaaaaaaatgcgtaagtcctgcacaaattccttttatttttgacagtcttgctctgtcacccaggctggactgcactggcacaatctcagctcgctgcaacctctgcctcccaggttcaagtgattctcctgcctcagcctcctgagtagctgggattacaggcaccggccaccacacctggctaatttttgtatatttagtagagatgggatttcaccattttggccaggctggtctcaaactcctgacctcaggtgatccaaccccatcatcttcccagagtgctagggttacaggcgtgagccatcacactcagccttgcacagattccttttatagagaagcaagggtgagggctttagaccaattatacaatccattttccatgaagaagccattcaaatgaattgtaccccgaagtcgatttttgtacatgaatttcctgatttgaccttttgcgttaaacaaatgttcatagacttttgttgtttgtttgggaaagggggttgttccaaatgagacctggccttagaactgtgttgttattctatcgctgtctacagggccaggagctaatcttatagctctcatctgacacaaagttgatgctataaactcagttgtttcttcattacaaactacgtaatttaaaggaagatgattactgtacaaattaggtgaaattgtgaactctctaacaacttggtgtttcagttgagatttagaagaaaagaattcaactgaatggctttgtgggaggcagaatcatacctgctacagacagatccccaagccccgaggtcctgctctctggagactgtcaatgtgtcacctgacatggctcatgaggactttgcagaacaatgcgcttactgagcttgggatggggagattatactagattattgagtgggcccaatgtaatgaaaaagatccttaaagtggaagacagaggcaggaggacaaggttccaggtagaagagcctgtggacaaaggtcagagtgacgcattgagggcttcaccctcttggctgacaagaaagctgctgatacctttataactggaaacgcaaacaaacgccttttcccatagagtctccagagagcaacacagcccagctgacaccttgattgtagatgtgagatttctaatctatttactgaacataataaacacgtgttggtttaagtcattgtatttgtgttaatttgttatggtggcaagagaaagcaaatctcttgttgagatgtatacattaaatatgtatagcttttatatgtcaaccatatctccataaagtggcttaaaaagaccaaaacagaaatacggcctgttaatcagaatgatctagaatgatcctgaggaaaaggacagaaaacaaaatatggtacaatgtgacacaattcttatctattcataaccttactgaatccaggcagtttaaaccctttataaaacaaccagtgactgaagatctaccgctgttggagtgaggtttcctggaagtcttctacagctgttagccacacttcttttaggcctgctggatttggttttctaataaacaaatagtttggaaaatgaaagagattatggggcaaatggtggaaaatgggcatgaacagagacaagattcaaagtagaaacctctaaaagagaatagggtgccaggcacagtggctcacacctgtaatttcagcaatttgggaggccaaggtcagcggaccacctgaggtcaggagttcgagaccagcctgagcaatatggtgaaacaccacctctactaaaaataccaaaaaaaaaaaaaaaaaattagccagacatggtggcagactcctgtaatcgcagctactcgggaagatgagggaggagaattgtttgaacctgagaggcagaggttgcagtgacccggagattgcactgttgcactctagcctgggtgactgagagactgtctcaaaaaaaaaaaaaaaaaaaaaatgaggaacggggaaataatggtagtgatcaaccaatgtcttcccgcattaattcagagcgcactgaccattttctctcctgatgtccagaaacacaggacacacgcctggtgaaatcaaacggagcttgccaggtcagggatattggtgcttaaaaaacaagggggttgagaagtgagaaaaagagtaaaagagtaacaggctgagaaagggtcttcttaagggaattttgacatgccctatttctggagcatctcaatctaggtcaggaaacccacaaagccattcagtgggaatgttggacagctcctttagagatggcaaaaggaactggttgttcccacttttttcccctaagaataccaaattaagcaatttaaagcaatgccaaattcatttccttcagaggattcaactgggttttgcttctgctaagagttaaaataaatggaggactcatgggatccttacagttacgacgacctcctttgagcttaaatagaacaggccagtctgtttcattttctccaaataattgtaccatacattttaggattctatttataacatactcctactcattctttcatgtaacctccctcagcctcacttttctccgatgggatataagggctgaacacattgttctaacattttacagcactctgtatgtatgactcatgcatttcgcgtatgtgacttgaaaaatgaagagtcaatttatggggataattttctaaaatgcatttggaaatgctaatggttttggatatcgctttgtttgagtacttctcttacattaagccagatttcttatgtctttagaaaatcatcagagaaatgtctgggggtccctctgcagttaagtctctttaactatgatgactcagaagccagaaagcattactgctattgggagaggctttaaatgatctctgcccacagggggactaagaaatttaataaacctattacttggaggagaccagttttgtgtcaatttgggcagaaagccatataaaagatgtgctttttcttttttttttgcattttctggacatgcaatccaaatgatttgtactgtggtgtttcattatctctgttttgtcaaaattaaatagaacaacctgatcaaacagagagttcctgacatgttatgttttgaattggctgttactcacattgtaagtgaaatcatttctctcatgaacatgttttgagtttatacaactgttccaagtcttattttggacattaggaaaagcgacaatgaactctcatattgcaagaacatgaaaaacagttaaaagaaggtctatgtgtgtgtgtatacacacataaaataaacacaataatacccagacacaaatatatatgtacacacgcacatacacatatttacatagttaccaatatttctagaaatttaattcaaaagttttgtgcacacgtatatactatctggggaaaaacaaccaactatgaaacaaaataaaataaaaaaacccatatggtatatttaaaactgtaccacagaagagttttcattcaacagttctttaatcaaaacgaccatttttttttttttttttttttttgagatggagtttcaccctttcacccaggctggagtgaaatgagatgatctcagctcactgcatcctctccccaccaggttcaagccattctcctgcctcagactgctgagtatctgggattataggcacaaaccaccacacctggctaatttttgtatttttagtagagatgaggtttcaccatgttggccaggctggtctcgaacttctgatctcaggtgatccatctgcttaggcctcctaaagtgctaggattacaggcttgagcaacaatgcccagccaaaattaccactttctacaagtcatttcttccacccggagcggcactcatgattgtctctggcaaaggccttctctctccctgacaatgatttttctccctctggctctcttttttctgggagcactctctgaggcaccatcatgctccacaccagtggccataagcatccctcttggtgacatcatccactcctgcgactctagccacggcctttagctttttccttgtgccctcctatagtcaattttttaaatgaaaaaataatttctagtctcctgagccctcccactcactccagcttggctcattctgctttccagcctcttcaggtgcacatcgcccccatcccctgctttctacacccagaaacagctgacttcatgcagggcgccatgcaaagccccatgtgccctcctgactcagatcatcccatgcgctgtcccttacctggagatcagcagaaatatctgccctgcatcccacctactctgcacctgcctggtcgtttctggctctcctttaaatttcagatcatgtgttgcagtctcagggaagcctgccctgatctctaagatcaggcagctcctccttggctatgccctctcctgacacgccagacttaccctttgcagacattttcaaaatagtaatgacttggtataaggcacatggctgtgctttggtcagataggctgaggtaggatgtttatatcctctgtgactcagcgagtctgtagcacaggcgtgtaactccatttggtatcacagccatgtagccataacatgggaagcccatgacttggccctaagccgctcttgtctgtggaaggtataatcgccctgctgacgccgtacaggcacactggtgcccagagaaagagagagagccaaagctgtccgtctgcaaagatggtcggggggagccaggccacagctcggcttggtttattcccagagagagaaagagttaagctgctgaccctgaaggcaagggagagccacccacgcagccgtgtgtaaggcagctgccagagtaagcagccgagacacggtggacagtgtgaggaagctgctgatgagagctgctactgaataaaatcaactttcacctgcctacgccccacagagtgttctttctgctcatcccccaactctcttcagatctcaccatgacatttggtgtagtcttgaaccggacacttggtgatttgtatagttatttgcttaatgttagtcatttttgcgagattgaagcctgtcctattctcacggtctctctggcacgtaacagagtgctgggcatgtggtaggcactcaatgcacattggctgaataagccaaagaggtctcttcacccacactcccagagccctaggccagtcccacatcataaagtagaaatgactatatgaaaccctcgatgttatgatgccagctagggtgcttatacttcggatattttgtctcctccaaatctcatgttgacatatgattgccggtattggaggtggggccctgtgggaggtgttggtgtcatgggggcagaaccctcatgaatgaatggctggtgccttccccatggtaatgagtaagttctcactcttagtttactccagagctggttgtttaaaagagcctagcactcccccctctcctctcctttgctccccttctcaccctgtgatatacctgtgcccactctaccttctactgtgaataaaaatttcttcaggcccttaccagaagccaagcaggtgctagccccgtttggtacagcctgtggaattctgagccaaataaacctctgttttaaaaataaattacccagtctcaagtattcctatatagcactgcaaaacacactgacacaagtgcctttgtggctaaacagtgtcatagttggataaaccctgtacctttgtacagaaactagataagtgaggagataaatggtggtaggacaatgaccagggctccatattctcagaggacccaggtccctgcatgcacacataatcctgaggacactattcacatggaatgatttcctccaaagccttagacctcagcacccctgactggagatgccttatctccttatcttaataacctctatgggaatcaaaagatcccataactcacttgccctagaaacgtcctcaattcccactccccacatctgtctgtttgtcatgaagctcctcagcaggtgtttggcacacagccaccccttgtttcaggatttctggaggccacaggctctcagatgtatatttctggttgcactcaaaaagacatgactagaggcgaccaaagcagggctcagggagtgcacagcactctctcactccagggacccctcctccatttagatttgcaccgtacgcattaggtcactaagtcacatgtgttccacctgcaaagtacgcttctcgcttctcttccagctacacactgcctgtgttcccgtccaaaccctggtgtctctccttgtgctgtagggaaactctcctgagtgtacttgtgctccctgcccctctctgctctaaaccacattacataactctgatatgaaataccacaaacataatcaaacatatataaacaacgtatgagtgtgagacaccttactgggccctgaagacatgcgtgtgagtgagtagaggcacccacaatctttgagagcagagtagccctgggtgacggatgtcacacctgagacatcaccaggtggggagtacaggttgctgtgagtgtctgcaagagaggatttaaacttctcttggatggcagtttccttggagatgtgatatccacattgtgacttaccatgtgtctggctagacaggggctggggagttcattatctagagcagtaatcacctgaaaattcatggggaagctaaatcacagcactgcccttttctctttcttttttttttttttttttttattttgagagacattctcactctgttgcctaggctggagtgcaggggcaccatcttggctcagtgaaacctctgctgcctgggttcaagggattctcatgcctcagcctcccaagtagttgggattaaggtgactgccaccacacccagctcattttcgtatttttagtagagacagggtttcacatgttgaccaggctggtctcgaactcctgacctcaggtgatctgcccacttcggcctcccaaagttctgggattacaggcatgacccaccattcctggctgcactgcccttttttctaaaaatatttttcatagctttcaaacacccttaaaaagaggtcaactgtcttagtactgaagaccctttataatatgaatcgatttgtttctagcctcatttcttatcacgccctttcgtgaaccttgtgttctgcccatgtggtggcgatcactccctcgactgtctgctgtgctcctgctttcgcccttgatcctgtgcagtcaatctatgctagccccacggactcacttttgcctgtgtaaatccttcccaaatttccaaggtttttcagaagacatcccttccagagacctttctctccttgtctttaatagacttaaccactcctacctttacagcatttgtttcataggcttccctggaagttactgtgtgtcttacattattaatggttgtgtagaggtctacctcacctctgcactctgagcccactgagggcattggtgctaactcagacatcttcctcttctttgtagtattctgtatgcactaaagccttaacaagtcaattctaaatggtttctttacttttatttttgctcctaatgtaagttattaagagaagtgaaccctaagatgataaagcattaagaacagtaagagaatgctgctcttgtcctctcatgcccagtggcttcccatcagcactgcagccttgcaggtgggggcgcccagggggtgagatctggcatcctccttttgtttgccccagcatagctccagagtcctacgggtggagacaggtctcaggaatccagtggggacacaccttcaccattgaggaaggagaaagaggaggatgacagcacttgtgagagatagggtatgagagtccatctcaaacatgacagacttgagagaaggctgtaaaaatggcctggatgccagcaaatcaggcatcaggaattaacccagaggtcaggcagagaggatcatttgggagaggatgtgacaaagcccatcttcttaagcttaaggactacgtgccagggaattgctcagaactcaagcctgggaaatggctcagacagacaagtaattcgataagacagtcgagagacagtggccctgatggcatttctctgtgggtgtgtactttgggcctcctgtccacggaagggacagaggaatgaggccagcacagtggtgcgctttcttctgccggatgagagagctgtcatgccccacctggaaatctcctcacaggcctttcaatgtgggaggaccctccacgggtgacgcagatcacactggtattaaaaatcttggttgcaacaagctaatctggatccaagtcagtgacctggaaaacgaaacctccaagtgcctgtttctaacccttggctgtatccaatgtcctggtacctgggttactactgtctgtgaagacaggcctctcaggcttgccaacacgaagaaacaaacagggagacaccctttgcctcctataatacttggacatttgaaacagggagcagtcggcactggcaatggatatccatatcatattttgactatcaaaaaaggcagtgtcgccaaacacagagatctctataataaattccacgcacagtcgatactcaaagactgataataaagaaaataatttaaaaaaaaaacatggtaacaatttattttgggttcactgacaattttctcttgatattatttttagcatacatattctttaggaatatcattaaaaaacacatttttctccttaatcttgggataagaacaagtcttatcctagctcattccaagagcctgaaatgagtctaccattttcttttttctagcaaatttcttatatcacttgatagactgacgcagaccttgttcagtcagctggtaagatatccaacgagtccgacggcaacagatgcagcacggctaatgcaatcatatgggtccccaggcgaaaagaccagcagccctcaacatctgagatcatatgagctctcataactccggagctcttcagctgcttttcagcatcactgcctgcctcctgcagacccacttaaacctcactcaagtacagtagccgtggggttccgctgaggctgctgtgtctccagctggtctgtctgtgctgtgcttcttaggtcacgctgccatcgtagaaagcaagttcattccatgcacaggctctggactgaggccaaagagcagctcaggctcttttatgaaaaccagccgcctttctccccgacctgcacactctgcaatggtgtggtcattacgaacacggacagtggagtcatactgacctgggtccaaacacaaccatgtcctttcccatgtgggtgacctcaggcctttactcagccctcctaaacctcagaattgttcattgtgtgaataacgatatgtgctactgcagactgcaagctgctgctgttctctcaagcatctttttctacttcccccaacctaactaaggcttagattatgctctgatcctcactttatcccataacatccaaagctgattgctgaccttatccaaatacgagtgtgtggatctatctctcaactatgttttatatccacttgcatatatattcacgcaatgcatactgtatatgatatatggtatacaagtaatacctatatattatgtatattatacagtgtatgtctacatatactttgcgttaagagaagtgaaccttaagatgataaaacattaatgacactcagagaacagtgctctcatcttctcacgtacacgggcttccaccagcactgcagccttgcgggtggaaatgcccagtgggtcagataaataaatacgtctatttatttatatatcatggtaaaaagttaaaaagtttcccaacttcttagcttttttccactttacattaatgatgtgaacattacacgtcatgggatgctgaacttttaaatatttcatatgtctttgcagttccaaactccatgaatgcaccaggtatacaaaacagaatcaatctttgaccccgagtatagacagctacggtccatatgatttagagtcatatatttaaagacaggccaaaatgtgtgtcttcaaagatagcagagagggggtggacagtaaggtaggagaactaaagcccagaaattaagggaatctttaggaagagtggttcctggcatagacaaccatacagtggccaatggcaacaaggcggagacgtattcccgggccaagtgaatatcatgattgagctaggtggttggttcaccttcccactcagtgaataatccaacctaactgtggaagctcatcttcaatatgattgggaaattccaaacacccagcctttaaggagtaacattcctttagatcaatccatgtttataaatgttttaaattgattactgtaaccagaaaatatatttccaacatatttttttctgaaaatttctagtttatgccataaacaagaatataaaatagcatgagacaatttataagaaagtccaaatggctcagacactgctaaacagaaacaagagtactttaagttcaacacagagtgtaacattaaatagaagcaggaattgaccatattttattttcacttgctccagaagctcagaacttttaagtgttgtgttattgctcctttccagccagtctagcaaagttatgtaatttctttattaacacgcaaaccaaacggatgtatcccacattattgacacactctcagaaatcgtaaggcttgtcctaagttttgctggtaacttgctaatccattacttccttggtggatagtctaaaagaaaaaatgcacaggctctaggaaatgtccatcctagagcaccacttctttgaaggagggtctacttagcactcactgcttttcaagaatctgctgtgttccgatggaaggtgaatggaacaggaaaggcctggcggattcccgcacagcaggcccacagcacacctggggagggcgttagttgcttttggacaggcaggtgtgtttggttagaaagtcagtcaggaaaagtcagagttgagcaaactaattaaagagatgacttttccttattagttactatacagttaaattgattaaaagatgaaaacttacaatttccccttgccatgattttacaagcttttaatgttcacagacatgttggtgacacctacaacactcgaaggcaatttgatcatcaccatgattcttccatatatatcagtaacaaactatagctaaatagtggtctttagttaaaatcattttgagaaaaattgcaaatatgttaaaagaaagttgtaccaaattagataacaatatccattaaatactatgttaaaaagcattcaatgacacaaaagaatatgtcagatacatccaattccagtgtaaagtgacaggctgaactcattgtttttcttccacagttgttgagaaaatagaggataaaaaaataagaaaaaatataatatcattaaaattagtgacaaaaatacacctagttttctatgtgctttcctttacagatatgtacacgcagatataaaagtgaagtatctatttatacatcatttaaaatccacttttttccattaagagaatgttatagctctttgtatatctatatatatatgatgtgtgaattctgtgaactattccattgagtgaacataccattacttatttaaccaatgtcctgctatggcaatttggtattatttctcacagtctcataagttttatagcacatcaccttacgatgcatgtgtgttgaatcagcacttttatttcacaggatggactcctagaagaaaaacgtatgtgtcagaagggatgtagctcttcaggacttttgagaaatgcctattgcaatattgctctttacaaaaaataggctttgggaagaagcctttgaaaggcactctgtgaattcatacagtgacctgcctttttcttcctttttttagatccggccaattttctacctttgctgtgattcctgatcagggaaggcttgcgtctctatttccagattactcccttctttccatcagagcgattggcacagctgtctccagcaggagactaaaggctacctgcagccctggcctatgccacactcatacaggtccctctcccatgattttgaaacatttctacacatggcttctttccttggtgcaagaaaatactaggcaactgggcacagtgtctcatgcctgtaatcccaacactttgggaggccgagggcgggggtggatcacaagatcaggagttcaagaccagcctgtcctatgtggtgaaaccccgtctctactaaaaatacaaaaattagccaggcacggtggtgcgtgcctgtaattccagctactcgagaggctgaggcagaagattctcttgaacccaagaggcagagattgcagtgagccaagatcacaccactgcaccccagcctgggcaacaaagtgagactccatctcaaaaaataaataaataaaaagtaaagaaagaacataataggaacattaagaggcctgtcgcacatgcagaacggccataaatgaagggaagaagggtctgaaaggaaaattgtttttagtgctttttcccatcatgactgactgtcgccccaacaccttgtgatctaatttcatgtcactgtaaccatgatggtagctctctttcccttccattgcctactccattccccgccaaacccatacttaattgcagtttttctttatactctctcaaccattatatatttagcagctgacctaagaaaagataaaggaggaaaaacaaatggtcctgtagctcatattttttagtctcatagcattttgcaggattaaattaatcattttcagatagcttggtgaatctccgaattcaataggaggtaagcagaaattgcccagtgcatgttaatttggacagtttctctctctctctctctgtcagtgtgtctgtgtgtgtgtctgcgtgcgtgtgtgtgtttcatttgcatgtctgtggtggacaatagtcttgggggtattgtattctcaggatcttgaaaaactgtatccaaattgtgaacaaaaaataaaacatttcaacacactggaattatgacttggtgcactttggggaaaaacgatgactactctttttggggccagctactttggggttttgaaatcgtgtttggctccgtgagccactcttgctttgaggttaggtccagaggctgcacctgctggtgcttctggaagccttgcttactctcagggataacagacaaagaagaacgcttagaaattcagacggcattgcttcacactctgcaaaaagagtttacaaaggagagatttcattcaaaatgctttttgcagatgatagcaagttcttctctcagttgctggtgggggggcaagcagggccaggccaattctcaagctctcgaacacacaacagtttggagcttctgctcatttgggtgactggatagcatcaccattgcagaaacacagccctagagacctggagagcctcaggggcagggagtcaggcagcatcaagttggagaaaggtgacagaagccagtgctgaatcacccccaggaagcaaaacacaggaggaagagaacggagaggcccctaaagacctcgaggtaaaagcagacaaaacgcaagattcaatgacattgactgtgtgtgttcaaatgacagcatcatgctctctccattgcaggaaagaactctgggaaccctttactatgaggcagaatgatccgttcaatacattctcactccttgtccttgctttgcccacttttgaatctgccacagtcctgatctgacccagatatgagcaggagaaaaatagcccacaggcaactcaacaagccgtgtaatgtctactggcattcagcaattacagcatttatccaattctgggctggtgagaatccataccctcctttgaaatggatctaaagaggagcttctagtgcgagcatctgagtctgccattatgctaccaatccaggcggttgatattagggtgattttgtgtgagtgctctaaactgtaaatgaacacctccttttctccttgaattctcagaaagggcaacatatatatatatatatatatatacacacacacacacacacacacacacatataatacacacacatatttatatatagatatatacatatatttagacatacatatgtacatatatttagacatacatatgtacatatatttagacatacatatgtacatatatttagacatacatatatacatatatttatatatacatatatacatatattcatatatttatatatacacatatatacatatatttatatatacacatatatacatacatttatatatacacatatatatacatatatacacatatatatacatatatacacatatatacatatatacacatatatacatatatacacatatatacatatatacacatatatacatatatacatatatatacatatatacacatatatttatatacatatatacacatatatttatatacatatatacacatatatttatatacatatatacatatatacatacatttatatatacatatatacatatatatacaaatatatacacacacacatatatatatatacacacacatatcaaacataccttcattcagcaaatattgaacgaatgtctggtctataaagcaccatgacagccaactggaagtctgtgtttaagccatcttacagcacctcccaaccccctcctctgcaccacatccttagtgcattcagggtgacaatgaaaatatcacagatgagggctgataaaagacatgtttatggctcacagttctggggtctggaggttcactatcaaggtgccagtggatcccacttctgggaaggactggattcctgattcagaggcaggacctcctccctgtaccttcccatgacagaagggaagaagggagctctctggggcctcttctataaggacactaatcacactcacgagggctctgtcctcacaacctcatctcttcgccaagtctccaccttctaatagcattaggatttcaacatgaactctagggggacactgacatttagacgatggcatgtactcacataatctgtcaccaaagtgtgaaactagcttgtgttttagattctccatgcataatttggggatataataggtttggggagagctggtaggatggggtcttgccctgtcacccaggctggagtgcagtggtgcactctcagctcactgtagcctcgactacagtgaaggctcaagtggttctcccacctcagcctccagagtagctgggacgacagtcatgcaccactatgcctggctaattattgtattttttgtagagattgggtctcaccgtgtttcccaggctggtcttgaactcctggactcaagtgatcctcccaccttggcctcccaaactgctgaaattacaggcatgagccaccacacccgtcctataataggtatttagtgaagacaaagtaagtccagtgtaaactatttggcagttttattcaattttggccttattctctatttgctgacttacagcaacagcatcttaattgagttcccaccttcaaattgatgatgaggagggcaagcatgatgggcggtgacactaacccagaataaatatccagaataaatatcattcaagtggcaggcccatctacatgcttcaacaagtcgttttcactcactttcccccacattgtatttattttgatcattactatgttgctgaggaaaatgcaaaccaataaacaaactggggacctgtgaggttgagtaatttgcatgacattgcacagctaacaggagcctgtgcctggattaaccctgcatctatttgctcttaattcttttacttacacagttgctgcgctatcctacctatctttcattcttgggcttttgctattttcctaaaatacaggctgagtcatgcagcttcttgtctaaatatgtccgcaacccattccctcttaggtttgagcataaatttacgctgcacaaagtgttatctaaagccttttgtgacctgcaccgcctgacccttcaaccttataattttctcttatccaacaacttttggctcaaatgccacttgctctgtaaattcttacagattgctgcaatcagaattgaattccaatgtgttcccagagcatctgggtttcagtagagtacacagtgcctgaggtgttatcatatggcggttgtttggatgtctgtcatctccccgggatgcaaaacacaagtttttcaaagatgccgtcagcctgctttccaccatgatatctccatgctgcctaatgtgtgctttgttgcctggctcataggacagagagacggttaaataaataaatagaaagatgctgaatacatgaattggtattaatctttcattcccctccttagtggacagaacgtcatgtcttcctgcttttctctgttaatcttcagttgggaacctgtttcaaattctcactatctttgttgaactgtggacaacctagctggagaccagtgaaaaaatcagtttgactaatgctaagtgcaaaggaataacttcacgatttctgctctcaaattttggtgaaaggatttctatttactattctaatgagtacaatatggatgacacagtgtccgtttttaagccatgactgtgctgccccgtcattctcaagggatacattccaagactaccagtggatgcctgaaaccacacagagtgctgagcccatatgtacacaatgtcttttcaatatggtaaccaagaaggctactgactgaccagcgagacgggaaacaggtagcatatacacagcaatgcactggacacaggggcgattcccactcccggcaggaccaagcaggatacaggagatttcatcatgttactcagaatagcatacaatttaaaacttacgaattgtttgtttctggaattttctatttaatgtttttagactgctgttgaccgtaggtaactgaaactgcagataaggaggaactactgtatttctttatttataccaaacttaagtccaaaaaagaattttgaaaggtttagataaaactttgcaaaacaagttagaaatgaattgtatgttaaacattggaagatttaaagacagtgaaaaataagtgaacagaagatgaatccaggagtgaagttatgcaggcaatgtatcctacgccttcacctctgaaccatctagcagacacagcatagcaggtaacaggcccaggtacctgactcaaattacacagcaattaaaaacaagtactttggggagggggcaaaaacaatcatttatcaatgatactcatgaaaaggacacggggtgaagttatgaataacatttccaataggatcctaatattaaaagcagggagaacttttacaagagcgcaacttcaaatgatctccagtgtggactcatgtgctcttgtcagtaaagttcgtaaattgttgggactcatgtgctcctgttcagtaaaagtcatagattgtcggggagagagcccaacacagtcactgaaataagttctagttcctaaatgatgcacgcaaacacacagttcaaatgatatgaactataaacttgttttactgccttaatctacaaaaggtccacgaagcattgctgggtgctgatgtcatcatggggtccattgctttccgccaacgcgcagggttgttactgacctaggatgggtcctgagacctctctcccttgcgccacatgtggcttctcaatgagctcctccagtctcatggatgtgaatgccacctatatgctgatgatgccaaattcatgtcatcagcccaggcttcctcctcagagcttcagaccctgatccaaatttccccttgactctctattccatgtgctggagccacctcagaacccatacacctaccttgtccatacaaatctactctttccccatcctcccccatccttccttccttcttcttacctgcacacactctgctcatctgcacatcatacggatcctaccttcagaacagatccatgtctgaccatctcagcaccggagggtgccctgtgctcatccggatggaggtcacagcctccctgcttctatcctccctgctccattctattctcagaacactgtccagaggggtcacatacaacccaaattagatcacattgcaccttgaagcgacactctccaggggtcacctgtctcactgagagtaaagccagactctaaagaggcgctgcaagggctgacaccttctcactcctgtccttctctaatctcctgtctggccacattctactcacacacctagctgtggccacacacacatttcctgctctctcttaaacaccctggggccttggaacttgctgtgccctctgcatagaatgccagatattctcaaaggtgactcaccttcttcctacgggacttttgttaaatctcattgacattgtagactccatatccagccatcaccacctccttctttccctccttcccaccaaggcacttgccattacctgatttcatacagatggctacctggagagatgatagatacattaggtagatgacagataaagataggcagaaaaaagatacagagatgatagatgagcagtgatagatagtgacatatagacgagatatatatatatatatacagatgacagatcatacatagaatgacagatacagacaaagatagctgatagatataactttgtattttttgcagagacggggtctcaccatgttgcccagcctggtctcaactcttgatctcaagtgattctcctacctgggcctcccatagtgctgggattacatgcatgaccccccacatctgaccttaaatgctggaggatttaaagacaatggaaatctgtctatatctgtttacatctatcatgcttcctactatctatctatcatctgtctatattagctatctatacctacacacacacacacacacacacacacacacacacacacatcatatatatatgtatgtgtgtctgttacttgttatattatgtttaaaatctgccttctcctatagaacatgagctccttaagggcaggggtttgtctgcttgatttctgcttggtgcacagtccacagtcagtaaatatttgttggacaaatgactgataatcctactcacacagtgctccagacagcagtgcctccagatgagctaactgctgcaggatacttgcatggccccctccactgctcttgcacctggggcatcctgtcaggcctcaggcaggcttcaaagggagcagtgctcattctggtgtcctgctactctaagagatgatgggctgaggatgctctgagcaccataaaatcctacaggacggagggctttctcctccaggctccctctagtccacaggagacaagctgccatacggaagcagtctcagaatgagatgcctcccccaccagcatcccaaccagcaacaagaactcctccaaggagcctccttgaagtgcagagtctcaggacccacgccagacctgcggcctccttcagatgcagagtctcaggccacactccagacctgcagcctccttgaagtgcagagtctcagttcccactccagacccacagcctccttgaagcgcagagtctcagttcccactccagacccgcagcctccttgaagtgcagagtctcagttcccactccagacccgcagtctccttgaagcgcagagtctcagttcccactccagacccgcagcctccttgaagggcagagtctcagttcccactccagacctgcagcctccttgaagtgcagagtctcagtacccactccagacctgcagcctaagaaactctggctgtctggctgtctgtgcttaacaggctgtccacgtccctccaggggaaactggagtttgagagctgctggcccagagcattatcttgagaaagactttgagactcagtttggagtcagtggaaaaatgtgtcaggatagattagaggcgtcagcagggggcagggacgggatcctggccgtttgtcctttagaggtctgtggaactgactattttctgctctgacatttgctatcacattctatttgcctgtcagtagtttaccatttaaaagggtatctttctcctgttacattttccccaattagggaaacctgtgtaatcaccagctgtctggaatcatttcggtaagaagaccgggggcagaaacaaataaataaaaagattcaacacttaaatgatctctttccacttccagccatcccaaggtgccctcgccttacaagggttcctgtcttacggtagtcccattgcccccatccctaccttctacaagaacgctgcccgtgtgcctgtgcacgctcttgcctggggtttattttctgagattctctagcagaaaagagcatcagtgccctctcctgtctctgttctgcacctctccttcctgcctccaacctttctccaggttgtttctggaccagagcttcctgcagtttcagagctggccaaagatcatcttccgagcaccgcttcctttctgcagggcctttggaaatcaggttacaaataattgcttgtgattgggtatcatggagccttgtttcatgctccgaacacttttctcctgactgctgtacaagtttattattcctcattgaatactcagttgagaaaacatgctgcttgcaggcatttggacaaaaagtaggacaggagttcccggatcaacaacaatctctcaaaaatgctgtttctgggaggacaatcagccttggcttgtgttcttttcatttgcagcactttttctaggctcagatcagctcagagacaccagaatatttgcatgatcaacgttttcataacaaattaccattcctgttctcctctaaatggaatgtaggttaaaagactcctaatgtctatttttcagataaataaaatattttcactatgcgtgcatacttgtgtgtgtgtgtgtgtgtgtgtgtgtgtgtgtgtatgtgcagtatttgagagggtgaataagacagaactcactgtatgccttctagaaggtgaggactagcaagggtattatctgtttgcttgagcttttatgaaactaggcttgaacttttctattgatttttagagatttcataattttaaagtagtactgtagctacaaattgtaatgacccaagatgaagaaggggcttcagaaaccctgtaatcgatgagcactacgtaggagcatcaagaaagatcgtttaagttgtcattttaaaattttagacatcttaaaacaatccttttatagtattcactgatttcatcaaatatgtgatggaaaattactctgctaaatgagccatgcaaattagcagtgaattatgctcaaatatccaaaagcaattatgctgctgaataaccgggtattttaataaaatatggataatgacagcgttaatattttaggttacatttatgcaatgatatgacatttaaaatatagaaaaccagatacaacactatctagcgcatattttatatctgcagaacataaaattatatttaagttatttgaaagagatcccaggtcctcatgctccttccagaagattaacatccagaaatattgagctgagacatatttaatagggacaggaaaaatagttgtttaaggtgttcttgaatattttgaaaatttagtttcatttatttttttctctcatggcctgtctcccagatccactgcttgtcttaacctttaaattgctgaaaactaagaaagcttaaatcaaccaaaagaatgtgaacttccaagctccttttcctaaatacaaacatgttcctggtattcacactctacttctacttttgtgagaaacattctttaaaattctttaaaatccttttactgtaccagtcggtgttgcattagaaggcttgcgctgatataaacctgtgccatcggggtgaaacatagtatgcacaaatccaatatgacaggttaaaagttaaaagcatcctttatctccctctgtaagtacactggcattaatcaaatcagcattgtctggttcttccatgctcagaaatactacagaagaggctgagcaattagttcgtattccgcaaatgagtcaactgaaataacagttgttcgttagaatagaatttggaagcattgcaaacaatcaagaggcggcctggtccttaattatcgccttttcagcacacattatcaacactgctgactcactagtaagagtggatttcacaactttaatggttcaaaattacatcctgaatcgagtatcagtaaccattccatcaagtcaatttttgtggtactactgaattggatgggtaatgagcttcaacaaactactattttcaaattcacaaatactaaagtgcatctaataattcactacaactgtcatcaaactgggcctgctcccagctcctggggttgtaatcaagcccctcacctgtgcaaaccgcttcagttgtcggcagaaagagcccagcctggtgagaaatgcacagatgctttccacataaagcccatttaatctcttgggtgacattcttatacacagattcatctaaaagaaagtaattcaatcagctggccctagtgctttgccatagaacaatttcctcaataattttctctgcttattggatattttgagatttgcagagtgtggaaggggtttaggtaacactggagaatttaggtaagaccatggctttctaaatgtaaaaataaagctctaaagatatctgtcttcatgatctgaaaatatctgtgacattttgtgtgactccttggaataaagtatttcgtaggggaaactgaaatctaagcaaagtaaagcagcaaatagttgaaagcctgttatgatcatggcactgcaaactgtttcaagaagccaaaaacaccttcagctttggagttcatgatcaaggttgtccaaacaagacaaagattggtgattatttaactcacagtacaaagtgataattggagcaaaatttaaaaaattgcacctgttcaattttgtgaatcagaatgtgcactaccacagagtacatgccgagagaatatggtatgaatatacaatattcatacatgtctttgttcttttcattctttactcattgaacacggagtctagggtcaggtcaagcgcattctatagagttaatgcaagcttgtgctgtgaggccaggtggactgggagcagcacagtctggggggtttcctctcagagaatacgggttaagggagctgctgatagttgcaccacgtggtgcccctgagttaggtgtgcgattgtggacatggatatatggtctatctgcttacacactgctactcgcttttgaaaagaactctccaattatcagtgtactctgtcccacagtctcacataccatcaagaaaccctatagttgatgattgtccctgtgatgtgaatggcaggtgcctaggtttccatcctggactccagcctacggaggttctagggtgtccccatgtgagggggccaatattgcccctgacaatctgatagagacaacagagggcttagaaatgctgaataaatgtttccttttaaaaaagttatgactttttatgattttgctctctatacttcctagattcatttgttcaatggcattttcccgctattttttttcacttaaattcattttctaattttggtagacccatttaataagaactataatctcacatgccaactccattaaaaaaggagtatgtggtaagagaagggatgatgatactgaaagacattttgattttttaagggataatttaagagtatctctctattattattctgtccacttaatacttggaaggagagtttgataaaataaacaataaaatttgagagccatgaagaatgtaggggtcatataatttctttttttctcatttaaaagagaaaacaaacgaagtcaaagaagttcatgtcacatgaaaagcaaattcacggtgcggcataggacagaatctatgtcagtcaccaggatgttagttttgtgcttgctttgtttaatgatactcattgacttgcttatatatttccatgctaaccatacttgtatgatactgtggccctataggaaaatgttcaaaaagggaactccggcaagtcaatctttaacctgaataatcacgataaactaaaaaatagactataaataggctgttcaacaaccctgaattcaggacagcagtaatgacgcataacatgtatagataatctaataaaatcaagtgctttttaaaaaggaggctgggggagggatagcatgaggagaaatacctaaggtaaatgatgagttgatgggcgcagcaaaccaacatggcacatgtaatcctatgtaacaaacctgcacgttgtgcacatgtaccctagaacttaaagtgtaatttaaaaaatgctatatattctcagagtcaacaatgtttgagaacaagctaatagtttttggctaggttcaaggagctgggtgttggtgatactgaattataagaacagtatgaatagagatctaaataaactttaggaattaaagataacaaatgattttataagaggtttttctagcatgaacacttatggagcgactttcttgccctagctcgcctgggaatactataccgtgagccattaccaaaaaataaataaataaataaaactgtggttaaaaatacatggcaagagatctagcctctaaaccaaattgtaggtacaggattgttagctataagcaaaattaagcacaacgtcctatagcacatcgcaagcacgcgttcatcttctgtactgacacttcctactgttgaaagcaagtccccatctccccatcccgtaacccccagcctccaccatcctcccttctcgggatttatccagaaggagattatttttgacaacttaagtctcaacatctttccacctgttctatttgttcaatcaccattctttcttgttcctggatagcagtgcatggtcaggccgatactgtgtaggtgctcccggaaaaactggttttttgcaaaactcaccattagaaatactgggatggatgggaaacacagtgcagatggcaggtttttcaagtccgtacaactctgtgagcaaagcaccaggaagcagtcacatgcccctggggtgacccacggctggcacagtcaggcggccctgggcggccctatgctgatggcaggtcgggagcacagaagcattggcgggctgtgaggcggccctgcagtgctgaggaggggaaaggacctgaatcctgtgctgagggtgctgcccctaaggtgggcacaggaggaagcaccacctggcacaggtgagagagttggacacagtagcaaaggcctgagaggaagccctggatgcagctggttcttctgcatgtccataaaacatggttgaagcaccctgctgctggttcagcagtcaaacggaggctcccctcccctttgctcctgaaaggtctcattcttactcctgctattcagatccccctttgcatataaggggaaaagaaagtcgcataggagacactgaggcttccatattgtaggacagcattttcccacttaccaattaatattgatggatgactgttttcacctcaggagcacatgaactagactcggccatggttgtggtgcaggctggagctgggctgcagtttgaataccccagctctgcgatttacctattacctgcccttgggcaaattacttcctcttctggtgcctgacctttcttatttgcaaaatgtttatcatcgtacaacatgcctgacagcactgttgtgaagattgaaatagtaaattcatttaaaatgcttcggaaaacattagtgtgtttggacaataataattacaaattctttttcctctctctttctctctctcatgcatacatatagtagacatgtaagtgtcacaccttgggaaaggggtgggtacccaataaataacaaattattttttaaaaggatgtgtaaataaatgtccaacacaggaccttgctagattactaaatttctcagataaataatattaaatatatactttctaatatctcacttctaaaattaaaagttgttctattgaaaaaatggagaaaacaatgagaaatcacacgattcttcagcccagaaataactgctgttagtattatgctgtttggcctttcagtttcttaaagagatatataagttcctgattttaaggtgaacttctagggatgggcacttatttttggacttgctagaatcctcaatttctaacacaccaactggtccctcatggtcataaaatgaatatttaaatttctaatttattaagatgcttcaatatatgctttagcaaagaacagaaaaatgaataaatcaataaatagaaatctgtttggtttggaaataagggatattgtcagcaaattttcaaatattcctggaaatatgctattattctataaacaaatggtggcagacaccaatgcatgactaagtaaaataagatacaattagcaattccactcatatttacatcatgttgcatatcacaattgcttgcaccatttccgctgattttcaactcatccaatgaaatcatcacaatactgatgttaacatttgcttaaaattgtactttacaaacatcatttttgtggtcaaaacaagtttcctgttgagctaaaatatactgctgtagaatttaattttatcattctggtaaaatgtctctcatgtcagattctctagctaaacagttataagtagagggagggaatagagatagaaaaactgcccatctcacccctcaatagcatagtggactttgggtcaagattgactgaatttgaatcctggtcctacctctgtgatgttgggtaagttctttaacttctcttggccttagtgcctgtctgcatgatggagatgatgactactgaattaaagagttgttatgaagaatcaatccatcacagtttgtgaaatgctcagaagagtgtctgtttcaaagcaagcacgacagaagcatttataaaataaatgatgaaacttcaggctgcggaaaataaatgccccgggcaaggcctcagtcagcagtggaaccatttcttttttcattccacacctggccatcaagggtctgttctggtgagaggtcaggctaagcagctgggacccagcaatgccaagatcagcaatgggccatgccctcctaaggcttgtactctagtgttggaaaatacattaacggcagtcaaacacctaggtgtacttccacaaacacaatcagggcttgaagggagaggtaagcggtgctaagaacacttaattggatcatttgatctcatttataagatgttagaagcaagttaccatcgagtgtttattgaaggaagagttggcatcgccctgagggtgagtgtgggctgtgtgcatggaggagccacgtgctaccaagaagtgagaggcccagggtgcggggagccaggagctaggaagcctatggtgccccaggaacctggaagagtaggtaggtccaggctgcggaagagctatgttgaagagcttcttccttattcctgagggctttgggaagtagagcaattaaagagggatatgtcatgtttgtgtctaaacattaacaagatttctctgtacaccattcttggagccgaggaaatggaaggcagacaattgggttagaagctctgcagttttccccaggagacctgagtacttaggctgggctggtgggcattggggtgaagaaaattagaaggacggaagaagtgatgtttgggaggtgagaatgagcaggcctcattgaaagactgggtgtgaggcgtgtagtttgtgaatcaaatagaggtgaggctgcttagcaaaacaggacacagaggagcacctggtttggggccagattgggacatgagatctcccctgttattttgggcacgttgggatcaaggtgtcgctaagacattgtcgggagatgtcaaggcaagagtggatacatgggcatggaggttagaagagacctgagggtggagacaaaaatcctctgtctgttggatggagggtcactgagaccacgggcttgggtgacctcatttagggagatactagagtgagaagaagaggatcgaacaagagtttgggggaccacaaaagtacgagagaaagcatctgtaaagccataaataaggggaagcaggaggaatggtgacagatagtgtcagacaacctaggagtgggtgagagccaagaatatcacagctcccgagtaatcatgcagactgaggactttacaacggcctaggatggacaggaaaatcgctgttgggctctctcagcaaagcagttgcttaaatctagcatcttagttcactcgagatgctatgataaaatactacagactttgtggcttaaacgaaaaccatgtatttctcactgtctagagggtggaagcccatgatcaaggctctgatgagaactttctttcaagctcacagagggctatcttccccttgcgtcctcaggtggtagagagagaagaaggaaacagaatctctactggctcttgttataaaggcactaatcacattatgagggccacaccctcctgacctaaaagccccacctcctaatactagcacctttaggatgaggatttcaacccaggaatttggatggacaccggcattcaatcctcatcatctagattagatgagggcatggaagctgagggtcaggatctgaagtctaacttaagtaacttctatgtgtgaagtgtcatatttattctgagtttagagtgtgtttacagagggttaaaccaagctttatggtaacaacataactcaagaggaagggtagtcaaaacatattctgaacatgtaatcaggtagctttcactttctagaaaggaaaaaatgtccagaattttgtattcctatgctgaggaaaatgaaaaacaacaacaaaaaaagaatttgaaaaaacttgtgagttgtgaaaaaccataatcaattttagaaaattgatttcatggatatttaaattggaaagctatagagaaaacagttcaatgttgatgccattttgcttgcaaaatcaattaagtaagcagataaccaggattctcctgttttgtgggaaattcatgaatttcaattcattttctaaatgatatacaataattcatgtgaaaaacaaagtagtgattaatcaaaaaaatgacagcttatcagaagaacctaacagcaattaagaaaatattcatatccatgaataggtaagaagatacagattttccaggtaccttaattaaagatgtagttgctacaacagttaattctgtataagtatttttattccaaggagaaataaggcagcttggtaatataatttagtattgtttacaaattattgtaagttttcacacaactagaaatttacattacatttgtaagaaaaacatagaccctgtatggggaagttaagaagtgttataatacaagctaggaactggcactttttagtactttaaatgtgctggaataagaaatcagtgtcctatcttgcaaagcaagaaaagttctatcacaaaatagtataagtatgagagagtgttactctattttgccagattaaatctctgtagttgtgaggggaaggagatgggcagaaatccttgcatgggctcctaatgctcttgaataattgggagctgtgagttttagaccaagagtaaaaaagaggtgtctttggctagagtcttaacctcacacactggctcaaaaagcctctccatccagtgagtgttctttgggaagacttgcaacgcttagttctaaaattttctttaaaatattctcaggacttggagatgaaatcatttgtaaaacaagggattcatgtgatactacataattacaaattacagatagttggatcacaggatttaacaggcatagacctgcatttaaacaagatggagctaaacatcagttttctttcttaaggaactttttcatagcattttagtaaaatgcataataaattaagggatgggctttaggtaccctgaggtgtgcagcccatgcctccctgtgcccacagcagccttcattggtcacagaagacccaagtgaggcttctggaggtgcccaacagaagaaccagctgagataagaggcagaaatcaaaatagaactggggaattctttcctacttaagaacttcaggatcaatagtttccttcatctcacctcagatatttattcaaccatccatccatccgtcaattaatttaatgcattaaatcttaccaaaggtgttaataggattgtaaagatttagttcatctacattttacttgagccctctgaggtagataaatgtagacaaaaatgtaagtacctctccatctacagacacagttatgagtctaagtagccattcagagattagaaagcactttcacatccatgcagttgttccatttctgaatgtgtgcataagagagtgcaaaatcaatacacaggacagacgcatttatgtatttcatgcaaccttcacactaacattctggggtagaaattatgatctcgcccattttatacctgaagaaacacaggctcagaggaggaaagggacttaggctatgggtacgtatttcctagacagtattgtagaatttaaatgcagataatctgattccaaattgtaagttatttccactgtattacactcttcccaaattaggaggatgctatgttctgaatgtttctgtccctccaaaattcatatgctaaacctaagcaccaacatggggggattaggtggtacagcctttggaaggtgactaagtcctttgttttagagcaatgccccagagagcttccttgacctttccactatgtgaggatccaacatgaaagcgctgtgtatgagcaagatagtgggccctcaccagacacaaaatatgccttggttttggacttcccagcctcctgaactgttgttttcaagcttcccagtttatatttattgtgacagccccaacagactaatacagagaataatgtaacttgtgtctgcttgtattgctagtgtttttttttttaagtagtgtttttttttttaagtaagttttttttttttaagtagtgtttttttttaagtgtttttttttttttttaagtaagggacaaaactttaacaggaaaaggaatacagattatgaaatgctaccattcaggtttttatgctagtactttaatactccaaattaaagtaatatattcactcacttgctaaataaagcttatatgactagagatactgaataattcttttagtctttaagtcctctaaaaaataatagtgaaaacccaaaattgcttaatgagacatgtatgaccttgtttatttagtatttatcatagatgttaaaatgatcatggttaattttttttttttttttttttttgagacacagtttcactctgtctccgaggctggagtgcagcggtgctatcttggctcactgcaagctccgcctcccgggggttgcaccattctcctgcctcagcctcccaagtagctgggactacagctgcccaccaccacgcctggctaattttttgtattttcagtagagacggggtttcaccatgttagccaggatggtctcgatctcctgaccttgtgatccgcccacctcggcctcccaaagtgctgggattacaggcgtaagccaccatgcccggccgatcatggttaatattaatgtaagaaattagagaatgtcaatgaaggtccattatatgtctattaaatgaaagtgttagctgcttatagttattttcgaatttaaattgccttggctcacatgccgttttataatttcaaatacataatcagaactcttttgcatctagtgaatcagtgctgcctacacaaaactcctttatcagggaagagtgcattatcaatcaaactgaaacgaaataacagaaaacaagatgaagtaagtcatgtgtagctactggctgtaacttcaaatgtataatgatggtgatggtgatgatgatggtggtgatagtgacggtgatggttatgatgatggtgatgtttgacagttataatgacaatggtgataacagtattataatgatggtgatgatgacacggttatggtaatgttgatggtgatgctaatgatgatggtgagagtgatggtaattatgacggtgataaccgtgtgatggtgataataacaacagaaacttagacaactaggaacaatcataatttttttttatgtttttggcatacacaacaattacatttcacaataacaacttatcaaaacacaaagagataatagctgggattttgttgttgttgttaacagggtttgttttatctttttgatatctagatacctttgacaaaaacacccaaacttctccatttcaaagataacgaccttcagaaataactgctgagtatagtgagtttggggtttttgcaacattgaggtcgataatgggacctggagatgtcagagccctgagtaaccgtccctctcccaggcagctactttttgagatggaaactgtcgctaatgaatggatgtgtcaaaactgtcaggtcctaagagcaacagatgacacctgtcattttaactcacaggaaagatggtcaaaaatattcttcaattataggcaaatggaatgcaacaccttcaggttataaagactccactaaaaccatgatcatttttaatatgatttatggctacttggtgagaaattaatttcataaaatcagtgtgatggaacactttataacttttaaagctggagtgcatgacaaacatattcttctaggttattacttatattttaggagcatttagatgtgtttgtaaacccctaccccaaacataaacttccaccaccaaaatgcttttagagattctataattatatccaaagcatgtatgataaacttgctctaattaatgaacataaatttaggtatctgaatttaagtatagtagaatttcataggataacctgaaacaatgtgaaaaaataaatttggtgaagaaaatctttcaaagctctttgacaggggattcttaaaattcctctgtatttctcacagcatcctagcatagtgctgatacgtagcttgtaatacgttctttagttgaataatttgaaaagtcatctctacaacaagggtatggacaattttaaaattaccttaacaggccgggcatggtggctcacgcctataatcccagcactttgggaggcctaggagggttgatcacatgaagtcaggagttcaagaccagcctggtcagcatggcaaaaacccatctctagaaaagcacaaaaattagctgggcacgatggtgggtacctgtaatcccagcaactcaggaggctgaagcaagagaatcgcttgagcctgggaggtggaagttgcagtgagccgacgtcgcagcactgcactccagcctgggtgacagaataagactcagtatcaaataataataataataaaaaaataatgtatcaaaccctttgtataggttggtgcaaaagtaattgcagtttttggcattgaaagtaatggcaaaaacctcaatagcgtttgcaccaacctaatagcttattatccttcagacacatcacttccttgttcttttctgatttctaattcttttgtttacttctaatgttttgacagtcaattaacttgggcaacctcaaagtttaaccaaatctctatgttttcctccttcaagaatgacttcctgagcctgggccaaatagggagaccctgtctctacgaaaagttgaacaattagccaggtgtcatggtgcacacgtgtagtcccagctacaggggaggctgagatgggagatcgctcaagcccaggagggcgaggctgcagggagttatgatagtgccactacatgccagcctgggtgacagagagagacctggtctcaaaaagaagaagaaaaaaacttcctgggagataataataataaaatcaatgaacacccacatgtacattatgatcattaatgtagccacttcctgcctcatttcttaaccatgacatatatatttggttataaaaacaaaggcaaaactgaacaagatgaggacggagagcttactttttgccttaaatgccaaagcgtttttgcaactcgctgattactgtcaattatctcacaattgatttatttttcagactagtaactttggaattgactcctcctttgttagctcccacataccttcctcttcctttcaccctcagacaaatcatgacaggcagtaagttaatcatttgccatgttacagaaaacaaaacagagaccgcaatcatgaaatcttttctaaaattgacacagtcaagttggtgaaagagtttcaaccagaatgctcattttctgatgttgagaactgccttttcatgctctctctcacaatttaaggcatatattgataatgacagagaaacaactactctctgtatttgacttgaagcacaggatgaaattttaagtcaccctacatacttgccttgagaacatctaacctacctgagatttaccgttagggtctttttcctttggtattttcagatgcacaactgccactgtgaaggatcaccgtctagaaccatccactctaccacaggtgtgaatttcctcactctgcttaaactctgaggatgggcgagtgctaagaatggagtaaaacacccaaaagagtagaaaggggcaattaacacttccaaaagtgtctcgaggaggatacccacaagagtggaaggaactgctcgaataatttaccactttgcagaggggctgatggattttggcatttttctgtttagcaatttttctctcaaccgctatggtctaagtcctgttccagaccttaatggtcatcaatctcaagcgactgcagcagtctctcaggcaattttcctatttttagaatttccattcccatctgtttatgcagctagaatgtccatgactatcatttaaattctgtcattttctttttctgttcagaaaccaacccatatttttccttgcctactttcaagaatgttgccactgtctctgcaagaactcccctttctagtaactcctgccatgccccccatccagccaagccagccctcttgtgcccccctctctaggtggatctctggattcgatctctgggcttccacatgacaccccctcctccaaagcctgccaccctgtaccctaatacatgcctctcttgcagtaaaccttcccaaatgtcccccagaagcctcacctcaattgcttggatgatctctcagcatttgtaaaccactcatgattcattattcagggtaagttaatatgtttatttgtggtcttgtgcactttttattttcgtaggatctctctggaactggtaggaacttgacgacagagaccttgccttctacctccttttatgccccagggcactaaatgtcaggatctgcatacaagaatcactcaataaatattgactgagtgtcgctgatggaccatttgtcaaatcgcagagttccctttggaattgctgtgattctcttgatactctcccccagagctgggtaaatgctgctatgtgtaataaatggttcttctgctttcctcttcctgaacccctgcttatcccacgcgtagacagacgaaagacttgctactcaaatgacgaaccgtgttccaccatcattggcttcccctgatggctcatgaaaaatgcagggtcgcaggcacacaccctgcctaatgaaccggtgtttgtgttttcccattatcccagcaaatgactttatgttactcaaagcttgagaagcactggtttaaggggaggggtttccttcttgggacaatcctgttctacgcagttgagatgttgatggcctgcagctacttcccttagtattcctaggtgtagcgacttcaaactgaaaactctgcgcctggtgatttttaagctgagtaaacatatgtttgctaaataaaacacttatagatcatgaagtttcatccatgtagttttctatcactaacaacctgtacctttgttaaatgtagtgatcatagaatcagtacttataaaccaattaaatcaacaaatagtttttcatagctactctctgcattacattgtattgtgtgttataatactaaaataagtatttaatacaactttcctgccatcaaagtgctagtaacccattggtttatttttccatttttttctcgatatattaataattattttttaatttgctaaacacatgactagaagttatgtgattatttggtatttatcctactggaaaaaatctcactgcttgactgtaaacctagcaaaactcctccgatatctcacagttgcaacttccaggtcaagactgtactctgaaacaaaataacacatctctaaagtgacaaccaacttgtcaataaactttaattctgaaggtaaaattatcaaggaagcccatatccgggatcaatttaccaatgatctctctctctctcttactgtctgtaatggtttcctacccattttcatcttttctaaccttctaatgtatagctatagatatatatctatcatgtatagctatagatatatatctatctatcatgtatagctataaatacatatctatcatatatagctatagatacatatctatcatgtatagctatagatatatatctatcatgtacagctatagatatatatctatcatgtacagctatagatatctatcatgtacagctatagatatctatcatgtacagctatagatacctatcatgtacagctatagatacctatcatgtacagatatagatacctatcatgtacagatatagatatatatctatcatgtacacatatagatatatatctatcatgtacagatatatatatcatgtacagatatatatatctatcatgtacagatatagatatctatcatgtagatatagatatatatctatcatgtatatagatatatatcatgtatagatatagatatctatcatagatatagatatatatctatcatagatatagatatatatctatcatagatatagatatatatctatcatagatatagatatatatctatcatagatatagatatatatctatcatagatatagatatatatctatcatagatatagatatatatctatcatagatatagatatatatctatcatagatatagatatatatctatcatagatatagatatatatctatcatgtatagatatagatatatatctatcatagatatagatatatatctatcatgtatagatatagatatatatctatcaagtacagctatagatatctatcatgtacagctatagatacctatcatgtacagctatagatacctatcatgtacagatatagatatatacctatcatgtacagatatagatatatatctatcatgtacagatatagatatatatctatcatgtacagatatagatatatatctatcatgtacagatatatatatcatgtacagatatagatatctatcatgtacagatatagatatctatcatgtacagatatagatatctatcatgtacagatatagatatatatctatcatgtatatagatatatatcatgtatagatatagatatatatctatcatagatatagatatatatctatcatagatatagatatatatctatcatagatatagatatatatctatcatagatatagatatatatctatcatagatatagatatatatctatcatagatatagatatatatctatcatagatatagatatatatctatcatagatatagatatatatctatcatagatatagatatatatctatcatgtatagatatagatatatatctatcatgtatagatatatctatcatgtatagatatagatatctatcatgtatagatatagatatatatctatcatgtatagatatagatatctatcatgtatatatatatctatcatgtatagatatagatatatatctatcatgtatagatatatatatctatcgtgtatagatatagatatctatcatgtatatagatatctatctatcatgtatagatatagatatatatatctatatatctatatctaagatatatatctatatccatacatgatagatatatatctatatctaagatataatatatagatatatatctataatgtatagatgtatagatatatatcttctaatgtatagatatagatatatatccacctatatatctatatgtatacattggaaggttagaaaagatgagaatgggtaggaaacaattctatatgtcaccttgttataggtggttgcaattatacaaaatattctgatcatcatattcttgaaattccattcacttcattttcatggtatcaacataagagataagcttaaagctaggcaattgtcaacatttcattctattgtttctacaaaaatggaaattcctcacggttctgcctaacaactcattatagcctaatgaagattttggttaatatgtaatgaagatgaagtataattaaataattccccacagctaaaaagttaatgtaatatttaataatgttgttaattatataaatttaaaaatatatcagcacatacgtggtagggcaatgtatcacttattaagatggacttctcctttaatgggtgaacatttaaaacataagtaaataatgaagtatactaataaaatacagtcaacataataattgaatttcaaagtctattcaacttgaaatgtcaaagaacttcaatctgaaatatcaaagaacttcaaccatctctattttcaaactcaagtggctataaagtagtttttaaaattgaggtaaaatatacttccaggaaacgcacatgtctttgttatataattcaatgattgttgacaaactgttcactgtcacaagtagagcccacaccccggatgcaggcataaaacattttcatcaatatggaaatttcatttttcctcttacattcagtttccatcccttccctccacaggcaacttttctggttttattaccataaattcattacatctgatctttaactttatataaatggaattatatattaggcaagctctcttaaatttggattctgtctcacaatataatattttcaagattcacaaatgttttatgtttcagcaagtcacactttttattgttgggtagtgttcttttatacaaatatgttataatttatctctccaattaatggacttttggattgtttcaccttttggctaatacaaacaaagctgctatacatattcttatacaaaatattttgtggacacgtattttcattaaacgtgataaaacagaaaattcctaggttattaggtaggtatatgtctgacttcatataaaagcactaacgattgttctaaggtgattgtaccattttatattcccacagtaagtgagcatgcaagttgttacgcatccctgtcaacatttgatattgtcaagttttgtaattttagctgttctcataactatttactggcatctcattgcggtttcaacgtgcatttccttgaagattattgatgttgataaacttttcaggtgcttttttgaccatttttatttcttcttaataatccattgaagtattgtgatgattgaagtcttagtgggttttttattatttatttagaggaattcagtatataaatatgtttagtgcatcatatgtagtcttttattagataaaacaatttttaacattttccgctacagagttcatttctgtatgaaatgagctgtagctttcctttttattttcataatggtactttttaataatatcttatttatcaatgttatttcctcttaggattagtgcttcgtctatcttaagacaactcagtatatctgatggcagtaagtcactctcttacattagcctctagttttttaattgggtctcttatatgcccaagtgtgagtgtgaggtaagagtgcagtttcactgatatactcattttgatttcaggaaccacttgattcatatcttgtggatatactgcagaaggtcaaaaggtgagaaagaagaggaaagacagcaaagatcatatgaaaacacttttccagagttttgagaggtgattgcaatgaaaaggcaattataaataaaatattaactttgcttccatgaagccagtactcatgctatataaaaaatacatacatttattcaagaagatgcatttacacacatataagtgtatatacacatgtacaaacataactgtatgtatacatatacaaaaatgtcactatagatcagtatttagaaattttttttactatgtttgtatttaattatgggacatctgtttataaattcgtgttggttgaaatttagtaaaatgttgtattttcctactctttcctattttcctttgttcatacagacatagtcaagtttataggtgcaaaagaagaaatgtggagtcaagctaaacatatcatatatataaaaactctttagtagatccatttatatatatgggtgaataataaatatgccatataaatgtaatataatactttttcagatctgaaaaagttaacaatctttgtatagtatgcttaaataattagaacatgaaaaacttccaaatgccattttttattatcctcaatttgctacatagtttaatagttttatttaacacttcaataaaaagttttataatgtatttatttgactatcataagaaaaagaggaatagcacataacttacctttcacaactgattctacagttttttttctttgatcacagcatttttttttatactttaagttctagggtacatgtgcacaatgtgcaggtttgttacatatgtacacatgtgccatgctggtgtgctgcacccattaactcgtcaattgcattaggtatatctcctaatgctatccctcccccctccccccaccccacgacaggccttagtgtgtgatgttccccttcttgtgtccaagtgttctcactgttcagttcccacctataagtgagacatggatttgaagaagtaaagcatacatgtaacattaggtaaaatggatgatctaaaatatgtgactaataaaaccttatcatttgaaactgaatacatcaacttttcattggtacagtaaagaaagaccccatttggcttgtacttgtagcattgcagaaaacaagttatgtatttgaggcaaattttgcttccttatctgacagttaagtctgccagctgaacgtttgacattctgtgcattgttttataataagctgtacaaaactttactcactgctaaatccaattttcatatctatgaaattctatagtgaatattacaaatctctaatctaaatggacatgaggctaggttttggaagatcacagtcctgaatttaagctacattgctgacttgctatataattgaaaaattaatgcaactttcctgtttctcaaatatccttatcaataatggaataatgaaaatgtctggggtataagcatttcactctgaagtccactatttgtgtaaccttgtaaaatcacttgacttttgaacctcaattcttttgtcactgaaatatggagaaaaacatttgcagttgatgctacaggctttgtgctaagatccactgaagtatatggcgctatttatattgtgtatgagttgtttccatgtggaaaaagaacaaaaatcagtggctagacatgaaaattcagcagagagcagaactttcaacaaacttattgatgatgatacagtcatcctttattggaataacattatatattgggaatacaagaagtttaatgccatgagaagttatactgggcaaatcacataccttaattttataatatgtcaaaatattattgttccggaagtgttttgagaaacaaatgagcttacacaatgaatttaatgcaattattgacacctgtgaagtgcttgagaaatagtataaattctacaaaaagtgctgggacaactggatatccacatgcaaaaatgcatttggatccctacctcacaccatacagaaaaattatctcaaaggagatcatagaggtatgcaatggcttggatatggttgtctccaccaaaaccaatgttgaaacttgatctccaatgtgtcagtgttgggcctagaagaggtatttgggttatgcagacagaaccctcatgaacggcttggtgatattctcgtgggagtgagtgagttcttgttctgacaaggtaagaacagttcttgaaggaaaagattagttttgttgaggtagtttgtttttaagcaaattccctcctcatgtttggctgtattttgtacgtgcccacttcccctttgaccttcttcatcatgttttgacacagcacaaaagccctcaccagagactggtgccatgcttctgctatggcccccaacaaccatgagtgaaataaacctctttctttataatttatccagccccaaatattccttttatcacaacacaaaacagactaagacaatttaaatttcatagctaaaatcataaaaatatttgaaaaaagcaaaagagtaaatctttataaccgtggttgaggccatgcttcccttgatatgatacaaaaagcacaaggaattaaagaagacggaaaggttaaattttaccgacattaaaaatttttctgctgcaaaggataccaccaagaaaagatagtccacataatgagagaaaatatttgcaaatactacatccaaaacggtctaataaccagaatatatagagagaacttacaagtcaacaacaaccacaaaaaccctaacaattaaaaattgggaaaaagatttaaatagacatttctccaaagaagacatacaaatggccaataagcccatgaaaagatgctaaagatcattagtcatttaagaaattaaatttaaaaccacagtgagaaaagccacaatgagataccatttcatacccactagaagggctatcactggacagatgataataggcactggcaaggatgtagagaattggaaccctctcgtgttgcttgtcggaaagtaaaatgttagagatatgctggaagacagttttgcaattcctcaaatggttaaaattactgttaccctgtgagtaaagaattccactcctagtttttctacccaagaaaactgaaaacatatagtaacacaaaaactagtgggcaaatattcatggcagcatcattcataatatccaaaatatggaaacaattcaagcattcaccaactgatgactctggacaaactaatatagcatacacattcagtagcattttacgggtcattaaaaatcaacaaagtactaaggtatgttggaatactgagggaccagaatcattaaagtaagtcaatgaaaaatcacaaaacaccacatattatgagatctcatataatacccaatgcctagggtatagggtggggagtcagggtagaacagaaaatgactgataataggtacagaacattttttaggggtgatgaaaatattctaaaatcggattgtgatgactgcacgatgatgtaagcatacaaaaattcatggaattgcacactttatgtggataaacttaaggatatgtaaattttatcttaataacattgttttaaaaaggtaaaataaaaatatcctcagatactgcagcattcaaaaaataattactatgacaataaagaaagacattaaagaagggcttatcacaccttgtaaattcttaaaaatatacatgatagaggcataaaatgagtttggaacatctacatggatgagatttctgctatttttccactttaaaatactattgccatttattatagtaattcctattatgttatacatctgtatatgtgtgcatgtgcttatagagatatttaattgaaagggacaatgttgcatcattttcaaacaaacactattattctttagacatttttttcttattaaatttgtcagcctgatacataagtatcaacttcattcatgtgaaattgatgtgaggtcactttctaagctcagtgggaaatacatttagcagaataattttgccacctacttagttaaggggagaaatacaggcttattgcaggatgtaattcaccaactgtttatataattttaagcctttagtaataaagcaatcatgagcttgtcactttacttctctactcatgacacttcaaaacgcaataaaatatagtgcttgacaattttaatttattttaattaaaagacatcccaaaagcgtgatgcaaatgcttgaaaatttaaagcttagctccctttgctttaactaaagaaatgttcgattcgtttctccatcaagtgaagggcacttttaagcatccgcactggcccttagatgatgtggtctttaaaaagaatagtttgatttgacaaaggaaaacaggaattttgaaagaacctacaaaagaaagacttgaaaataatcagccaaaaatgttcatgatcatgttgtagggtgaaatatttattatttccttttgtaatgataagaacaatgaaatccagaaaaaaatgcggaagatgaataaagtggtggcaacagccttttggtctatctctatcaaaatgcagtgttctctccatcatgctgtctctttgaaggacttcattctaagtactcatgttctaatcatgctgaaagcaatataaaatcattcatttgttcagaaataatttttgagtgatgacttgtgtgccaacccccattctgactgcttggcataaagtcaggaacacgggttctcattgcataaagttgacggtttagcagcagctgggtagggagatactgctatacacaaatacttcaatagacaagacaagacaagacttgaatggtaagctgatcactgaacccacgctggagaggaaacaggtagtgtaggtagagcttgtggtcaaggagattactcaaaggagaaaatattaaaccccaagttattactgcttcagaggctgaataacaagaagagcccatgcacagaaaacccaggggctgggcccaggacagaggtacgcaggagcccacaggtgggaaaggctcagatggttcatgaaggagaacaaagaccagtgtgtctgcagtggactcagaacatttgagcctggaaggagaggagggttcatagaggccagagtggcaccacgcagagatttgttggtcagaattaggagtttggattttattcaacttcagattggaagccagtgacgaatcttgattagggtcctgaagtaatttgagtaacatttggaaaatatctttctgcctactatgtggagaatggaccactgtagacaccttaataaacatggcaaagaggtgtgaagctactgaggagaggaatttgacttgagtgacaatagcagacaaggagagaaggttaagagacaaagtttctctttttttctttttttgaggtggagtcttgctctgtcgcccaggctggagtgcaatggcgtgatctcggctcactgcaacctccacctcctgagttcaagcgattcttcttcctcagcctctgagtagctgcgattacagacgtgcaccaccacatccagctattttttttgttatatttttagtagagacagggtttcaccatgttggccaggctggtctcgaactcccgaccccaggtgatctgcccacctcagcctccagaagtgttgggattacaagtgtgagccactacaccaagcctagagacaaaattttaaacgtcaattcaaaacatttaacttgcaggtgcagaatactaaaataaataattttttttgtgctgagaccagttgaaactctaatgcgtcttaaaagaagcagtatcaaaaatacccagtgtgaattaaccggacacaaataaaaaatacattaattaaattttgttccagaaaatgaaaaatactatttttctaaattgacatgacttactataatggactatggaataatggatttgatcactttattaattttaatagctataaaacatttacgcatcatgttgctataaatgagattagcaaaatgcagtcacaggtccaattttttcttttatgcatattttgtagtatctttttcatttaaaaaatcactttacgataaaatgcacacataattcaaaatagaagtgaaagaaaaattaagagaaatgtgagtaggaagaaaaatgtaaacacatatatttgtgtatgatatttgcttcaactgatcatgaaattagcctttaattttacagtagctgagaaagaaaatatgtttggtaatctaattattcatatctaataattgagtacaacacatcataaagaaagggtaggttttctttcctgttacatgattataaaaaagtagcatggattagtgaaaaatgactactttagagtttcaggttagtagcacagtaatgaatgacttctccacctctgtggccagagaagcaattgttcgttccactttcacagttcacttcttctggtcttgaagaggcctggttggtcatattcacactggaatataacaccacttaggcacagagaattagaataacagatactacgggaaccccactgttatgaatgggaaggggtctagaattgcctcagattccactaggacagcagcatcccattcaaagagaccacaatattccccaggactacaacatgacaagggaaggagtcagtttcctgcgggacaccagcatcacaagggaaccaaccaccatttctcctagggcatcagcatcgcagaggaaggagccacagattccaccaggacaccagcctcaaaggcaagaagctacaactttttccaggataccagaattacaaagagaggagccacaagttacccctaaaaccctgtaatcacaaggaaagaagtggtcacctctcagcagctctgagtggagcagaaatgatctactccctccctctttctgacctccactctgattcctgaccatgttcagggatgactctgagtcctggaacactttcatctgcagtggaaaagattttttgtttgtttgcaagaaacaggtgaaacctttctgaatcagttttccagctaagagttatacctgtagaaaggatattaccttggtggggagtaaaatgaaggcaagttgggtatttgattgtactactgtaccattgtgtttcattctttcctatctttcttctttttttaattcgagaatcttacttgtttgtgatactctttgagtccgtcccctaccccagtctttgtgagtcatctcattcactctgtgcagaattaccattcaagccttttcaacttcctttatgacaaaaatttcatgcctcagtttcccagatttctattctggggcaaaccaaacacttcttgtagtggacatgctcaccagaaagcactgacacacctgctcttgaaaggctccttcttcttccgtcttcagattctaggcaagacttttgctcaggcaaactgggggagacctggagcagcttcattgcacattaacttcttcaatggattttaatttataattggacaaaaattgttggtttagtggtctccaatatgccttttagttgtagtatttatgaaagcatcaaaacagcacagttctgcctgacacaacccatcatataagataccttgggtcgtccattcaaacgcagagtgctttggatttttcttcctctcagattatggagtacatgcaggttgttttcacagtaggatggaaggcctagttttcattctgtctatcgtaatgatggccttaattctttgggtaattaatagattctttacaaccaagtatatagaaatgaaaataataaccaatatgcccctgaagcctgtgggacacaaaagcgtgtgtgaagccctcaagcatcctgatacggccatggcctgaataatgaaggcaatttgaagctatcagcttctataactgagtctccaaaagaaccaacacagagccacggtgctctgtgctttgaggcatattcactcactacctacacgcacacttatcatagaaatgtaaactcctgcagagcttcttcccagagtagtaggaacaacatcaataatcaatgtaagtcagcttcatatgtgcatcagacaatgcgttgagcacttgaataatcttatcaaatcttcaaaacaatctaatgagaggtaatatttccattttaggtatggaaaaacaaatttaacaatgaagacaagtaatgcaaaatgttagttgttttagctactaaatactaggtgcagcatagttcagaactaccttttctaaccatttggtctagctagcagacacaatgtaatctagtaaccaattaacagtagttagagacttaatataatttaatccagtagtagtgaggtacttattctaattgtcagataggatttaatccaactgcttaatctgatgatttattctagctactaggtgccagataaaactggctagagggctagaaatattgtaacccaggcagtctgactcacaagtctggtagcttaattattactatccatggcttcccccacgcactgggggaaggttaaattgactttaatagggcacatttcctaaagaaaagtttaaccttgatccacagcctttaattttctcttgtgaccttctaaaatggaaattttcatgaagaagccaggacattgataaacctatatttaatgccatagtaatttccattctttgatcaacagaaacttaagcaacctataccgcatgccagcaaaataaaatacagtatctggttttgtacttgacaaagagaaaagtaatagaaagtgattaatctgggaatattcccaagccctttatagaaattcaatactgtattcagcagaggatgttttctctgattttttttatatgtgtaatgaaaggcaaagatcactgagccagaaatgtcaagttatctttgaaacatgaatgcagcattaccagggcagagcttcaacagatactaatgatatgttaattagttaattgcacattttaataacagacttacaaagccacaatttctttgtgtttaaataacataattgtgtttcagttgtgttttcagtaaacactgggaagttttcattcacctacacatctctatataattaagttttggcttttcttccttgagctataagggatcctaatgtctttattacacaggaatcatctttagtcatctatttttagttctctctctgagatatctagattgtcattcaggcagatgcacagaccctcactgagatcctagcacatttacaaatggaatgactgtgctcccttggggtaatgctaagtacaaaagcaatccccttcttgccaagtaatcacatagaaaaaataaattgtaatttttgaggctaggtggcttgcataacttgtcaaacaagacatgcagccctattcctgtgtcatttaaatgctttaaagtcgtctcattcttgagctctatttttaaattgccttttctacagaagttacagcagtggctgaagaaaatggtttgattatagaagacctgttcaccctcagccacgtcactcaggaatgcatctctgtgaaatcatctataatctctatgaaattaaaaaaatgtaacctattaaaattgtttttgcaaaaacatctgtgatctaaaatatactaagagatatactacaaaattcactaagtagtcacatttactaaggaatataaagatttttttcattgttgttctttttatattaatgggagcctctcttctctaaagacaaatttctggaaatgtttgggtcttggtatattcaaaggactgactgtgataatgacaaccgtggtaaaaagtaagttttactactcaaccaaaactcattggaatgagtcttcaaaagctgtgtttctctctttatacttttcagtaatatgttttctgccttatgaagaaagactaagagcatgctaccgtggtgaatttacatgcaaagtctgtctctctttatgatatggggagaatcctcatgtttgaaaataattgcacactgctgtcactattatcaaatactattgcatcagagatagttcctgagcccaagggacttaggtcttgtttgtaggatatttctgaggtttggcactctagaagttcccacttgcgtaaactttcaactctctctctttcctagcatagccttgcaagaacacgagttagctttaggtagtttgtctcggaattggaaaatttcaaggggcatttggcagtagagcaaggctatttatttccaaaggaaagcgcagcccttaggtctcaatgagaattctgaagtcatatcagggattttaaacttctagtcaggcaagcctcaattccgtgttagtgctatgtagaggggtcgtttgcaagaagagccaaggcactggttaaacaggtttgagtcaacatgacatggatgattcaaggatgctggaaggcatgaagagatacacttagctttccaacagcccctggggaatcacgcagcttctatcatatatgacaacctgccaccgggcacatgctctgccctctattgggaatatcttcctctttccccttccagcccccacagacctcattcttactgtcctttactaatataacttctcacccatcaggtctccagttaagtttcacttcatctaaaaagacttctgaccagctgggtcaggtcagctccctttgccatatcacaacacaatgcacctttcattgaaagttcttgttcacgatttttatcgataaatatttgtttacgcacttgtttatcactgttctactcactaggctctgtttcagagaattagggactgtaaacctttgtttccttctccatcaaaagtgattagtacaaactacctggttcctggggatagttcatactgggctgcgtgatccttcagtttccttttaattgggtcatcccagaaattagtgggttctcaaacattgccatgcatcggattcactgggagagcttgtgaaagtgtagatagttggccccacctgcagagtgtctaattcagtctgtctctggtggcggctaagaattctcattctaacatcaggtgatgctgatgctgctaatctgggaaccacacttccagagacactgccacgaatctataggtcttcaaggaaggttttcctaagaggggagttgagacaacaggaaagtattagaatggggggttctatgtcattaggagaaaatgcactgttcacatactgaaaacgcaagaatgcagacctctagaaaaactggtgagaacgtcaatatcacccgttacgtacctttgcctttctcccatctttaatctaatcctcatttacttcatatacaaccaacatttacttactcaagggccttccaacttctttgctgcaggccaaaatagacaccagctctgactgccacatgcaaaattaattgctgccatgtctgtagtcctctgtcacacctacatatttttattatcatgcttgtcacatttaaatgtttattcagctgtctttctgccttggtttgccaagagtgctcccaggccccaactgactatcatagtgccaggcatatagcaggtgctccatacatgtccaatgagtcaggacagtctagtctttgacagtatagagaagttttcatagagatttcaaaaggaatgctggtacttccatgtattcctgatgtttcacaggacgaagacaagacaaaacccaaacaaccagagccactgggaaagaaatagtgcttctcagtcacaaaaatcaaaatgggatttgggaaatatggtgacccttcagggagagctaagtccaagtgttttcttgttaagaagggatcgaagggagcacgggaggacctgggcacactgcagactctgaggcagcctttgggacctggggctggtcatggaagaggtcagaatgggatgcctccttggtgtggtctgtaatcaaccgagggtcagtctacaagggttagaaggaggcttctccgacagttctcccttgtcactggtgactcattattgggggactggagtctttagtttataaaactttgagaaagtagcttttctgggatagaatagaaggaaatggtttatctcttgtaaaacattgaatttgttatgaaaaagccttggttcaattcctggctttggcaatgatcatggtgttgcatcactgggtccggcacatcatcaggctgacctcactctttgtaacacaaaattcaaagatggggccattgatctttaggctcctgttcagctttaaacgcaggcattttcaccctgagatgttgagaaaagtgcttcctcattcagccctttatctttgaaatggggataataacgtttgttctttattaatataagtacaagtactttaaagctatgaattaacactgttccatccgtttgatcactccgtcttactggcaggggatgaatcttgaattctaaagagctgtttttcctgagatcgtgataaaggtagttctaaggtgactcctctgtgtgtacctatgtccataactcctctatgatattaaatatccaacaggactgtgagatctgaattctttttctattcgaattattttttaagggagaagggcaatctgtgagtatgaaacacccaagttaattatgaaacttagagagcaattaccagagataagtttatgagcacggaaaactgctaacctgctataaccttcacactgtaccttaattatggacaattatggttttaaacttcagcctttacctgtgattcttacttgttctgatctatagaccatgtagtaaggcatttgcttcatgttcgacttactgggagtgggcatggattttatctagaatagacatttggtttttcccaaccgagtgcctgttgagagttttagcagagttgttccctggtgttccttgacaatgtgttcttttctctgcacgcctgaccacatcctcggtcaaggccatcatgggacaaccacaggcacacactccttcagaacccaggaccaggctcaagtcaggccattccttgccaccatctatgccaggaatcaatattcaatactagatggatgtttgtttttgtaggaaaattgtgaaagcggatttcacaatgcggcggagaaagggaacctccatggacaatagctgagtgagagatgaggagaatcagtgctatgtctacactgcttcagcaactttaagggtgttcatctccattagccaacacatttttgtcttacttaagccactatgtgttgtgtttttgctcatttgaagcctacaaagtcttaacaaagcacatatagataaaagtcctggaaaggcttttgtttgtttttgtttgcttcagtgtttttctgagatgcttacaacctaattcaaaccatttactaatcttcttatgcttagtgagaaaaaaaaaattccataaagcatttcacgatttcatcagtcactggggtaatgaataaaaagctacacaataatttccttaaacgggtgtccatatttgtattcatattcacatgacaattctgtaagtctaagcagtgagttgtttaataaaagagaccacatacaaacaatatatcgtttgtactcaaaagatacaggaaagggaacttcacaaaataaataaaataataatgcattgtttttggtggggactctaatctcacagggtccttttctgagctttgcctctcaatgagtcatgtgaatgacaatttgtcctcagcctctataccaggtagtgagatacttaaatgcagggaaattaaggactgttgacacctagatattaattaaagtgctcacaatgatgtggctagattaaaataagacacgatccccttgaaatggtccatgttcttttcacaacactgaaaaacagtttgtggggaagagttcaaaagctaagctgaaattcaactatcctcggagaccttgcttatgaggaaataaatacttacgctataaagggccaaaatggaaaatacattgactgacaaatctgtatcctagccacagtaaagaggaattaaggaagagattgcaacgcatgcaaatgacaacatgagctgtttgtttcctcagtagactccacaaacaccacatctccccaagtcttgcctattttaattaaccaagggtcaatgtatagtagctattgaattaactgtctttcctttgaggttgctaggagttttgaaacatttatttcatcacatcctgaattggccaacgaggaccagtttaatgacatgccagctctttcgtggctgtgataatgtgttttgtcctctttgataacgtcaggtatctatcatggtaaagggaacaggcagtgcaatttcttgggaggaaatctggaattaactcttagattacttaatggtatattgtgacagcatttaaaaattgagtgttgtataaaggctggtataccaagaaaattctattttaagctagtttttttttttttttttttaactagatgaagactttcacatatgttcccactggcattgtaacacaattacatttcaaagaaattcatgacataattttacttcagtcaggtatccttgctaataaaaaagagggtgaaattgtcctgtcatcattaagatagcaatcaaattgctatccatgcaaatacatttaattgtataacctttaatatctgctaagatatcatatgatctgttatactgcaagtaaatttgattttgcaatgatgtgaagtaaataaacagtctaggagatttaaggaggtgatattttccctaggggcctgtaaaagaactattttaattaagtctataagcatggtatttagtaatgtcgtatcttttggacttttatgtgcattaaaagaagggctggcgtgaatatgaagactgatccatctactctaatataacacaacgtaggagtctataacacaatttaacaagaattttaagatattttaaaaagaaattcttcaaactgcctttatgcaataatgaacatattatgttaattatacaaaattatttaagtggcttaaaagccctgtactttccaatattcaactattcactcctcctataccaaatggtccatggtccatttctggaggtatgagggatcaagaagcaacagaaaatgatctcactctattaatgtcttctgttactgaaaaacttaaagtatgtcttcttgaaagcttcgaagtttatgttttctatcagacaagagaaaaagaagagaaagtgatcgcttttcctttttgctactcttcttacttgttaagtctgttgcttctggagtcttttctgagaaatgtaagaccctgaaatatgtgattcttacctaagtaaaaggagaaccgttcaacagattaatgcaacagattaaaaactgtctttaaaataaagctgatgcttattattctgcaaaatgtgtttcaaattccctgaaggaagagcttgagatcagaacccatgttctttgcaataacgtaccagctcagccccagattctggtacccccagcgtggaagtcaagatgcaaactgcaagacactttcaacatgtttcccagctcatcagctcgtctgcattctgaatagaaatgcgatcttgcttatacttagttctgaaattctgtatctgaatcttgagtcatttgttctttctactcagttcctgcaaaccagagccagttatctgaccaaggacatctttgactctagatggctttacctcttatacattatactatatcagggagtaaacttaaaaacaaacacctgtcatctctagagcatgacagaattgtcatgaaataatgatttgcacactccatagctttcaactgtggccgaattcatcctcccttccgtgacgccatttggcactacctggagacgcctgtggttgtgatatcagggtggataccacttgcacctagtggtaaggccatgggtgctgctggacatcccacagcacacagaacggcctcccaaacaaagagctatccaacctcaaatgtgaatagtgctgagatggagacattagcttagccctctggtgatcgctgattctgaagtagaaatcttaacttaggtatgaatccacaacttgcatttccaatggactattctgccacgattttctatttattcgtcacggtgtgattatttcaagccaactccagtaccatgaagaagcggactccttcatactagacacacccacttgtgttaattatttaaagtcatggtgaaaataaatgactttaaaaaccgacactctcattacttctgaagtcagccatcccaaaaaaatgatctttgaaagacaatcatctgcataataattactaaattacaatagttacatagagactaaactaagcaatggtagaagaggcacatgaagatgtttgggaaaaagattaaatgtcccctgatatttgagctgtacattttttcagaaaataattagacatgggatattttgcttagtatttctcccagatatagggtgagaagctgttaagtttctatagtcccaggtcaacatagtttctttctttgctctccttttatgggaacatagagtacccatatgatttgggtaaagtgtctgaggatgtgtcattgataacagaagaaagaataaccaatggtgttgagtattagttcacttctgaacaaatcatgcattttcggaacacatcaggagttagagaactgtgttaaaacttacagatgaaattaaatctggaatgaattgagattaattatattgatagtataatacactgacagatattgtgccagtccctcaggtttctgtgtaaatataaaagttaaactcaaaaatatgtgtaagactatgtttaaacaagatatcaaacaaaataaaagaaaaaactgtgcttttgaaaaaatactgctttgaaattacataaaaattaatatgacttaaaaatgtctatcactgctagactttctttttttttttttttaacaaataaacaacctagacaatatcctcccagtctcttatcaatgatggtgactttttcatactctgaattctttggacttggagattctcatgtacataacatggaaagtcataaaaccacattgttcatttgatctatagtagtgagctagtgaacgggcctagaaagtctaaattctagcctttgaatcccagcatgtggcagagaaactagagccagtgatgctccagacttgttacactaaattatcatcaagagtaaatagaaagaggaaaaagaacaaataattcactggactagaaatctcatttattcctccaataggtttacttgatgaaagcattacaacatcaaacttaaaaatggcagtaagatattgtctgtgttattaggtccccgtgggttggttctgatgatgacaatacttgccttcctgacaaacctgccttcacctttaggtctctatctcattaacacaacaatcgcaggctcagtctcaaagaaaacaagattggataaaaaccttccctctgtgctctctgcatctgggagaatcacgacttttcagacagaagggcacgtgttatattcgatcctggttacggtgcattcattttctccacattaaactagccagttgttcctcattctctgcagtttcccttgctgtgttttcagctacccacagtcaaccactgtcagaaaataagtgagcacagcaggaaaagatattctgagagcaagatggagaagcagaccacattcacataacttttattattgtatatagttatcattgttctattccgttagtagctgttatgaatctctcgctgtgcctaatttataaattaaacttcctcatagatgtttatgtatagttaataagtacaaatatacaggttaatggaagaaacaagacctagtatttaatagattagtagggtgactgcagttcacaataatgtaccaaacagaagagaataatttggatgtttctaacataaaggaaaaacaaatatttaagatggatatctcaattacactgattttacctttacaaatcatgggaatgtatttaattatgaccagaaccttgaaaatatgcatacctaatgtgtgtcaataatttttttaaaatatggtatactgtatatagggtttggtactatttgtggtttcaggtgtctactaggggtttggaacatatttctcaggggtaagggggcactatatatttcactttccacacctcataaattctatatggtcctccctattctactattctaggcagcgaatcaagagaaagataaaccaacaaataaatgattaaacaggttcgaacaatgcttctcattgtgttgtaaagaaaaaacaattttaggagatgacaagagagaaagaaacagggtgaaggaagataatctgttgagatgaggtctctgggaaagagaaatgaagatcttatagagagagctcttcatgatgaagggacatgtgttcctcgagtagaaagagacgacccctccccctccccaatgaaaatggtcaattgtccactctggaaaggatctccaaatccaaagtggtcatatcttcttcttcttttttttttttttttttttttttttttttttttttttttttttttgagatggagtctcgctgtgtcacccaggctggagtacagtggcgggatcttggctcactgcaacgtcctcctaccaggttcaagttattcttctgcctcaacctcccaagtagctgggactataggcgtgcgccaacattcccagctcatttttgtgtttttagtagagacggggtttcacctcgttagcgaggatggtctcaatctcctgaccttgtgatccacccacctcagcctcccaaagcgcagggattgcaggcatgagccactgcgcctggccatcttctttatttagagtcacagaatatttacgggcaatattcatctggcattttaggaaaacactcccatgttaaaaacttaaagctcttctttaatggaactttccacttctctactctcagaaggtatgctgagtttcagaataaagagctaaggagaaataacttccagaaacagaggtcttccaaaagccccaatgcagaccaaagtcaggaatgtttaataagcacgtgcatctggccacaccaagtccagctttcccagagtccagagcatacccttcacggcttcacactaaggacattcttgctaagatgcagattcagccctgttaactaccagacaaaaacctggtattagctaagtggattcttttggtatctttggtatacttacttgtattttaagaaaaagcccatttttactttattttaaaaccttccaaccccaaaccacgactctcgttctattcggcttggagcaggcatggaggtccgggctcagccagcctggcaccatgttattccctgagagcccaggacccaaagagagtttcagctaagggtagtgcctcctctgacactcataggatgccaactgcacactccccacagctgctcctccatgaaaacgcagagcccaccccaagatgcagcccctgggtccgtgcagcacaggtgcttcaccctctctattcagagccacagggtgtagtgggagagaagaacatacacatgttccaaagaaactccctcatgtgagagagctaaaccccttcctaaggtctccaaatgtttactcttggagggaaatctgagtttcagaaaacagcaccaaacaattattaactaattaactcctcatggatcagctatccagtgagctcaatgcatgtgctaaatgctttcttaggcatgagagatacaactgcagattagaccagggtaggcttaccccaagaagacaggagactagccagcatgaagacgtgaaggaggtgcaagaatgagaagtgctagaaaagggagaaacagggtcccatgggtccccacagcaagggatgcccggcatcgtctgatgacagcaatgatgaccttctgaagaaacggcagtcaacaaaggaagggagatggaaaacacaaccagaggaatttgatcaagatagacagatggtgttaaaacacacctggcataaccccaaaacacccgacctacgtccctctttccctttgagtcgctgtttaactactgtgaatgacaagatcccttgcatgatttaacagccttgctcacacttccttcctgcaaacttgaaagcaagaccaccgcacatgcccacactcactcacactcacacccttcttctaaggggtttggtagttgacaaacttcaaaagagaggggaaaagctgacatcaatgatttatcactctcttttgacatccagattgacggtaaaacatttcctgtttgtaggaaaatggcacagcttcatagcttaaggcagagtagagagaaaagtgtaggaggagatgggggaaagatttgctggtctagcaggcggaaaggaatctgacatcagaggatgagtctgcccacagtgaaactcaatgtctcccaggctaacactatggacaaccctctttgggctgtgtagtcaaacacctctgcttcatacctttcagttataaggaacttctcacctcatgaataagtcacaggaagctatgaagagatgagagagtgacaggtaggagattcatgtcatttcattttatcattatagctaccctctttgttttgctccagaaagtcaagtttacattaatattttatcaacaaggtaaagaaagttggaagctagaagtgcttccaacttcaccttcaatcgtcggtggcactgctctttctattctccaagaatgctggagctcaaaagcgaaggtgatttctacacacacacacacacacacacacacacgtatgtatataaacgccaacatgcgtaacatatatatgctgagacaggatctcactttgttgcccaggctggagtacagtggagcaatcatgactcactgcggccttggcctactgggggtcttaggtgatcctccaatctcagcctcctggggaactgggaccacaggcacatgtggtaccatgatcagctaatttttaaaaattatatagagatgtaagcaatccttttgcctggcctcccaaagtactgagattacaggcgtgacccatcgcacctggcctgaaagtgattttgcaaggggtaaactaaatcaagcagggatccagagtgctataatagaggcagactggacaagacacgccacagcttcgcctctcccttgaataattcatcgtttcccgaattgctgtccccagacttgaatcccttcagcgtactttccacttgaacatcacagtcatcttcacagatagaaaaatctcattcgagtacatttccacttaagacgctcagtgattctgcattttcttcagggacagatgcactgcttgaatgcagtatgatcttgaccctggtcagtttaatttgaatgccttgcacaaagtgctctccaaagtgctgggtgctatatataaaccatgtttgttgaggtcaggggtcagccatatagacacacttcccagaccatgtggcaaatgggaaggtagaaatatgtgtaggatatgtgagctcagaagaggacacagtagtctaagatgaattcctcttagatatatggtgtttgaactgggatatatggtgtttgaactgagtaccaaagaaggactaaaagtgagtcatatacattagcttaggcctacacagggtcaggacaatcaatatcactgtcttccaacttgataccttgtcccactggaagtttgtcagggtcaacagcacacgtgaagctgacatctcctatggtaacaatgcctttttcttccatttgtcgttgttgtgtttttgtttttgttgttgtttgtttgttttgagatggagtcttgctctcttgtccaagttggagcgtagtggcgtaatctcggctcagtgcaaactctgcctcccaggtttgagctattctcttgccttagcctcctgagtagctgggactacaggcatgcgccaccgtgcctggcaaattgttgtattttttgttttgttttagtgatggggtttcgccatgttggccaggctgatctccaattcctgacctcaggtgatctgctgacctcgacctcccaaagtgctgggattataggtcacaatgccttcttcggaatacctccttaaggacctgcctgagggtgttctatcttttttttaattttttgagccggagttttgcttttgctgcccaagctggagtgcaatggtgcaaactcggttcactgcaacctccacatcccgggttcaagcgattctcccgcctcagcctccccagtagctgggattacaggtgtgtgccaccacacctggttacttttttgtatttttagtagaaatggagtttcaccatgtaagccaggctggtctcgaactcctgacctcaggtgatccacccgcctcggcctcccaaactgtggggattacaggtgtgaaccaccgtacccagctctaggttaacttttttaaaagtagaatgagtacacactaaaataacaatcaaaagtataggaaatacattaaccagcaacacagtcattattattctcaagtattatgcactgtacataagtagatgcatgagacccgtctaagactggcagcgcaggtttgcatatggcaccatcaccacacacacgcgcatgtggattatgcattctgctatgacgcataattatatggctacaatgccactaagtgtaggacatttttggctccattaaagtctaccaggagctgggtgcggtggctcacgcctgtaatcccagcactttgaaaggccgaggagggcggatcactgaggtcaagagtacgagaccagcctggccaacacagtgaaaccctgtctctactaataatacaaaaattagccgggcatggtggcacatgcctgtaatcccaactactcaggaggctgaggcaagagaactgcttgaacccaggagcgggaggttgcagtgagttgaaatcgcaccactgcactccagcctgggtgacagagtgagactctgtctcaaaaaaacaaacaagcaaacaaacaaacaaacaaaaagtttaatgggagaaacaaagttagtcatggcaaggaatatgggaaagtcacacggagaaggtaaaaaccatgaactgtgcttccagaagctggatgcgatgaagacaacatggagaggttttcctacatttccaggcccttctctcatgtttcccttcacattctttgctctggttgtaatacaacttctgcatcacagttcctcagaacaccatgcggtctgacatctctgccttttgacctatgctgttaactcttcctgaaatgtcctatgttttgtctccgatttttctggacaattttttttctttaagagcaaagacggaacttctcctttctgagccaacccttgaatcgtttaagcactgctagtcacttcattccttgactagacactctgccatgtgcctgcttccatcacttaacctctggacgcatcccttaaagagacatttacccttgtaagagcttgtgtctagggggaagaacaggtgttttaaatatccctgaaatcttgacatcaagtactttaaaagtcgttgaactgtatctatgaagcaagcagtaaaaaagagtctgaaaccttgggcattttttaggttgaatatctagaaaaagaacaatgccacaaagaacaataggtattcctaactgtaatttcaggatagacaagagctgctaggtactcatgcacagcaaagttaattaatgtcttccccgacaggcaattctttgcttccgcctctatcacttcatgggtttattggtaacttttttctctgggcaccaccttctgtcacccgctacctctacttgctttattacattccgtcttcatttatgtcttctcagcttcacagtcacggcaatgacttcctcctgggcaggtgacaccctaaagtcctttgggttttgtttggcaccaaagtggaaatacaggtttgttgagaataaagagaggatggatagttgatttgtggaacagaactttgggcttattttttttttagtaggcacataaaatgagctatgcatgtggtatttagaatttagtgtgtctaaatgagaaccagagtaactcactgtgcagagctaagtaaagactgtttggtattctatccctgggctaagaaaagttgaatcaacttttttagtatattgcccaggttccctttggttacgaaggctgagtcagctgaaaacataattcggcatcagtagtttatgatttctatggttccggaagagatttcaagaggaataaattacctgggatctcatggccctttcatacaaatgattctcatcccaaaggtataaactgtggcttgtgtcttcatatcttctttatctttaccacatcagagaactcacagtttgcaatattggtgggttattagtttaggtcaaaaataaataaaatagctgagaacttcaaagtaattcagttttgccagataatgtctggaatcgcttcctcctgcaaaccatcttctgggtgcatgtgtaacagggacccagtactctcatttttaatcccggttgcattatttaaaggaaagttaaatactgttagatttcaaggcaagggatgatatttcttatgcaaaatttaggaaaggaagtataaaacgtttgcaatttttatgcaacgaatgtatttttgaaccatttagcttatgcttgaatcaaataacattttgttataaaaataaagtataacttaataaaataaaaaatttacaattataatgcaatggatacatgtttgaaccattcaacttatgcttgaatcaaataacatttttataaaaataatgtataacaataaaaatacaaaatcatttacacgttttatgcaatggatatatgtttgaaccatttaacttacgcttgaatcaaataacctttttaacacaaagtaaacttatatgtttttctctaaaatacttttgtcagtcttggtcagtttaacataaatatgttaaaaatgacttgatcataaagatggtaatttaaaaaatttttaaattaacttaatttaaatacttttctgatcctcagtttcattgtaacgattaaatattcatttttaattctacctttacatctctggtaattttatacaaacagatcaaataatttagttttcaaatagttctgaaacctaataatgtttttgcttccagtctctgtgcctgaatattccctctgcccaaaagtctgatatttcattcttcatcctggtgatttgtagaaaacaaaaatgtcacagtgaaattagtctcctcatgctatgtcggaagaaatatctcattcaccagccgagtcaaacattccaatggaaatatctatagctttggagatgatgactaatttatcctgacagagttgttgatttatctgagaaagaaattccaaaaaaacaaaaaccaaaaaaaaaaaactgctgactctttcacttaattcgatgttaacaaacgggcacaacagcctaggaatactgagaggttgccagatactatgtgcaaagtttgtcaaatgacggcgatttccctcccaaagctcagagtggcaaagctcccaatgggaaagatgaatagacattacaatcctgtgtaacttttcattctgcacctctgtcccctaagtgccgtacctcatacattatccactagccataagcagccacgacacacttaaagcgtgatgagtctgaattaacatgcactgcaagggcaaaatacggaatgcatttctgtgacttcacaggaaaaacatacggtaagatattttattaatgtttttctactgattacatgctgaaatagcatttgttatatattgagttaatgatgtatattaatattaattttacctgtatctttttactccttttaatttggctactagagaattaaaatgagatgtggctcacattggtggctcacaatatattggacagcagagttctaaggtctaaactgatggatgagcaaattgaaaaaaggatttcaataaaatgacacagggtttcaattaaaacctgacacaggctttaataaaatgagaattgtaaagatttcagccctgttaattagcaccataaaaaccgcaacaatgattaatctgattttttaactgttgtttaataataaacacatatttttaaaatttttaaatatgaaatgtggcaggaaatgctagcactttttcatatttagggagacttcgctgtgatgagggcttctaggtatgtgtgctttatttcttcaggccaggcattttcgaggaaaatgatttgaaaggaagcacaggggagatttctcattctctttcccagaagctgtaggtgagggtttagcgtgctgattccctgaaggagtcataaaataagtgaatccaaagtcccatcaagagcccttgagaggccgggtgtggtggctcacgcctgtaatctcagcactttgggagaccgcgacaggtggatcgctggatgtcaggagctcgagaccagcttggccaacatggtgaaaccttgtctgtagtaaaaatacaaaattagccaggggtggtggtaggcacctgtaatcccaggtacttgggaggctgaggcagtagaatcgcttgaacctgggaagtggaagttgcagtgagccaagataaacaaataaacaaaaagcccttgagaagaaaactctgcaatgggatgcaggggcaggttcaggggtgtggggctgagggtggtgtttgattacctagaagagtgggggaagggattaatagaagagtacagttggttcttaggaaataaaagacaacagccaaatgcgactgaggccaagttttactctctaggctcaagagctccctcaaagacatagtagctagctaaggaaaatttccactgaagcaacaaggaggcgattggggccacatgaactgtggaaatgtagaatatattcaggcttagtccagatgatatggaattgaaaggctttaaatcccatttaaatatgaaatagacatatagagacgcattgtacactagggcaagatcagaaaccaaggtatcatgacaaaatcagacatgcaggtaagaattcattttgataaattccaacttaagattaaatgcatcgttttaacttggctttcagcaggatcgtattctttatcactttattcacttgcctttttcaaaggccaacgtgttgtctttcaaatggaggcccacatagacatcttttgtaacacccaagctatacacaactatgcttctgtaacaataaaccggccgtcagcagggaactcacactgcgaatgaatacatcaaagtgacgaggctttgactgagttgaaagccctgtggaggccttcacggtggagctggacacagttgctagaaagatgaagtgatgcatctggtcagcccaggcacgggtcacccaaaaataccacccagggtaatgaaggaggttgagattgtcttaactgggggcttgaaatgagctaaaagaatgtttgggtttgaaaattgcctctgatgcaaattctgggagagttcccaagacaactgatcatgagacacgagttattagggagaccgctcttctgggcttcccttgctcccggcctacagcagcacctttacatctcctaggcagggggaccatgaaagctcttctagaaccacattttcagatgttctgtcttccaagtcccggctgatatgagcgcctctctctgggttgagattaaccactggcccagcccagctttcctctcagtcccgttctgctgagtattacatctggattctctgtttatctgcagctcgggcatgggttttgaggaaccaactctgacttggtccttgataatttctttattttcaaagaaagagtttgtactgaatatccctaggaggactcacttataagcattgaacatatttttatttatttttaattttaatatttttttgagacagggtctcactctgtcatctaggctgcagtgtagtggtgtgatcatagctcactgcagcatcggcctcctgagttcaacccattctcccacctcagcctcttgagtagctgaaactacaggcatgtgcctagctatttttttaaatataatttatagagacagagtgttgctatgttgcccaagctggtcttgaactcctgatatgaagtgatcctcccatcttggccttttgaagtgttgacattataggcatgagccaccaagccagcctagaaacaatatcttctctattttagatgtaaaaaccgtaaaagaaaaaccctacatgtgctcacacagtttagaaccttaatgtacttatgttcttgaggtattacatattctcccaaagagtagggacaaacttgtctttcataccgactttttcatcaatagctaaaataaagcacacatatccttgcaatgttacatttgaaccacatgtggttagagtcaaaggctctatataaaagaattaaacaaaattaataactatagacaacaatttaaaagacattctgtttcagtaccacctgtacttagatatcaaatacctatatagttggaaaaataaacacatcttattaagcaaatattttaatagtgcaaaacctgtgtggtctttcacgacgtggtttttaacttgtaattcctctgtgacatctaggtttccccaaggcactgtcatattcctgaaatgttttctgctagatcaaagcccaagacaaaatttcaaattacatcaatgaaatgaactattcatatggaactaatctttctataaaaacctcttcgaataaaacatgatttttgaaagtcagataaacccaatttattgacttcattgtgagttttgtcaggatttattccatccacctcattgtacttcttcactatacgataatgaatagttgattgggaaaagactatcctataaattattgccagttacacaaatatgacactgtaaaagtcggtccactaataactcacagtgcatgtcacagaagagcacttctgatgaagtttcatccccatgggctcactcaaaggaaacaatatagtaagcactatttaaaagagaaaataaagtatctatcctgacattgctaaccaaatagccatcttaacataaacagaaacaacctcatgcatggcaagactttacaattatatggatttgtgtgtgatatactccacttcaatgagcaaaaagttatgccacacagagcttaattacatcctatacagcatgttaatagcccatatggcagaacctgggaacatcctaattgaaagtcacttaacatttacaaaggcaatccaagtttaaccagtatgcaatccttgatattcctggctagaaaagacactcttattatcatgaaaaataaatgacaacgttatgtaagatctgatggctcttccgaacatgcttattttcagtttggaacacctgtctcagctttcacttaagtataatgaatctataattaagaatctgttaggattttcatagaatatttagttttgaggaaactgcgttaccatattgtcatattgcaacagcctctgacttggaatacaaaaagaataaaatatataaaaacccatgtgaatacagaaaatcacttgatctttatcagtgtttcccaaacactagttatctataattcctctcctttttccaccttcttgtgtcttacagaacttgtcgtattgactctctctgcaaagcattcgacaattttcttccatttcttcctgtcccaatcccagtcatcgtcacacctattttaatccaagccatcgtcatctttctacggacctcttttcaggttgcttattggcctccctagtttggagcctttctgcaagcctcaccagagagaccttactaaacatcagtgaggtcctgtcacttcctcccaagcatccttccactgcacctcaagttacagcctcatgcctcactcttgattgcaaaactccacgagattttgtcttatctctagccccgtctcacatcaccaaccccatgttcactgtagtggccttcagctcacccattacttctgcacactggtcttctttctgtttcttacatatggcaacacagttccttagggtttttaccccagctgtttcctctgtctacaatcacctttctttttttttaaaaaaatgtatttttccgtaagttactggggtataggtggtatttgtttacatgagcaagttctttagtggagttttatgagaacctggtgcacccatcacccaagcagtgtacactgcactctatttgttgtcttttatccctcgccctcctttcacttttcccccaagtcctcaaagtccattgtatccttcttatgcctttgcatcctcatagcttagctcccacatatgagtgagaaaatacgatgtttggttttccattcctgagctacttcacttattctacaatcacctttccataaccaggtctttctggttactgagaactctgtcaaactataccccttcagagaagtttcaggtttcaacctacaacagtcagaatgagataagtcaataccggttccacatgaattcaggttatctgcagagcccttgccgccaccctgctgttcttgagtatttttcctttgtccctctgtcctgcaccagaacatgattacatgagtttgggagagttgctactcttttccctgctgtaacctccagtacttagaataatgatgggcccctcaggagagctgaagaaaaagatgtagaatgaattaagaattagagatgttctatgatgcaaatgtcctcgtatcttaacatgcttgagaaatatttggttgaaaatcagctttcttcctgtagcagttctcaaaattctcattataccccaattatgtgatttctccaagacaggaatattgaatgaggttttccaacacttctttggccactgaataagttcgttttaagaaagctctttttgaatattaatccgcttagaaaacactgttatgtgaacatctatctacatagatctattgggaaaatgaaggcttttctcctttgaaaaaaaactgatttcaaggaaaattaaaaattttgctcatatgttttttgtttatacatttgttttcctttgttaacaaggtaagtggatttcaggtctaactcttctaataactttttgggctgacttttgacaaatcaccttaattttcttctgtgcccgttttcttgaccctaaagtgaaggagagtaatttctctgatatcatttcatactatatgctccagagtttctcttccatgaagctgatttatgaagtggaacaaggattgtttgaggtaaaatatgtgaaatttctaaaggtgatcatacatgatagagcaaaaatcagcacagttagtcacattacagagcatctggctctggggcaaactaagcgtcagccttcacttgccgaatgattggtcgttggttcacatctctgctcagaggttgctttccctcaaggagacgttacctggaccgcttccaatcagatgatacccaggttctaattatacgttgactactgtgattgttttaacaccatttctttctctaagctctgcattctgtgcaactgagaatcatggagttgtgaagactgttatgtccttagtatctcaaagacctcctggcatgtagaaaccctccaataagttattattgaagaatgattgtttgcaagcaacactggcagaaaaatattgatttaatgctctgccatggccaatatcaatgtgcctaggaattcacactcagaaaacagagagaaaaaaaatgccccaattcctcccagacctgctgaactttgtgtttattaaaatataataattattcaaaagaacttaatctcaagatgaatggatatgcacgccagtaaaatgctaactgaaataaaataattaggagttattaagctctcctttcatgcatgcctaatgacagttttaagtgtgtcttcatcgaggttcactacgttaataaaatctatatttccttcctctcacctaaaattatttcttaagttctttctgagggacagttcacctaggacgattaacacatggtcaccttttccttcaccaaaaaatttctgcttgttggctctgaaggcagcttaatgcgcgaacagggtttgggtgttggaaatgtccagaagaaaggaatcaaatattgagtgtccaataccattcagaattaaatgttaacaatatttcacaaatgctttcacaattcaaaagaaacccaatttatctagagactctacattgatgagtggatagatttttcacaaaagcatgtggaaagttaaataaaaaaaacaaagttttgagagaatactgctcttagttattcctgctcgtcaggggagctgccctggggagctgtggcatgttgcatttcggacagctccatctgtctccttctggaattattaacagcacttgcaaactcgtctttccaacagagacaaatgattcttggaactgccctcacaatgaccaaagctatattaaaattccataaggaaacatccaggagattccttataaacatgatattgaggtactgaagcccacagtgtagatgcttaaaaattaattttggagaacaggctggaggaaaatgttgttttcatatgcctctgtgctcactacagcaatggaatatcccaaatgtcctctctaatattatagcttttcattgcactacttatgggttttccttcaaaaggaatctatgacaaattaaaatctttaccggcaaaggatatatgtttggaatgccaatgaatttactattgaaaaagaataggtttccaaatacagttctcggatgggtagcacaacacatagccatttgggatatttttgctcacacgcgggactgtgaaatgctgcccatcataatctggaaagctactgctatccttgttcatataacatagcatctttgtgattcaggtcatacaatatggtaacccagaaatatcaagacttttaaaataccccccagagattagtcctggaaagtttgcagagtgtattaggttttgtacatttgtgttgccaccatccacattttttggtaaatttttaaaaatctctgtccttctctgcgttgctcttatcactgttaccagcccttcttaatcaagactgggtatctcatgtgtggaatcctgccttatgtgcatgtgggcaaacagtaattctttagggctatttatgggccagcctctgaaaattaagaaaggcaaacagccgtggaggctgagtcacgtgggatggaataagctgtgccctgtccagacctggtacctgaagtcctgcgcttccctgcctgatttcccttattcctgagtacacgggattattttaatctttaccgttaaaacgcaatgatgttccttgttcaaaatatataccgcaaatctcctgtctaaaatatttagttttttctggtgacattttctcaattgaattattttaaactactatatttctctgaattgccttaattataaagcgattatgtaagataagattttttgtttcttgttctaaatgtgtatccacatttatctgttgcatagcatcacttattttaaactatttttgtcttattgtatatgtctgaagcaaaatcatttcaagacgtaaaaaaacaaaaacagaaataacacagcaatgatggcatgggttcttgaaggagtcgaagatttcaagtacttacaacgaaactgagattcaaggaccgtggacactatagattcatgactgtatttcagaacgaaacaaaaataggacttacaccatgatgacttctgataactaaaatatgatcagatttttaactttccatctgatccagattagaaataccttcgccttattaaaaataaaataaaaatcaatttgtatggttatagaaacacgtagaaacatctatttggagaatccaagaagaaaacccatattgcataagcaacacaaataggagtacgtttccttcaataaaattattaaatattttaacaagtgaatatcaataattgagaaatatagacactgttttctttttatattaaagtgtcagctgctaagttgatactataaagtagtgagggctttccatttcatggcagctgtttgaatgtttctgatttttatttttattttttcaaaaacaacttcccactacagggagcatgtcaaacgatcaacttcctctctttaaaatttcaggaaagtatataatcactttaatttgtccaaagaatttttaatcaagaatttttttgtccgtactgtaattctaaccatattacacatgttgataatatctgcattttgtcattacaacactgatatctgtttattttatgtttcagatttctattcggaaaacattattctaagcctctgggccattttatatacaacggcatttcctcacctcctaaaataatttactgcattcaactccttttatattttaattttgccatattttatatcataaatatgacagtttacaaatcatttattaatgctatcttattttcctactataacaaagccctttcctcattcatattcagaatttttttcaatgaagaagcactttttttgtgtcctaagtggtaatcaacttttttgtttttcataattttgatgatactttgaacaataatttctttaaaacacatggaagtgtctctcacaggatggtgtttgtatgggacaactttaaaaataaattatccttttcttcaatctttctgactggttacatatatataaggtctatgttggcacttacatggataatttttaaaatgtggccctggttctcttctcttggtaaacttggaaaagagaggctcattaaagataaaacaaaatggttaaacaatataagacgtttttctttaactcccaaactttgatttgaagtgtagttgtaaacaccaagtctataatcctattttgtgaaatatcaaatttatgtattattggttggttgttgctgttgttattctttcaattcacctttcctatacggtttgaacaccacttttcaggtgaattaaggatttaaatatttaactcttgacacggtcactaatgtaaagtttggtcactactgaaaaaatattatactttgatttcctttcttaaaattgtttttgttttccttacatttctaattgtcttcaattttactattgctttatctatatatacctattttttacctattctatcaacagttattttaaaattttttttcttttattttgtaaagaattgctcctaaggccccctctgtccatatattctcatctgtatctagggctcttccaactgacattccatgacttccctttaccctctgtggatgtggcttactcactgcttataggtaaggtggggactgagtttaaccttgtctgcagttaatcaaccaattgtgcctgcacagtaaaaccccaaataccccctggaagtggggcagactcactgggcttccccggcaggcagtgctccatgtgtgttgttccaggtcagtacctcggtacttaaggggagaaacggggtagaagctgcactgtgcgtctcttccaaaactggctgatttaaatgtatcctggctgtattacaaatatataaatgtaacaaatgtgaaggtaatacgtttcagagagttctttgagtctttttagtaaattatcaaacctgatggtggtttagggatccacagaacgtgtagttggtgtcaaaagtcttgggcagattagaaatttggacggctccattctcggaggtggagccaagatggcggaataggaagagctcaaggcaacctacaaaatgggagaaaattttcacaacctactcatctgacaaagggctaatatccagaatctacaatgaactccaacaaatttacaagaaaaaaacaaacaaccccatcaaaaagtgggtgaaggacatgaacagacacttctcaaaagaagacatttaggcagtcaaaaaacacatgaaaaaatgctcatcatcactggccatcagagaaatgcaagtcaaaaccacaatgagacaccatctcccaccagttagaatggcgatcattaaaaagtcaggaaacaacaggtgctggagaggatgtagagaaataggaacacttttacactgttggtgggactgtaaactagtccaaccattgtggaagtcagtgtggcgattcctcagggatctagaactagaaataccatttgacccagccatcccattactgggtatatacccaaaggattataaatcatgctgctataaagacacatgcacacatatgtttactgcggcactattcacaatagcaaagacttggaaccatcccaaatgtccaacaacgacagactggattaagaaactgtggtccatatacaccatggaatactacgcagccataaaaaatgatgagttcatgtcctttgtagggacatggatgaaagtggaaaccatcattctcagcaaactaccgccaggacaaaaaaccaaacaccacatgttctcactcatagctgggaattgaacaatgagaacacatggacacaggaaagggaacatcgcacctcagggactgttgtggggagcggggagggatagcattaggagatatgcctaatgctaaatgacgagttaatgggtgcagcacaccaacatggcacatgtatacatatgtaacaaacctgcacattgtgcacatgtaccctgaaacttaaagtataataaaattaacaaaaaaaaaaaaaaagaaatttggatggctccacccttaaccccaccatttggctaactctgggtgattgtgtgagttcctaagagtaatttttcagtctaggagttcttctgttccttagttcttctgtacctttagtgcctctgtaccattcgttttttccatgaaggctttgataagacttttttcaacatattttctccgtaggaacaatatgggtccaggaatagaacttttggattaagaccttgactctcttattatttctataagattctatcatttctactgtcctcattttctgtttcattagctttttctaattgtttattgattttctatgtctctaatttcttaattatctttttaaacttttacctatgtaaaaccacctcctatcctttgaaaggtgtgaagttatttttttcttactatattcattgtctcagtttattatagatttttccacttgtttattttgatcatgtcatcggacattctttaaatatctttaatatttggttatctgctcttatttcacaatgtggcattaaaaaactgattgaagcttgtaacaagtcaaagcagtttgccagttttgggtttacttgacaaagatctatgaggaactagctatatccttgtgggaatcccaagggtctaaatacaaagatgttttcttaggtgatggaaaatttctccaatgcagaaatctccaatttctgcattaatagggaaactgtagaggagatgtagcagagattgttgctgtatatactaattttaagccacatcttaccctttagagcaagaactaggatggagtgagtcagaaaagtggtgatattgaagcttggtctttgaagcatatttaagtaatttatatttactaaatggtatttgacctgaatcaaattacacattcacaacatgagacacgtgagttcctgtaataacctttgttcaatatggttagaattgggaaaataaacagattagcagagtttcaagagacaatgaaattcagggcaaaaaaatgtattttctcactgcacaatcttagtgttttatttatttcttctcacagtttaaataattttataactcaattaaatatgttaatatttaaatgttaagtatttaatataacttgactaaagcagttctttaacatttttttttcaggacattattttcctagttaaatctcaatgcactaaagttggcaaaaataaaaagttttataaaagaaaacagaactaagatccttaattagctactttaagtgaagttactcccttcttggtggccaggctgggtcaattgatgcccatgggtgattttcaacatgaagagctaggaagaacgctaccattgagtagattaccattcagtattaaatgcaaaaattgaaagtgtagtcactaaaggaaaaaaaaaaatctgttcacatcagtttcacagtctgtggtcaaagaaaacattggccaattattccagaatagatgtgcatagctaaagcttattcaaccctttgtaatatcattttattagatagatgaatctcttcaacaacagaagaaaattagattgcaactagtattcatttctacatcagagccccaggctggagctatattaagccactaaatggtctgcagaaaattgaagtagcatgcactttgatctcaaaggactgcctacgtcacatatgacaggcatttataagagaagagatgtcctcctgggacctaatgctgaacagcagaaacaagatgtgagatcctgaggatgcagagacatttaaaaaacaacacagcccccaagataacattaccaataatgatacttgaaatgactgacaagtaagtttagaagtcttaatagaaattctagcgtttgtggaattttctgcggattgtaagaaaatcccatcctacataggcacagggatgtctgctcttgagtaggaagagtaatagaggttgagaacacataactaccctctccttaaaatcctcctggctcctcccagtttatcagttccatctttgttttctcagactgcactatccactgacaaagaaccagtgcttccctctctatagtcgcaggaaattctattgccacagcttcattccaacctcacaggactagttttcattttcttctgtcacttggaaatgcacagatgaatatactgtttttcaaataaatgtcctttaatttatttcttatttttcatgagttgaaatctaaactggcttcttggacttctgatgccctccccaactaattatcataaataaatatgtatgtattgattagtgtgacttggaaacggttgtagggctttgggaaagctgtagcagaaactggaatttctaacttgggattagaaaacagccgcaaatatcagagtcctatactaagtattgcagaatacaaatgaatcagacacagaccctgccttcctatggatagataactatgacagaaatatatagtacaacctgcagtcagaaattcacaagtctgggcataatggctcacacctgtaacccccaacactttgggaggcaaggcaggaggattgcttgagtccagtagttccagaccagcctgggtgatgtcgtgagacactgtctctactatatatacgcactatatatatagcctatatatatagagagagactatatatagagggagtgtaagagtatagactatacatatataggctatattatattatatatagcctatagatatatagcctaggctatatataatataatatagcctatatatatagtctatatatgtactctctgtagatatatatagtctctctatatatctatagtccctctctatataaatatttatatataataaataaattaatatataataaattaatattatatagtataatatataataaattaatattatatagtataatatataataaatattatatagtataatatataataaattaatattatatagtataatatataataaatattatatagtataatatataataaattgatattatatagtataatatataataattatatatactattaatatataatattaattatatatactattatatatactattaattatatataatattaattataatatataataatatatactctagatatgtatagtctctctatttatatataataaaaaattaatatctataaattaatattatatataatatattatatatcatataattataatattatatatttatatgttgatattatatatatttattatatatataaaatatatagcctatagatatatagcctaggctatatataatataatatagcctatatatatagtctatatgtatactctctctagatatatatagtctatatatctatagtccctctctctatatatttatatataataaataaattaatatgtaataaattaatatatagtataatatataattatatatactattaatatatattacttatatatactattaatatataatattaattatatatactattatatatactattaatatatattaattatatatactattaattagaatatataatattaatatatactctctctagatatacagtctccatatatatttatatataataaaaaataaatatatataataaattaatattatatattataatataatatattatatattatataattatattatatatttatatattaatatatatatttatatagaatataaatatatgttaagattttatatattatatatatattataatatataatattaatttattatatatattaatatgatatatatagttgcccactgcactccagcctgggcaacaagagtgacacttcaactcagaaaaaaaaaaaaaagaatctatctccttcatttgggagctgttgtggagaatgaacaagtctctttaaagcacttcgcttgctgttaaacccatgagtgctgccactgctcagagagtttatatttgttcccagagaagctggtggccaaactagagaccaaagtgcacagctaaatggagggaacattatggcctcttctacgggcggcagtttctaaggatcagaacagccttttgaggtagtaggtacctagaaggaattcacagagatgcagtgatcttctgctctggatatttggagactgaagcattgggtgagatgttgaaggatgcatttaaaggtcatgtcaaagctaagctcctaagagtcctatgtttctaggaatcctctgggttgattttttaatatataatagctctgcctatactttcaatgaatattttcttaattgttaaaaagacctattatgaacagcttgcttcctttatacttaatgttttctcaacatgcctaagctatcaaagggccttcataaagtaactaaatgcttctgtatgtttgaacctttgaaaaaaaaagagacagcataaattagccaaatggtgaaacagatgttcaagaatggcaaagctcacgcaggaggctgaggtgccaactagcatctcgctgtcctgttaacagaaatatccttgaaaactctagtgcacaaatatgctgagggagaataatagtgtgtaaataagcaaaatagataacgttgtactttattttattgtgttagtagcaagagtacctcttgccctgaacataataggcattcaataaatcattgactgaataaaaaatataggcaaaacaaaacggtagaggaaatgcattcatgtaattcaatcaaaatgcaagcatgcctccttatttcaagttaaaacatgtgagtgtatgtataggtgtgagtttatgatatatctgtgtgtgtgcacttgctagtgtataggatattgaggtcactatacagtgacctcaattcttttttttaattttttttttttttttgacacggaatctatctggctctgtcgtgtaggctggagttcagtggcaggatctcagttcactgcaacgtccgcctcctgggttcaagcaattctcctgtctcaaccttccaagtagctgggcgcctgccactacgtacaggcgcctgtgactacgcccattaatttttgtatttttagtagagacgaggtttcaccatatcggtcaggctggtctcgaactcctgaactcaggtgatcctcctgcctcggcctcccaaagtgctcagattacaggcatgaaccactgcagctgtccggtgatctcaattctttggtacatgagtcttagggcaaaattccaggacaaacactaaactacactgattgatgttaaatcaagtattaaatagaacttttccaggaagcctggcactattggccccctcatgagggtactcatcgataaaatggtggaaattgtgtttttatgtatgtaatacaaaggaattccatacaatttcaataaacttgtttggaaaggtttatattgaaaagttttaaatagttcatgagcttgattttgaactatctttaaaactaaattaaaaaatgcatagattggcaaaataaattggcatcaagtgcatttttggacttctttaaccatgctttcgttatgtggttctcaacctcaagcaatgtgtttgattgcttttatggagaaaagaagaaaacaacaaaacaatctttgacattctttcacttgcaagaccaagcactgcattccccattcccttttcattgctcttctatgatttgtggggatgtctagggacttgtaaaattccacaaagcacatatatcaattaaattgtttatcacaaaatcaccaaatattagcactagaaaggattttagaactggatcctagtttttcaggtcacacatttttagaggttcaaataaaaaaaaaccatgaatatgattctaattttagaacctagtgattataatatataatatcaaaactacaatagttccctcctagctttaactgagctacattaataacatccacagacaatgaaaattagtaaatacgtgcaaatcagcccatgatctgtgttcaaagcaccgagactttgcatcaagctagcagctcctcaagggtcctggcccttgggttggccacactggccacggcaaagcctttcccatgggatgatcttcccctagctgatcctccaaaaagaaaaggaaagttactgcttccaaaagcagtttttttccatcgtgttgcagcatcaatttgtatatcgagttaaaagctcctttctttctaatgcatacccttgttcttaattctgatagttaataaaacacacactaaatgtaactggaaaacacacatgccttcattctgcctaattcaaccccgatctcttctccttgtcaaacaacctcaggttttcttaaaaactcgttttcctagcatcattgtaatattcccattttccaagcctcttgtagaatcatctgcttgtccatttctctgttaaacattcaaaactaattcccaatcttcttatgaggttctttcacttttcattccagtagtttctattggtacactctgactcaattaggttttagatacccatatcaataccactaataatgtatacttaaacaaaaatcctgacagttggctgtgcatgtcttatagtctcaagactatattttaaacagatgttaaatgattttattctcattgttcattactagtattaaatattttttggctaaatttctagggaagaagtgggttccaattgtagatctaggtcagaaattgtaaatcctggggacacagtagtagaaataacacataaatctcttgcctatatggaagttacatcaagaagatgttgacagctagagtttctattttttagaacactcataaattatgttgcatttcaaagagcatttgaaactaaaaccaaactaatgagaaacctgcaaaaaatgtgtcaagattaaaattgggaaacagaaaaaaaaagaagagttaatatttgatttcaaaactgtcttttaaaaagttggaatgtcagtgttcaaaaatacattagcagatggctgctacaataaatgggaatataggattaatatcatttgtttcacaaacttgacattacaaataaaaatataaaattttaaaaacgcactgaagatgttcctagaattgaaactacaaaaagtcaacattagctcactcaattgtttagtttgctcagtttgatttctaaagcaaccctgaaaagtaaggattattagtattcacattttgcacatgataaatgttgtaatgagtttctatttcagtatcgttttctctttttatttattctttagagagtttgaataaatgattccatagcacatctaatggaatcaattctcaatttttcactgtcatggcttgtaaattgtttgtttccttgaaaaccttgctttcccatttttttgtaattaacacaaaatcatctgctgataaactactccactaaaaatactttcgttgtttgttaatgagtttatctttttatactaatctttacctcattgaacgaaatcgtttgaagactttatttactgaatatttattgtgtgcttacagtatgtaattataagcaaagatatttcagatatttaaagtcaaagttggtttcagagtaattaagaataacagccagccaaagatcaaaatgacaaattacactcggactttgtgtacatgaaacatgagacagatatgagaaaaatgtgaaactatataaaagtaaaaaaaaaacaagttattcacgatgcttttatgtcaatgcatccagttggaagtttaatatttgaatattttaaagagaaatttgttataggataccatggaatgcattttcaaagagacaggccacggagtgagtgacgggagcccacagtgggtggaacacagacctagtttgagcactgaaaggaggtggctggtcttcgggaaatgttttaaagcatttgattctcagatccaccatctgcaaaatgtgcatgaaagtaatacttccaaggcttgttttaggaatcaaatggatataatgtaccttcgaaagtaaagagggacagatattgtgagtacaatttagagtaacgtaatttacacccagcagaactttccattgcatgcgcacaaggttatctgagaacaatgatgaggaactcagaaaatgtactcaaacggccaaatgtctagcatccagcactgataatatgtagtcattgttattacaatggcacaatgttaatataattaaatttccatcccactctcaacaaggccatctaaacctgcccctcctaccatttttattatatacataagaatagtactttaaaaattttaaaaagacaatattggcattaacttagaaaggcttatttttatttcctctttaagaagggtgttgaagaatgagtctggcttgtggctaaaatctctgttgagagcaagttcctgacggatgggtgggtgatatttagtgagtcaaggaaaattaataacagcattggtggatcaatttcaagtcaatgacaatacttcaggaagtcccagaagttctatctggtagacacacatacacctcactcaccaacaaattattgacaaagaataattctagaacctttacactatgatccataggaggtccagggagttgatgtatggattcagagagagcaatctctttggtaatgtgactaaccgtaacttcatcatcttttagcagaattgtcacagagggaaaaattggatttttaggaaagtaataactagaggccaatgtcatttgaaaaggcaagggggtgtcctcccatctgcagatggaaggagaacggtgggtatgcagctggaaattcactatttgaattcatcattgtcgggaactgcagcctcactagttttatttctgataaactgaaatacagatcttccttgacaatgaggtcatgtgacctcagaacttatgagcgaaacatactctgccacttctgttcatagaagaatcagaacagattttgtttttgtttttgtcttttgaagggaaaaatgtctcttaaaatttaaaactaaagttttttctaaaattcttgtcaatatttgtctgtgcatttaaaaactgccatcagaatgcttgatttttattttaatgaattaagattttaaagatgtgatatgcagatactgcacaaactttaaaagttaacaaaggttattgatgtataattttataacacaataaaggtctcctgtgattagactttcatattatagtttaaaatgcatacatatatttagaagcaagaagtatcaactataaggcaaatctgtagacattgaattgaaggcaggaagacagtttatgggaattagaaaacacataccgttaggaaaatagtgcaactatgcatctcctaacaatggagatacattttgagaaacacatagtttgctgatttgtccttgtgcaaatatcgtagagtgaactcacagaaacctaggtggactagcctaccacacactgaggctctacgatacagcatgttgctcctggaccacacacctgtactgcatgggactgccctgaatactgaaggcaatggttacacagtgatagatatctatgtatctaagcatatctaaccacagaaaaggtacagctgaaaaatcagcataaaagatagaaaatgctacacctgtacagggtacttgccatgaatggagcttgcaggaccagaagttgctctgggtgtcagtgaacgagtgattatgaaggcctaggacatctcagtacactactgcgggatctataaatgcagtgtacttaggcacactaaattcatttaaacatttttttgtcttcaataataagttaactttagcttactgtaacattttgtattttataaagtttttgatttttcatcttttttactcttacaataacacatagctcagaacatactttgtacagctgtataaaatatcttatttctttatatttttattctatgtgctttcttctatttaattttttttttactttctatacttcttttgttaaaaatgaagacacaaacacacacgttgtcctaggcctaaacagtgatcatcaatatcactatcttccaccttcacatcctgtcccactgcaggctcctcaggggcagtagtacccatggagccgtcacctcctatgagaacaatgccttctggacatcttctgaaagagctgcctaagactgctttacagttaaaattaaaaaaaaaataataagcagcagtagacttctataataaaaagtatagtaattatataaaccagtaccatggttgtttatgatcaggatcaagcattatgcatggtacataagtgtatgtgctaggcttttatataacacactatacgtttgttgccaccagcatcatcacagatacgtccacaatgcaccacgctatggcattatgatcgctaccatgtcaataggtgataggaatattccagctccatgagaatcttatccaaccacctttatttacatggtccatagctgattaaaatgtctttatgtggtgcatgactctacatgtgaaatagataaacatatgtaagttttgattagccccaactgatcaagaagatgacagttactcaaaataaccttcctctcagttttttcacgtgtgaaactcagataagcatagaaagtatttcacaggaatggtgggtggattaattgggctagagcatatgaaatgtttgactttagattaagttgacatttaaaataaatattcacaaacattagcagttattatcattaactcaccttatttctttagcctaaggatttatttaattatttatttagtttgagatggagtttctctctgtcgcccaggctggagtgcagtggtgcaaccttgactcactgcaacctcgactcactgcaacctctgcctctctggttctagcgattctcctgtctcagcctcccaagtagctgggattacaggtgcctgccaccacgtctggctaattttttgtatatttagtgcagacagggtttcatcatgttggccaagctggtctcaaactcctgaccttaggtgatccacccgccctggcctcccaaagtgctgtgattacagccgtgagccactgcgcctggccccaggatttactttttaaatatgaattttccagatccacagcagatcagatgatgcctcttagcaatctagtctcaggtttagaagcccttccagggtgggggaaggcaggatcctaagaggacctccatgctcctgaggtctcctcctcttgcaagtgggcaggacctgtgactggcttttaaccaataatgcctgaaccttacaggtggcgcggtgtcactcttaccattatgttacattacagggcaaaggtgaagacattttgcagatgtagaaaggtccctaatcagttgatttttaagttaatccaaaggcagttgatttgggagaacctgacctacttagaggaacccttaaaagtgttccaagtcagagaaggaagcagaagtggtcccctcctgctggcctcccggaaggcactgcccagtgtggggagggacagttggctgcgagcagtgggcagttttggggtcctgagcatctcagccctatacttgcaaggagctgagttccgccaacatcaatatgagtatggaagataattccagcctaaggtgagatcacagactgaaggagtccttgactgctgcttcttgaggccctgagagaagactggggtaaggggtccttgattccagaccgatggagccccgagaaaacacggatgcactgccttcagctgctgcatttctggtcatttgctactcagccatggaaaaactaatacagaatgcttccttatagcaagtctcaatccctgacactgcagttccagctccatatgttcctttttatcataagtgattaggaaatatagttgggtgccaataattgcacatcaaacctcatcttgactgatttagatgtatttgctcccattatgcgctccctatagctagtctgacttttcaactctatccgttttctctccttataaataaaggtaagtgcatattttcttggcttcaaaacaaccaatgatttttatttattatttatttattcatctctattctgtgtatcttggatggggcacttctttcctgacacatgtttttattttgtctaatcttcttaccatcctggtgatatttctctctctctctctctctctaaatatatatacttacttagtgctcatattgaatttatttttgctgtgactgctgtatgtggtggatgagaagttggcattttttacaggcaaaagccaatgtcaggaacaatcagaagttgtcaggacattgatcctgcccttaatacctgcaaatcctcagctggacccaagtgttctgcccaacaggggagctcattctactgcgatcccactaacaacagagatcaccacatcaaaaggagcaatcttattaaagagagtaactagaaaaagactcattttttttctcagccttctctaggcatagttggtgttttttaaaacacaattaggagttatttcaactaatagttacttaagttctctgagtacttaattcagttaattgatctggatttatactttccgattttatagcaaaagcctgagaagttacttaatttactcaataccactttaatttcacctttgtgctgctccttgtaaatatgtactttgaactgctcaatttccctcactgttctaaagtgcagagaatagatggaatttaattttaaagccagatttttcatttcagatcctattatgctccttgcaccatctgtgtgatctgatctctgaaaatgcaatggtcttttaggtggtcctgaactacatgtgtctaattataattgtcaaatatttagtactgtagaaaaaaatgattagcagcgattttaaagaaaaagtggtactttatgaaaggatgtttataaagcacacatttttttcagtccagaaatgctaaagagtgatataaagaagatacatatctagatatcatatacatatatcatatatatatgatatatatatgtatatactattgcaaaaatatactcctagttaatcttataataatggactttcatacagaaggttctctgctcatataaacttaaacttagtggcatgcagttttggccctcaatatacaagattccatttaacagttgaagggatacttttgtaacagaaagttacactgaaagacaaggaagcctaggatgataaatggaggtgtcttaaacgatgacattaacttagtttgaatgaaaaatcaacctgggaatggttgatgagaaaatgatggaaaagaggaataaaacgaaacaaaaccacaggaacacgggtgcatgtgaatgtgcacagacaaagatacagggcggactgggaaggaagtttctgcaccagaatttggggagatgaagtggagagaggtggggtccactacccgcagctgccatcacaggcgccaaggaaggacggacgaaagggagtccttgcttaaatgtcagaaagtaaccctgctccttctggcggttactccttttagttacatctgaattggaatccatcaaataaatgagtaaatgagtagctcgacggttagaatgacgacttcagcagaaattggtatctgcaattcaaatgagttcagctaatgctccacatgggaaaagaacagtgattcctgggcctgtctgctggagcctacctggggaacaaggtcgaagtccccagggaggggtcgattttagtgatgttgtcaactgctgaaatcaggatcggcacaggaaacacagggtgtaaactcaatctttatgaagctcttgtacaaatatcttttgagaaatgatatgtttttaaagatgatattgtgagacagagtatatctttttttgtttggtttttgtttttgtgatggagtctcgctctgtcgcccaggctgtagtacagtggcgcaatctcagcttcctgcaacctccacctcccagttcaagcaattctccagcctcagcctcccaagtagctgggaattacaggcacccactaccatgctcggctaatttgtgtatttttagtttcacgatgttggtctcaaacttctgacctcaggtgatccaccagcctcagcctctcaaagtgttgggattacaggcatgagccactgcacccagcaaagagtatatctttttgatacatttgggcgatgtcgccattcttagggcatatcccttatgaatttcaagtgtctgctgtataggcaaattttgagactgtttacacttttctttatatcaaaggctccaaacaaaagaataaaaaaccaataggtaagtccaaagatagaatcaatatgtgcacagtgttctctattttggtttcaatagctttgttttccatagggtctcacccctgactctttctactatccttgccttttctctttgtcctgtaagcactgacactgaattcaactcctcaaaattcgcattaagcctggcatggtggctcaggcctttaattccagcattttggaaggctgaggcaggcagataacttgaggtcaagagttcaagaccggcttggccaacatggcaaaaccccatctctattatggatacaaaaattagccgggcatgatggctctcacctgttttcccagctacttaggaagctgaggcaggagaataacttgaacctggggggcggaggttgaggtgagccaagatcgcaccactgcactccagcctgggtgacagagtgcgactctgtctcaaaaaataaatataaataaacataaaaaaataaaacaataaaaaaattgaaattcgcatttatacacatcacaggggtgtgccttagtagtgtgtgaaagtccagtcaaaggaacaaagctcaaaagttactgaaggataaaaaatgatagatactctacagactcaagaaagaatttatttcagcattattatcacaggaaacagagtttaaagttttctaatttaaaagaaataagaattacttcttttaacttgttgttatataaaataacagatgagtataataagtgcttcagcttagataaatatctatgtgtttttcctgcagtgatgctcacataacaatttgtagaaatgaatgtagaaggaatatttcaaatctatttaggtataattctagatatcattaaagatgaattgttttccatgtaaaataagatttctgaggagctaatttgtgacaggatatattatgatatcagttttcaaagcatgagcctgctcattatgctagaaggtagaatatttgaaataatgaatttgcatctagacaagggtgcatatcagggcaacacaaagtctttagggactggtcttttcatattgacattacacacataaaagtgggaaattccaacttgatagcccatccattccccaaatggccatccctgaaccacttttgttatctcttttggcatggacatatgtagcactaccaatttctcagtgctgagtattgcacttctactcatcaattatctcaagggaaaaagtacaaaaagaaagacctagtgtcttgagactttttggctctgtttgatcaggtggtccctgaaaggtgagcctctgcaccttgagcagcaactccctgctgcaggccaagggagggcagggttgtctctactttcactggagaaaaaaacatccattgctaacttaagctttaggtgatagacaataagaaacaaagaaaagggtgaatagcagaagaaaagagaaaaaagcagaagataaataattaaaggaaagagagagaacaagaaggtgaggaatgaagagggaatgtataaggaagtgaccacaagtcaggtgtgagtagaacacgtggttctaaggatgagagactgagggcgccaggagggtcgggtgggagcagacatggccatgcaaagccagtgggctccatggatcagagattctggcggggtagaagtactgggggcctgagcattgaagaatatgtgagctagagagatagcaggttagagagaataattcataaaactgagagcatggaggggctgcaatcaccggtgaggacaagttccctggacctgtatgaaaaataagaatggttgaggcagactggaggagatctttgcagaaaaggaattcaagaaacagaggctcaggttgttgcaaaaaccatcgatacaaatactctataagaatacttgattctacaagaatctagtggaagtacggagagtatgtccctaaattcaaggactgggaatggaggcgcaggaacatgcaccagatgtggggaggtggtaaccatcctgtaggcagtggatgcagcgaactcctgccccagaatcagaggtggggtttgtagggagcaagggagaatggcccgaaggaagcagtgcaggataagggacaccctctctactcccagccaagtggatgagcatgtacagtgaaccacactcccctgtgctgctggtcaagacgtcgggaagagggtagggctgcagggctgcattcagagaataagctgggatatagaagatgctgacagttgacgataaattccagaaaacatagtagatggtgttagggattgaggaaggtgggaggagggatggagtagaggacttactcgtgtcagctatctcagcattcacaaaagcagaatcctggcttcatcaaagtgaccaaggggaaactgaggcaggccaagatgaatggtgatgggggtggggaggagcctttggaggctgtgagggacgggagagatggagggtcaggtaagcgtctgcatctcccgctgcacaggtttgtaggatccattccagcctcttctgtctcctccaagcgcacgcttcaacaattctccgctttctgtaacccaccagggattcctctcagcagaatcaatccctccagcatccacgcaggttcctatttctctcattttaaaatattttatcttgatcccaccttcctcactaaatattgctccatttatttgcaccgctttatggcaaggctccccaagagtgttcttgacttgacatcacctcgtccccaacatccaactacatctcccgtcctcatgtcatcagtcgagcaacccacgtcactccatccaatgcctgccaccctgacctcatcattcttgatccaaaagcagcagtggcagcaggtggctgagcccgcgtcccttggcttcaaggacactcctctgagatgctgcttcccttccttcacgattgcatgttttcagtcttctttgttggttcttccttttggggattcattcctgaggctcaggagaaagctgtgagttttctttgtgatcttcataccctgatcaatttttcttctcacctgacacttattatttcataacatgctccacaatttactttaaaaaggtattgttatgtaatgtaatgcattggtatagcacgctctataatttactttaaaaatgtattttcttatttactcccaggaaatggtaaactctgtgaaggcaaggatctttgtctacgttgttcacagacacttctcaagcatcaatatgactgccttgttactagaagatgctcaatcaatatttatgtaagaaagtgattatgaaaaaaataagttaaataaaaaagaaggcacttatgaaaaaagaaggagaccttgtgcccctgtgagcaatgctcctccgaaggaccatcttccctagtgtagaaggtggcagtgtgcagttggataagcctcagtaaagaaaccacctcggggtggggggagcagggaaggacagcattaggagatatacctaatgctaaatgacgagttactgggtgcagcacaccaacatggcacatgtatacatatgtaacaaacctgcacattgtgcacatgtaccctaaaacttaatatattatactttaatatattaatatattatactttaatatattaatacattaaagtataatatattaatatattaaagtataatatattaatatattaaatatatcatgtcaatatatttatatatttaatatatgatacataacatataaaatattataaatatattaaatataatatactaaagtatatgtatattatatttagcatataatatactaaagaaaaattacattatactttatatagttatatattatacttatatatataaactctattaaagtataataataataaaaaaaaaaaaacacgtcttggaaatggaccaattctcatgctttgggaacacttaaaacatgtgaaactttcttaaaatctcaggagtaatacatttaactccaaaatatgatcaataattcttgtaaggtgaaattttagtagtgtgcactgccctttttattttgtagtcttttttcagataaattcttttccttttgattttaagaacacagataatgaattaaagtatcatattttcagtgactttttaatgctactgtttaagaatatccaaacagtacaacttcaaaattacttggcacacgttatagctgtattaacttttgagatacagataatacaggcatagtggcttaactgcacgggttatgggcagtttcatttctgcttacttagcttttctatctccctgcactggaactccctcacccaaggagattcctaaatctggtagctccattgtcaggccttatgatatagaatctggacaatgtggaagagagggggatggagagtgggcgagaagggagtcgggaagatgagacagcgggggaaatgagtaagagaaactccagagggggtaaaaaagaaaaaaaaaagatcgattaagaagtggtgatcaaaattcatatcgagctgttgattataatattactaaacataacaaaaacagggaattgttaaatcaattctaatccatttcagagtaaaatattatatggacattacaattcactcgcaaagcatttctaacatgtaacaatgttgagaacgtgatgctcaatggaaaaacatagcatacatacacacaaatgtccaggcccagtaatccatacagccatacacattcggaaataaacacaaaaacatgcatatgcagagagcttgagagaaatgagaataccccaaaatatcaagagtatttacctactactcttgaagctatggttttaaatatttttctgtactctctattttcataatgtttctaattaagacaaattactttcaatataacaaagatgtattattaaaactaatggacaaggctgcgacagctattttgtaaaagaagaaataaccatagatttttactatattgcatacaaaaatctgtctttgcaatttaaacttgaggcattaaaaattatctatattttttcatccagaaggaaatacactcacatcctaattttaatttgctagtctgaacaacagaacaaaataaaaacaacaaaaataaaagcatattctataaaaaacaaaaaagtttaaatatcagaaattctattttcatggtgaaatgtgctagttatgaagatataagctcatatgtcaaaaaacttgttttttaatcgccatgttgccactgtaggcattaatgagtttaacagaaatactgattaactgagtttcagttggtacaatgccagatgactgagtatgctaattcctatgacagtttactgcttgaaacatgaatttaattttcctgacttcattaatcataactgttatttaccatataacagcgtaaccattttcttctactgagaaaatttcattttcatgggtcatgcgatgtgaaatcctagagtctgctgactttctgagtaaagacaagctttctgtagaatttttactagtagggtattacgtaaacatctttgatttagagttcaactgcatttattatgacactttggaaacattgtcttattttcttgctttatacttgcattgccaaatctgtacgggtgagataaatattgaatcccagaagcatctccctactactgagtttcatgatatctgtcagtattaatcaatttttttttgttttttatatctagacaaacattaccaaacttttatgtcattcacatcatactgtggaatggtttggatctgtgttcccacctaaatctcgtattaaaatgtaattcccagtgctggagacggggcttggtgggaggtgactggattgtggaggtggtttgtaatggtttagcaccatcctcccagtgctgttctcatgatagagttctcataaaagctgtttgtgtagcacctgctctctctcttcttcctacttggcccatgtaagacacacctgcttccgcttcatcttccgccatgattgtaagtttcttgaggctgccccagaagctgctatgcttcctgtacagcccgcagaaccgtgagccaattaaacctcttttctttataaattacccagtttctgctacttctttatagcaatgcaagaacagacgaatacatactactcctaacatgctgccctatgagttcttaattggtgaggaggagaactgcatgaggatcaaatggaaatcacgtaataaatgcaacgactgtccacatcatgcggcactggggcctgagtatggcagactgtattctaatttgccatattttatagtccttttctatggtgcccctccctgcagcagcagtaaacgtttgcaccccagggaactcctaagtgcccacatggccagtgaaagctgggaagatagggtatgctgtttcctcaaaaatctttcaaagcctgtgtttcctttgccatggtgtctttgtctctgaaggagactgagcatattacagatacaggctactccctcaggctggggcccaaagttaacagaacaggcaactgagccacagcagatccagcatggacatgagtcatgaaatgaacacttgtaactactcagactggaggtggtttgctaccacagtgtagcctagctatcctgacaggtacaaagaatcaagtagaatttggaattttttttatttgcacagagaaatttttgtaatggcatggcaatgattagaaatatatatcgagggcttcttgtatatcccacacttacttcaggaaaaaaaaaattaaaaatgactaagacacagctctttagtcataaaagtaactaagacaaagttgtctacgaagttagtgtaaaatgatgggataattacatgggcttcatgaaaaaagtgccaaagttgtacaggagggagtaattaattgatacaacctaggtggtagagttacaagcaatatttacaaatggagtaatctttaaactgggcctttagcattaggagggtttttcctaattagggaggtgagaaagacctggcaagttaaacaaaactacacaaacaaagctcctaagatttaaagagattggcctatatttggaataacaagtgaaaaacaaaaactgtgatggtaaatccaagccagatgggaccttggagaacttctggacaaatatcccacctatatatatgaggatacctaagtccagaaatagtagatgatttgcttaatattactccactggaaatggcagagtcgtcttccacacctgttctgtttctacgctgtgtagacgtgaggtttgtggtggggccaggtggagttcacagagcagagggtggggacacagatggtccgaatgagtggaattttaatacacttcttagattcttcataatcttcaaataccaggtgtgatgatccatttacaaagacagtttttgacagagcttctataggtaaaaatgtgaagagagatgcaatgggggaaaaggatacaacaccaggccagagtagaaaagagcttattcttttataaaatacctagagttacctttgctgagtgagagattacgtgatatgtaacagggattgcttccgtccttaaaattgaccaggctttggcttccagccaatcaaataaagcctacactgcatggtgacttctctgtataaaattgttcggcatggtgcggtctctgcacaagattgctctgcacatgtgttcttggaaaaattagtgattatgtgttgatggttgtgtctgtaaagatagcaatttgtgactgtccaattgaattttaataacatagtcaaatcacttcgatcttagctatctctcactagaggtagaaatggaggctttttgtcaattaagtaattttttgactctctatttccattctttaaaatcataattcaaagtaaaagttatataatattttgctttgataaagtccacagaatgaggatgggccttatcaaaccctcaggatttcattaatatgaataaaaacttcaaaggctcttcttttgagaaaaatgcttaaaatatttcatgcttgaccttggttttataacaatgatttaaaatgaattctatgctgtttcttaccttttaaatcagtttttaatctatgtttcatttaagccatataaaactactactctatctttagataataattccaaccatttgtagaaatggaaggcctacttaattttgaataaaagtgcatagagcaaggtgttaactgcataaatggactactttcacgagtagtcttaaattaataattttcaccaagttctcgaaggcctatttaaaacattacctttttctatgtatttaatgctgttataatcttcaggagaactttttttttttctgttcgtaataccccaaataaaatagtccataaatcagattacattttcaaaataactttggatgttacactcctgtataacttatttaggatttaaaagcactgaatcatttcttctaatgttatcgggaaataacatgacttgcatgttgcatttttgtttctgtagaatgctccagtaggatcaggtttatcgtgacaatgtaaatctatatattttacaaatggatttggcgagttggttgaagtcagtttcagcagtggaagcagaattaaagtataacgacatcaatcccttcttctactccacaccttcatagtgctatgaagtgttccctaaaagaccttattataagtgaaattttacattattcatgtgttatgtgatattcatcttctcatccatgcacattcaatcagaagctctgagtactatgattcaacctatctctactccacacaggcatagcactgtgccagacacacaacaggctctctaaatatgtgcgtagcagaggagtacgtgggaaagccaccattcaacttctcaagtgaacgccattcaatcccactcactggtgagtctttctagttttccttcaacacctatccatggcaacctacattcgctcggcctattttttgtcactttcattctccataatattttaggtccagaaatacttctttttataaatatctttggaaatatattttgtttacagatgtgtagtaaagaatttggctccaacctcagaaatgcctggactttgtgcttggtttctgggaggagaatctttgccatacttatatcttcgtttacagcaggagctggccacagttggatttcagggcgaggctaactacatctaacaatcttagtgcgaagttgggtcatgccagaaagaccaaccatgttatttatggtgggagctttggtttacatgacgtcagttgacctgaagagtgagttcaaccatatgggcaattaatcaatgagtcgtgcctacatagtgaagcctcagtaataactctggacacagaaacccgggcagtcttccctggctgacaatcctgaatactgctgcatacttatgctcagaggtcaatgcatcctgattccgcagggaacaggcaggagaagctgcacatttggaagcctcctgggtacagcctcaggcatctcttcttcagatgatgtttaacatatattcttcttctgtaataagctataaccatgagtgtaatagcttttcatgaattccatgagtcccagtgaattttcaagcctgagggtggttttgggaaacccaaacttggagtttgtttgagaagtaagaatgtgcttgtggagggtcatgcccttgcgctttgcagtatggttagttgtggataataggtcacactttaaaaagtttgccttcatattgatcccctttgaagcttagaatctaatacatattaacccctcatttgatagagcaggcagtagaaagtttgagtgattcatatgaaagtaggaacagcaccaggtcgtgttctccaactgcctactctgtttcagtcagaccattgtgaagttactgagaactctgcccttgggaaacgtccataaaaacaaagatcttttagaatttcaacacagccagcaagtatagggcaatttcagttcatttttattttatgatatattaaaaaaatcatcagtcaaaatggactcaatgtttctatgttactaaaacaataaaacttttttttcctatttgaatgtaggagtttgctaatatagtttttaaaatgtacttgaagttcctttatgcaaggtaccttgtacataaattactctggtggcctggatttaccaatgatatcagaaaatacgcatatgtattgctaaccatattacacatcatatatgaacataagagacactattagttacagtccattaattttcaccataatccggttaattattatttttcttattcttaagaccacagaactttgtaagatgaactaaatgcaatacacgctaatagcaaagtccacattttgaacccaggtaagtttgaagggagagagtagagctgttttactctgcaacacttaactctaaccatagttttctggtgaacaaacgtgttctctaagaaaaatatacaatcatgaaaagatccaaagttcactttaagttcaggttagcactagaaatctagtctctatactatagaattatttttaaaatatattttctagttgatatacttcatgcaaaatgaaatgacaaatgaaagacaaagcatggaaagtatgacagatatgtaagttttccttgtatgaactgctgctcttaatttgctcctctcccctcctttttcagtatcagctgtaatgccaacttctagtgagctcgaaaacaggacgtggctttctatcatatgccaaaaacacacctttaacacactgtccttggttccttcatgactcctcacctgtttcttggcaacgaggttcagttgtctaatgtgattgcagtcgcctgtgggtttctaacggagaccaacgtactatgtacctgcacttgagaagatcattaaaccttcctttgtcctacatgaatattttatcttggctggcataactgccgggctccacaactctgataaaagtaaaatatgagctgtcttagcagacagcattgttcatggtgaaaataaccctgattggtaaattgcatctgactgggggtactatgaatgaacaacctatagcatttgagaggccatagatttggactcgtgagggctgtgcctttgaacctgcacctgatgcctcttgggagaattctgggatttaactccacgtgagcattacttgggaatggctcctatggtatgtgggtttctgagctgaagtgacctcacattcatctaggtgaagcttgttgtcttggagatgtatatggctctcctgttattggaggtccagagaatagggttttttgtttggtttggtttttattcgttttgtgttttgtctgctataaagattttaccaaaagaaatatcctaacttttctactggcccactgagtatcctgtctgcttatctttctaagtgtgccgattacagatgtgacctatgaagccactggcttttaaatgtctaatggagcctaagaaaacccacagtggaagtcatagcatccaacatgcctgcattccaggatttccttgctcctggaaagtcaatctttgtaccctggtttaatatctgttttctgtgatgaatgtgtttatatcttgtggaacatctaaaaccaacacaatcattccatgccccaaccattgcttgctaaatcaaagttttctctcccatgtgcctttctttttgccatcagtgaaaatacactatcatttttttcaactttttaatctgccctgctgtgaatttaattcagttctctattgccttctacctatacaacatcatagcaggtttttctaactcttttacaaattatgacacataactgccttaacctacctcatacacagcttccacttaggggactgtgataacttaccattacctcttagaacgaatttacattctcctttctgtcatctgcccaagggcgtccaccaggtgacctcactttgcttcctcagatttatcctctgatgtggccctttcattttctcttcctgaatttttctctcacttgtctttcattacattctcctggaataagtgttccttctcgtaattcaaatgtgagcctttcgccagaactcaaagttcgcctttcccagaccttacaactgtttgctaccataaaattcaccttttctttgagattttcagcacctgtaattatggtatattttacttaagctagaatttgcttatacatggccatactatatttctctatttgctgaataaaccaaatctctaaatatttctttggttatttgcattcaacgtgcttttctatataggaattcaaatgatctccaaaacaactgagtaagggaggctaggagaaatgattatgtttgttttgccactgacgagattacacacagagaagttaactgcctatcacaacagcattgcctgccctcaaatggcaagttagggcaggtgtcaaaatctcttggtcattagttttatgctattattactgtgtcttagttcattccaggacctatagcaaattacatttgtctggggatttttaaacagcagaaatttatagttcacaattctggagtctggagattccaatatcaaggtaccaacagatttggtatctggtaagatttgctttgtctctgcctcaaagacggcacctccctgcagcatcgtcaaagtggaaggagaggcaagagagatccctcaagcttttttaaaggtgcgaaggtcgggcgcggtggctaatgcctgtaatcccagcattttgggaggccaagtcaagggattacttgaggtcaggagtttgagaccagcctggccaacatagtgaaaccccatctctactgaaaatacaaaaactggctaggtctggtggcaggcacctgtaatctcagctactcaggaggctgaggcaggagaatcgcttgaacccaggagatggtggttgcaggagttgagatcgtgccactgcactctagcctaggctacagcaatgatactctgctcaaaaaaaaaaaaaaaaaaagtgctaataccattcatgtgggtagaatcttcgtgacttagtctcttcccaatgaccccatctccctgcctctaaatacgaaccacatcagatattgggctccaacattcaaattttaggaggacaccaacattcagaccacagcgcactgtttacaaaaatataatctaagcctgacatcaaaccttgcagtaggatgtatgttttgttcacttcagctactgtaagttacaaatattctaacacacacacacacatttctcatatatgctcagtgaacaaaagaataacatacatggtctctaattcagattttgttttcatttcaaatgttaaactacccagaagagaattttctactagtttttctgcttaaaaattctacaatcttctattattcatgacgaaaaaaaaaatcagaaaaaacagagtttaatttcttccacttctttcagtttcaaagattcgtatgatgactataaaactgacacgtatcctttagaagcttatggaaaaatgacctccagaggtttagaggtctgattctttttcctgaggctgcagtctaggtttgtagaaaattcataaggcagaaacaaacagtaaacaggtttgcaaatcttagtgaagatgaatgtgaagatggcccagataatatttaagtaaacatacaatattttcacctgatttttaaagctgttgatattttaaaaaaaaatgtgaccagcatttatggatcacctttaatattataggaaatctgctaaatgataaaaacagaataataattcagaaatactccttgctcatacaaacccatagactgttgttaaaattaaactcctgtgggaatcataactcaataatttggccaatatttgttgagctcttttcctatgagaggacagttatggttatgaaagacgatgcatagataaccacagaaggggcaggtatatacatttttaatcaaaaggtgcaaagatgaaggtgagaaaaagcatgagaagaaaggaatacagtatgagaaggggttaaggaaaagagggaggaagacactttttttattatactttaagttttagggtacatgtgcacaacgtgcaggtttgttacatatgtatacatgtgccatgttggtgtactgcacccattaactcgtcatttagcactaggtatatctcctagtgttatccctccccagtaaccccatcccacaacaggccccggtgtgtgatgttcccctgaagaagacactttcgactgatgaaggtgccctactgggaggttggaacattatggtaattccacactcccctcctctcctagtaaattaaactataggcaccatcgtggttaactagatgttattatagctcttcagggtctaaagagctatttgttatacagaaacatttcctagacattttcctagttttggccagactagaattaaataattaatttctttgtatacttagtaaaacaagaagtattgctctacgtggtctcggacttctgttctgggtgaacgagcagcttttccttccagttttggcagcatgacatcatctgctttagtctggttgaggtgctagctaatctcctaatttgtcaagtaagacatgctttgattctatttctcggcatatgccaacagtgttactttggtaacaatactccacacactattctggcctcactttctcatcatttgttctgtgtgtgttccagctcaggctccgattccttgggtgtagaggcacctctgatatttaacatcttggaaaatgacagacataagtcatcatctctgtcctcaactaccaaccaagtagggacagtaagttacttctgcctcacatctcagagagcggtacttcaatgtgacatacgcactcaatttttaatctgtaaactctgaaatgctcttgctggtatgaaactgggtttgcaactgaacacattccctcagtccctgggctccttgcacagctctgcctgcaagcgagactgtgagggctcagaggcagagtcacaggtgctcttcagagatgggaggtgctctgggaaatcagaaaagggtgacaatagtgggggaaagagttgggggtggaggcaatgagggaccaagcaggcacgtacagtgggaagccgcaggagaattcaggtgcctctcatcagcaaagcgccaatgtgttattccttcatgtatttattcacatcatcgatgaaattccatcagtcctgttaagtaccaggcactgttctaggttccaacggagcagtaaatacaacaacaaaatctccattcacagcttacatgctaatggagtaatgctatttgctaggtttccgtcatatttctctaaaataagtgcctctttttttggtatactgtaaatacccttctcacattgctccatttgagctggaaacacgtgttatagtatactagaattataaatagcaatatttacaagtaattgtcaaaaccacattaattaactcctcatgtttccctcgtgtctgggaatgtaattaaaataatgaaaagtgaaaggaatttcaccatcatctgtagtcatgttagtgagataaatcgccaccagaaaacacagtaacacttaaaaagaacaagtaaaatgtctttaaaaattctattcatgagctttcttccaaataaggattacattattccatatgtaagtgtttatgaatactctgaagatataacattaaggttttaattcacaactacatacacatctaagcctaaatgagtaaagcattattcctaattctagttttgttgccacagattttgaataccatttgtaattacctataaacaacatttttaaataaatacttcttaaaaggaagctgctgtaaaaggctggctgaaccctggggattggcatttctgtccttttactggaatacagaacattcatgtatttcatttaccattgcttagctcatatggtttagtaaatggaagcgtttccaatttgattacctgatatgtttaaatagtgtgtgcttgtgatattaatattttacacatttcctgttgggtgcctgacgtggtaaagcatcatgatctaatgtgtacgttttggtctttaaatgacctttttagttctggtgatgacactagccactgaaaacaccttatagtctcttctttccatccctcaaacccaaagtcactatttggaatgtgattcaggaaataataagcttataagatttctatagatacagctgttctcaaagctattccataaggtagtccttggccactacaaagccacagggattctcctgatggtacaaacatatgcaaagtgaggactctttccttcaataacggctcacaaatccttaatatgaaggacttcaaatcggtattaatcaactaaatttaccatgttactaggactccagttctgctgcaaatcctcctgcaagacatggtgatgttttcatactgccactggacatatgcatgtatggatttgtaagtaccaccattttcatgaaaaaccattttgcttataccataaaagtggtgagtcagccaatatttttaattctgtgcattaaattaatgcacttgtagaattgctatttagtttttacttttccaaccagttttttaaaaatattgtaaccattttgattgattgattttttttctactatactgtttttccactgagtggtggaaaaaggcagaatagttcactggtctttggtcttgtcaattgtatatatagacaaaagagtgaattaatgcatgaataaattagtaactagctagctagtgtaagaagcaagaccataccattacatatcttgaatataaggaaaaccatgaccagtctaatgattaccacaaacagtagggtagcctaggaggacagactggatgtctcttctattgaactttataataccccaaatttccattcttttcttttaaggatacttactcaggagtatttgcccttgagtcttcctggctatggtttaaataactaaacaaaatatatctgacctgctgaagagggtgtcagaataaaacagatatgttttaatgtgtcccagacaacagaaggctagtgagagacgtctaatcctctaatgaactgtgtggatatctgaaacctaaacaaaaattttaatctatacatatatctatatatttatatatctatatctatgtatagtatcttggttaatcttcacagaaacctagaaccatgtactacacttaactcatgcagttgttaataataatagctgcttatgcaaacactggcacaggaaccctcctcccagggccaggcagcttcctgtatatgtggagtatgactcacattccaactgaccttccctcaattctaggcctccatttccaggattgaagaagcatggaccactggccagatcttcctgaaccgttcccaagactctgtgtcacctccgcctcctgcctggacacccttacagccaatctttgtatgtcttctctggtgtttatgtcactgtgggagacccaagattctcaggtcacacacctcatccttccttctccaatcctgatttggccctgcaccctgatctgtccctatcacccattgccatatctctcatgatgcttaattccttgcatgcacagtatttaaattatcctagcactttctgcttggcagaaatcacagccctaattccactccactctgctgaaccaacacctggtgcagttggatgtactgcgcctgtagaaaaaacccagaacgaggatgggggggcatctccatttaactttatgaccattgctctgaagtgtgccttttcagtcgccctgcttgcaggagagatttcattttcacccggagacatttattttttgccttcctttctccctaaagtctccagtagtgccatctgcaggccacaggtccctgctgtgcagatggtccacacaagggcagctggggggcagctgtaagccgatcccatgccacctgcatcagccaaaaggaaggggctctctcattcaacagacacaaagaacacttaccaacaccaccaattcccaaatgcgtacctgcagcctgaaccctgttctgaaatgtggatttgagggtccagcagcccactcagctcacgcaataggacccgaacctcacatgcatataaacaagttcctaatatttctcctcaaactcatacctctgcaatctttccatctcatgaatgcagcgttatccttcctaaaagccttgggggcactcctgaccctctgctctctcaacccacatccaacacatcagcaatttctgttcgctataccttcaaaatataagtagaatctgatcagtcgtgtttcatggccaatgtgctcatccaagccaccattttctcaggctggactgttaccatcgtcttctaattggtgtgcttgcttccatctttccaacatcctccctggctaacaccccagagccaaagagactccattacaacctaagtcacataactcttctgctcagatgatgccgatggctttccagctctctcgaagtaacagctgcaagcatatttacagtgccctcagggtcccttcgtggctgccacgctgacatgaccttagggacctggtgtctagtgtcactctccttgttcacaagccaagagctccagctccacctgtctccacaccgtgccctgaaatacacagatgtgctgcaccctgaggcttctgcactaggccctccacctcggtgtttctctgatgctctgcctagcactgcatgccttcactcaagggtctctttctcaaattgtgacacaccacattctccttctctgcttcatttctctccatggcatgtatcacctgtggctatactatatcctgtataataaaattatataatacatagagactgataggtctatgaaattgacttattttgtttactccttttctccaatcctgtcctgccttcataaagcgtgtctcaccttagttttaacttgcattcccctaaatggctagtgaggctgaatgcgtttgatatgcttaacaatattttatcatttcttcctgagagtgcctgacttggttcacaggtagatataaacctatctatcagatataaatagtgagagaaaacatgcactttctcaccgctgagctaacctggggaaagttctgcctttctagttgccacaggaggaaaggtgcacaggtgcgcgcagccaggagcatgtggggaagctcatcctggcaggacccaccccagcagaagcactagcaggcaacacggggccaggggtttgatgtcagggaaggcaagatgggagcttgccagatttccgtatcaactgccacttaataatcacattccatgcttttatgaattatccttactgatctaattttgtatcagtagtgcttgaagggcttaaaggaaaaactagccctttccttaagcaaaagagagtgagctagctatatgtcatctatatattttaaaattacaataataatacataactagaggaaaagtgtaaagaaatacattaaacaaaaagtaggcgtctcttcattgcttaactgtaagcataccctctgggtataatgattattaagttatctactaataacatgcactctataaacaggtagaataaaaacagagattacacattattttacaatttgaatcttggttaaagaggttcttccagaaagtcaagaagaaaatgtcaaccatatttctctttctagcaaaattaatagtacactgaaattaagattattcaactgtgtaaacgtgttacataccaatatttccacattatatatcctcagattttatttttatttttactatgatgatttgtagcacatatgtaaaaagaccagtgccttatggatacctcttttttcccccagctatgcacatagcactccatgaaacatttatatgcatatatctttacatgttggtgggtatttctctcaaagaaattattagagttgaaattgagggattaatgtctaagaaaaatttaccgtttgagagctatggtcaaattaccctccagaaatgtccagccatttctctccaactatttgtaacagaggatctctttccccaaactcttccaatatgtttatgaatcttacaggtgaaatgggatctacttatttttgcttttatttacctgaatattagagggatgttaagtattatctgatttatattcatttatatattctcctctgttaatgtcctatggccatttttaaccataaataaatgtatattaattagagctactcaggaattgcattcttattgtaaaacatacacaggagagaaagaagcatctccaacattaacaccattctgtcttaggttccttagatgcctgagtttaatgttccgtttgctagcttttcttcttttattgcatgtacatagctttttatgtattcataaatgtaaatttttgttttatattcttaaatataagttaattttttctcattcaatgtgttataatttttttaaaaaaattcaatacatataaatctccatctttgtgtattattccatgacttacgtatgttaagccttatttaacaattgtcctattaatagacatctagaatattttcaattttttaaaacaagtaatacctcactcatcatacttttatttgccttctaatgcaaatgtgcaaatatttttctacaatgtgtaccaaggaactatattaaaattagagaatacatattttagcacttaataatgccaaattactcttcaataaaaagctgcactgatttatactcctactagtagtgttggaaaatcacaacatcatagttgatattgacaactattatgtctcttactaaaataatggattaaaaaaacttgcattggtttcttcaacttgcattattttcctttaacatgcatcatttaatttcaacttgcattattctaaattactagtgaggttgaatttattttcatagacttaataaacatttgtatctccataatgaataatgcttgattttaatttttcttagtctattaggttattattattgattcataatttttatatattaggaatattagtcttcaaattcagattatacaggatatattttttctcactttaccattagtctcaacctttaatcttttcatacagaggtcaatcattttcacccaggtaaatgtgtctcaaaaaattgcttttgaaatccacccttctaacatttgagaatgtgggtaaaatggtggatgacataaagattaaatgtaagagttgttgatgtgaatgaagtgtgaagcttgtgaaggctattacacaattagcttgtgagccaagaactcccttctgaaagaaaataacaggtgttgattttgaaataaagataaaatgaattaacgtagccctaatcttctgaaaaacacagcctaagttttgccattttctatttgtgagctacaaacctgcactatttcctatgcaatggtgtgcagtgagtatagtggttaacacattattttggatacattatattgctcttttaggatacaacctgctgaaaggccaattcccttttggttttctcaaatttctttccattcttatttgttctttttctcatttcatgttgttttaacccgtgtttggatcctcagttaaattacagtgtttaatggaaatgtgagatcgtatacttcattctggttgttgtcgttgttgttgtttttagggaaaagggttcttctgtgaactgaacgtgtcaggtttggggtcaccctgtaagtgccatctggctcattctcagttctcccagctttcccccggcaaagtgccaggtgctgtgttggcaagatgtccctgcttcagtgactctcaactgttcattactaccttcctgaagtgtccagttaaaacgcattatccgaagcccactgtgcaaatgaaaaagctgtgggacaaggcaggtaaaatgtgctccctggtgcctgaactaggtaatgttctgccaggtcactgaaaggctgatctcaagaactgaggttgtctgtttcagaattgcttgatagagttcagtaaaaaggcattcatttcatgtcagtttccacaatccattcattttctcttaatttattaatgagtttatttcctgagcccttcattcatgaagagcctcgtgctacttagaaggccttgttctcactattaacagagtgaacagataaccttcaaaaccggagaaattttttgcaaactacccatccgacaaagatctaatatccagcatttgtaagcaacttaaacaaatttacaataagacagctccaaaaaaaaaaaagaaagaaaaaagaaaacagctgcattaaaaagtggacaaacaacatgaacagacacttctgaaaataagacatacatgtggccaacaatcatatgaaaaaaagctcaacatcactgatcattagagaaacgcaaatcaaaaccacagtgagataccatctcacactactcagaattgttgttattaaaaaatcaaacaacaacagatgctggcaaggttgcagataaaatggaacatgtatacactcttggtgggagtgtaaattagttcaactattgaggaaactagtatgatgattcctcaaagacctaaaaacagaactaccattcaagccagcaatccctttactggctatgtagccaaaggaacagcaatcattctatcataaagacacatgcaggtgtatgttcactgcagctctattcacaatagcaaagacatggaatcaacctaaatgcccatcagctgtagaatggataaagaaaatgtgatatgtatataccatataatactatcaagacataaaaaaaaatgagatcatgtccttggcaggcacatggatggaactggaggccattatctttagcaaactaacacagcaacagaaaaccaaataccacacgttctaccttctaagtggaaggtgaataataagaacacagggacacataaagggaaaaacagacactgagacctactgcagggtggacggtgggaggagggagagcatcagcaaaaataactaatgggtactcggcataatacctgagtggtgaaataatttgcatatcaaacccccatgacactagtttatctatatgacatgtatccctgaacttaaaataaaagttaaaaataaataaataaataaaaagcctttttctcagtattaaggatacagagaaaaatcagatggcctgaaccaacgtagcccttgattagactgggagaaagaaaagcacacatggtcacggtgtttgtagtttctggatgttaggaacacagaggagatattcatttaagccagactggctgaactgggggaggtcactgatcttggagacaactagatctgactttggattctgaaaagagaacagtgcagtcttgagggctgtgttggtgacataggtctgtttatacacactgtgcggctgtagaacttctctgtcaaattagcatctgtaaagctttccacttccctcccctcaaatttaggaagttctctgtgctatcctcaggctgggttctttcactgccctctctccaggaggcctaccccttcccctggggatgcaatctgctatgtgctataaagtgtaattatctagtgttccacagccatggagaagaccttcctaaccttcctgcaattttctaaaggatgaagagcatgtttattttactgttagaatgctcaaggtccctgtgtccctggaccacctgtactttggaaatacaggctgcgtaactcttatctaaagtgaggttttgaaaaattgtctgtatttagaactctttaaagacgtacttttcagtgactcctacagtcattataggttttatccctggatcaaactaagtaatcagaaaccagaaagctcagacttcagtgcttgaacttttacagacttcttttatgacgttgcattgaaacacatgctgtcggcgttcattgaagacatacaagcagcatcttagggagatgttgctgcctctgtgatggagatcttcttaaaagcatcattcagtagattaagtctcacatgtggaatatgttttttggtttccaaaagaagctgccatgtttttctctgtggatgatgaaaactctgcaagtccctcctacaacaaatgcgactggcgcccactgctcttggcaatggaggtgagaacataccatgtctgtgacggggaaggacagggtttggaaggagatgcagacattaaataggacacacaccaaagacggggtcaatttcggaggatgaataaacccattaagaaaacggcaaagggtggtgagatccactgcgatgctgcgcaccagtgatttgaataagacttggggaagaccttggggcctgacatttaatctgagagcttctaccatgaaggagccaagcaggatggacgtctggctgcatcatctcaagaagaatggatgcaagcacaaaggctggcatgagctggggcggctgaaagagcagaagagcggacacagaaaggtgcctggggaccagatcctagaggggcttcaggaacacattgtggggtttggaaattactcgatgtaaaatgcgacactggggaatggactgtagcgcagtggggaaggagtggaacagtgaggccattcgggagccaccacaatggtcctcatgatttgaattgagaccatagctgagaagaaggataaaaggcaatatttacactgcattaaggatcctaaactcaaagaatttgctgttctattaggtgaaggagaattagatactaagaaggacagtgagtgacgttttggcgacttctgcgtagacatggtctatgaagttatggattggaggagttcctgcaggagggagtgagatgatgtaggtgaatgggtggaaaagcccgaactgggttccgagggtcactggcatggagaggtggagaaaaggggaggaagcagccggcatggaagaaggaaagcaggagaggctccttcaggaggaatgttttattggagaggagtcccattgtgagaggaggaagaggaggaggaccagagtttcctcacagcctccggagcatggaagtgggtggtgaattccaggagagcagctctggctgaggtctagggagggggcagaatcttctcgagtggattgaggaaagaaaggcagtcaaagaaatggagacagccagtgaagacctcctcaaagctttgtggtaaagggaaggtacaaaaacagctgagagcttgagggaatttgcagatcaatcaaggattgccttttggaaacactagagtgtgttccaaacttggtaggaaatcacaagcaaatttccatgtttctctttatgaggagatcaatgggaagctcggaggcaaatttatggagtaactgtaaaattgcgaagggccacatgtcttacatttcttcctacagttctatttccagtttttataccctttgatcttaatactgcattttaattacctattttgaaatatacttgttgtcttttctatatatttgttttcttccttttaaaaaataagttaaaaaagcaagaaattaacctctggaaaccagtgacagtcatgttttgtgaaggaaactcatgtttgaaaggaggggaggggaaaactcctctcacccctgatatcgctaagccagacgtttaaaatcaaatgcattcacgtgttgttttatttaccttagaagtttttagaattagtatgggaaaaggtgatgcacatttcaaagcccaggatgactgttgtgttagttttcatgtatagtgttgtcctagagtactcaataaactttcctgtatttctaaagaattctgcacttagaagcctggagacaccattctccttttattcctgtctcttgttggagagtcctaacagaattgataaaatatgtaagtgtgtaagtgtggatgtaatttattaggagaaatttattcatatttattcctaaaaaattattaattctaaaatgaggtactggctttttatcatgcttcatggtattgtttttgtttgtttctttgtttttgagacagagtcttgctctgttgcctggggtgaagtgcagtggtgctatcagtgcgcactgtagccttgacttcccaggctcaagcaatcctccagccttggcctcctgagtacctggaagcacaggcataggccaccaggcacagcaagtttttaaaaattttttgtagaaacgaggtttcaccatgttgcccaaggtggtcttgaacttctgacctcaagtgattcgcccgccttggcctcccaaaatcatgcgtgggattacaggcatgatccactctgtccagcctctcatgcttggctttttatcatgatttatttagaagcacaagaaataattcataagtcataacacagatctcaagcaataacatactttcatatgaaatgtgagcattttcatttcgtatagtgtttttttgcctgtcgtaaccacaatgtcttaaggttcttacaagggagattcagcctgaagtagtgcaactcctcggtgaagcaggcgaattttgcactttccccatcccttcctctacctttcctacaggagaagtgacttttggaagaaggaagtggacactgggctcagcaccccacactgcttgctttgagacctgcctacagtgagcagatgtcctggtgtggcccttgatgcgtggtgaaaggaaacttctgcatgctgggagccctccaggtgtccagctgtgtccatgatgggggaggcatgtgctcttccatggctacctgccagacatggctgcagaccgaacccacgttccatacaggctcagaagcggagtctagcgttccagatgaattctcttaatctagcaggccctacagctctctcaatttgcttctaagacgagggaggaaatttacttatggataccctcaagcttcgatgttccccatattcaggtaaaggccagagaaaaaaatgagctcttcagggttacactgttagatctaacaaccagaatccacaatttctgcccagttcatctactccttacagtagaatgtctattttcccctgaataagggtctgagcacatggcttgtacattttatatattttcatatgcagtcacaataaaatagcaagtttgaccgttaataattcactttgatatgtaaatctagcgttagcatggcatgttaagttaaatggaacattatcatggagattgtatatttatagaactgacttaaattttgtctaataatgacaaacaaacattactaaaccattcagaaggaaaattgtatcttcaagtaaatcattttataggtcgtggccatgacctaaagctttgtctacatcaaggtcatgcaaagtttttttttttttaaacttaaactgaatgtaaatgataaaactttccaaagataaaatgatttattagtacctccatctaattacatattcatgctgggtggtcatgcattgaacatttgctatcagcttctgcctgtcttccttcctccttccctgcccacattcctttccttttgtctttgtacattttttgcacgagagattcaaatggagaattccaaattttgtagttcagggataaaactaatatcaagtagtgagaagtcgagatgataatttcttagattatatacaatttccaggaatgggactaaaataaatcaatctcttctcccagtgtataatattctctacactattctttaaaatattcttacacgtgtatcttctttatttgatacacgaagaaaatcctggatttgcctctaagagtctcccacattataacaataatatcaacaatgataccagtcttgcctttccagtgtaaacatgaacagactcttaaatattaactaagtagaacacaagctagctttttaatatttttatttatttaaaaaatgaaaaaggaaattatatagataggaagtatagaaaaaattgcgtgcattatttcaaacatttttaccgataaatctgtaagatctatctctgtttattgacagaaaaatctccaaaagacccaaataagtagtttcatattcaactagtctgagttgctagtatgtctgatgcttcagtgagacactgtgtcatgggaaatattagacccttgtactttatgttggacagttatgcttcctgagtttgtgcaaactttgagtaactataacgacgaccacaaatccagctttccatatcttatcaagtgtgtcctggacacaaaccataataaactgactgagcttaattattcaccaatatcacaagttatatgaagtctcagagaatgtacatgacagaaaataactttaatatatgactaagtttttaaaatcatgatgcaagcacttcaagcaaaaaataatatattagtactaataatttagtatattttacctctgaagtttggatagttctctaagaacagggatagcatctgagttattctggggtacccaagcatgtagtcatcttcttgaatcttaggtgttcaaacaatcattttgttttattagtactatcaaagcctggagcaggtggtggtttattacagcacacttctctttgcctagaaatatacaggtatgtatttatacactatacctgtgtatataggattgtatattacatactgttcatcaatatgtatcaatatcaaatgtatgtcaaaaatgtcctgcagccaaatctaaatcattacaagattattattcattagaatcatctaaggaatctctatagacataaagtattcatacactgtagcacaagccaattaatctggaggaaatgaatcagtccggtcattgagaacaatgtcccaggtttttgcttctcgttttgcttagaaatgggacagagaccaagttaccgtgagagcaaggaagatgtagctcctcccccgctacagtctactttgtcattctctattgatattaccttaacaatcacatagctatcagaatgagatttgcttttattaactggtttcagaaatgaaaaagcacaaacatctttttctgtgtagacaccaatatttcttgacgtcacatagttctcagaaaaaaatgaaaggctaactcctaacctacatagaaaaagtgttgcatgtggactagcacgtttttctatgaactaacattgctttcagcttcagatatttgtcatttatttcgtgtatagagtgtgtaccggtgtgcgtgtgcgtgtgtgtgtgtgtgtgttgcgttttagtcttcttctggtgtggatgttgtattcacgtttttatcccctataacgaaatagtgcttggtatgtgatacgacttactacatatttatttgatgggttagaattgtattaagatggactggtaattttgattctgtaccgaagttactgactaatgtaagtataaaatcctcgaagattataaaagattttcttttttttttgactgagaactcctaacctaacaaacgtattactaaattcatttactgtcacaagtttctactgtgactgctagtaccttcgaccatggtacagaggaaattggattcaagaatagccaagaggagcagttagggaaaataatgcaatttcaggtgcaattctatatgaatcaccttctcttaacattcatgagaactcaaattctcttgctctacatgctgatattagattacatttttcaaaaactatcccattattactgcatcgttgttctttattgttaattgacagtaaacaatatgccaaattgccatataaatgaactgcctcatgaccaaattagcttcagtttccaggatttgagtgatatttatgtaaattttaattcttgagatatctcgctgcttcactttatttccttagagttataaataaaatttgattttctaaagccacgtagtttattttactaagtgcttctcagtagcattgtgaatagccagttatcttccactacacaaatagtactatatttttggattctccattttaaatctaggacatacatgtttcttaacctttcctgtaaagtctaaaaaggaagaaagctttgcacacgtttcccaaatcctcagctccaatccttaaataagcaaaatatattaaaattatattatacagctattatccaaaatttgtctcacgaaaaacaatgtattttcttttagatggttggttataaagataattcctaaaaataacgtaatgacctgcgcatttatattttttctaatacaaatttttctagtcctccttcgtgtaccattgaaagtaaacacaatgttatttaccaagtattacattggatgcaaaattagtatagaaaagacaactgcatttttaagtactagcaaaggcaaatgaagatcaaaattttaaaaagaaatcatttacaatatcaataaagcctcaactatctatgagtgaattcaaaaaattatataaaaaactgaatgcacgaaatctgaaatattattgactgaaattaagaagatctaaaaaatgcagatatgtgccatgtttgtacattagaagacacaatattttaaagatggcaattctctacaaatgtattatatagattcaagtcactctcaacccaaacctcaacagagttttgtttctttgttttttgcttttttttttcactaattcataagccaattctaatatttccattgaagcaaagaagactgaatatatagatatataaaaagcaagttggggccgggtgcggtggcttatgcctataatcccagcactttgggaggccgaggcaggcagatcacaaggttaggagttcaaagaccagcctggtcaagatggtgaaaccctgtctctactaaaaatacaaaaaaattagctgggcgtagtggtgggtgcctgtaatctcagctactcaggaggctgaggttgcattgagccaagatggagccattgcagtccagcctgcctgggtgacagagcaagactccatctcaaaaaaaaaaaaaacaaaaacaaaaacaaacaaacaaacaaaaaccaacaacaacaaaagaaaacaaaaaaaaacaatttggaaaaaaagagaaaagcagagcttggggccttacactaccagttatcaaaatttactccagaaattaattacttaagactctgaatggtcgatgcaaggaaagacagctaagcaaagggaagaacagaagtgagaagcaaatccacactgctcagggcaaggggaaaaggattgacttctccataaatggggctgggtcagttgcatgttcatacagaaaaagttacctggattctttataattccacagagattacagatctgaacttgaaagatgaaacaaatttccaataaccaatcacgagagaatattctacgatgtctgatgatgcaactatttttaaaaggtattaacaataaaagaaaaaacatatcaatagtctaaacatattaaatttaagaaattctggtcaaaccattagccagaaagtgagaaaaaatcatcacaattggctcctccaccaagatttgtgtacagaatatacagacatcttacaaatcaacaagaaagagagagacaacccataaagtggaaaaaaaagtaattgatttgaactgacacttattagaaaaagacaccaaatcatcaatccaataaacacacaaagtcattcaacttcattagcagtcagataaattcaaataaaatctcgacgatgacagaatactgcatccccactagaatggttaaaatacaattttaaaaacaggaaacctgccaaatgttggttatgtggagcaactggaaatttcctacactacggtggtattacaaatcagtagaattattttgcaaaactattagactctctctgcctcggttgagcacatgcatacactgtgagtggacgatcgcatccttaggcatatacccaatattcacccaaggctagaatgttcatagtagcactatttgtaacctttgcaaactgaaaattatgtaattgccctcagggatataaataagttgtggtatgttcacaaaacaaaatactacacagcaatgaaaaggaacacattacaaatgtgcacaacaatgtaggtgaatgtcacaaacataactttgtgtgaaagaatccaaaagcaaaacaatgcaaaatctacagtgtcatttacagaatgtgtcaaaataggcaaattagtcaatgctgtcagaagccaagagaatggctacccctgagttgggactgacgatttcaagagcatgctagcatcttgtgggagtaatgttctgcatcttggccttgtactgaagtttcacaaactctctgcgaaagtttgttgactctcaatagctgatatgtgcacacttctgcatgcatattttatcctgaaccaataaaacgcctgaacatatctaagagccactgacataaatgtgtcttgactatttactctaagaattccctaagaatccttagtgtaaataacaaaataaaaataaccacatcatacttgcaagctcaggccttggaattaaatggctgggtgcaaatgcaagaaatgcaatttactagatacgtgtccttgaatgattcatttgacctgtaattttcctcatattaaatattgagataaagtatttccagctcacatgtttactgtgagaactgaacgacataatataatacacacaatgtcctggacactaaaaaagtcaattaacatgaagttttccagctatcgatttctcatagttttaaactgggtgtatgtgtgtgtatatatgtatgtgtgtgtatgtttgtgtatatatgtatgctcgtgtataagtgtgtatatatgtatatgcacacaaatataccttttcactgctcctttaaatgaatcatgcggctttatgtactatttaataactaaagcagtgaactgatgccttcaaggaatagtttgcaaaaattagtgttattatttatttgatatcaattaatatcaattattaaaattgatatcaattactgatattattaatttacactaacttctatcaatcatgtaccatgtattatggcatggttatgatttatggcttgaaagtgattcattgaaacaactgaaaccagtcatcttaaatccacagggaaaaagcagcttttaaatctacttaaacaatcccattaacaactactgatcagaggaatgaatgcatttaacaattttgacagaaaagaggaaaacaatacggtttttcatatgtgtatttaaatataaattaaatatatgttaaaatatatgaatataggcatacgcttttaaacatacatagatatagagtgtgcacatactaagataaacagacacatttgaaggtcagaatttgctaaatattttagttttcatgcaaaagataacattaacttctctatcagtgtttcaaaatcattattttccaataaaggtaaacagcgaattgaaaagtaattaacaatgtcagtttcgaatttttattcctaagaaaatatttagggaaaaatgaactcaggtggctttaaattcactttttaaataggtaagtttgtttaataagccttccattatcctttgatacgcctctaatggcaagtctaacctgtcttcaacttaacatacaatggccacttgtgtttgttatataaaacattatatgtgcaatatacaaacttgcataaagtaatcaactgattccctagagaactgttagtgacatggtgcttgccaaaagtggcatcttctagcacaaatcttgttacaagggacacagaaagacaccagagaacaaaaatctcaactgccagcctgagcagggccccgcagtagcataacttcacacctggattctcctccttcggggtcccaacactgcagtcactcaggactctgatatacctgggtgtggaattgcacacatacacatggaaacatcggtgagaagtcatttgttctgatttggttaaacaaaaagacgttacttaatgttgaccaataaattctggatattcttctcttttaaattataattttagtactaactcaactgagaaaatgtccatgattggccttaacttgtataaaacctgtgagtaaataatgattctaatcccaatagtattcacctctattgtgtaccttttggtacgctacgcaaggagaatctctacttcgtcgtcagtctgtgtatgaaaatgccaaggctgagaattttgctaccataaaaattataacttttatattaaaggccttctaaatatatatatatatatattcatatatatatatacacacacacacacattcagaaggcatcattcatatatatatatatgcacctatcaaatgagtaagctctgaaataaatgtacctagtttctaatggacctagtgtctatgattctaccatgcttataaagcaagtagcttctcatatacatgcttatcagatacatttgtcgaaactgtgtacctcattaacaagatcccatctcgtgactgtatcagcgttgagtttattaagagacattcacagatcagaaaagtggaagatcccttatgggagactatttattagtgttcacagaaaatcctgaaaagcctctagcatcagacaggtgtgagttatagaatcaatctgaccttttcaggggtttgtcagtatttattggcacacttagtgacatttatattgttaaacggttaaacgaaaatataaaagcttgaagctgccaatggagtagttatgaggacaatatcccatcacaggatgctatcaattatttgaaaaaagctgaagtacaaatttctgcttttctcagagatgaaaataaactctcgaaaaatgtctctagatggtctgttgtctcagaatactagggaaaaaagaactgttgctccacctagtaatgaaattaggcagtcatcatccaacatcagaatcggctatgatgagcgtctgctcctttcatttcttgctttctgttctctattccccctcattattctctccatctttctcaagctcacagaaatgcacgtgtgagctcatgaaatttcaggcactcaggaatatcagccccttctccatctcacaaacaaactggagtcaagtttatttatgacagaaagctgactttcttaaacaatcagttctagaataaaaatgtgtctgacctggcaaacgtctctgtgaacaaaacaatttgctcttttgctaaatttttctaaataggagtaaagtttgttgttaatctgtgaataaatataaattgttaaaagttgataagttatgggcataaatcacaacaaagcaatattgattcaaattatatatatatgtgtacatatatatgtgtacatatatatacatacatatatatatatacagacacatttattattatttttttgagacagactcttgctctgtcgcctatgctggagcacagtgctgcgatctcagctcactgcaacctctgtctctctgtttcaagcaatctcctacctcagcctcttgagtaggtgggattacaggtgtccaccaccatgcccagctaatttctgtattttagtagagatggggtttcaccatgttggcctggctggtctcaaactcctgacctcaagtaatccgactgcctcagcctctcaaagtgctgggattacaggcgtgggccactgtgccaggcccattatatattttttaaacaaactgtggtggcaaattggttgtgtgctagttgtggtagcagtgatttagaatgtaatcgatttaacatattctttacaaggccagataataaatattttggttttgtcagccatacggtctctgtcacactacccagcagtgctgctgaagtttgaaagcaggccatggacagcactttaatgacgaagcgtggctgtgttgcaggaaaagtttattttccaaagtccctggagtcagatttggcccataggctgcagtttgctgagtagtgagatgtatcttctaacaacagctactgatgattcaaaacctactacatgttagacacttatggaagtcttaatctagtgcctctaagatggctgtcatcagccctattctctgcaggacacagacttagggacagatatactgccaaagattacagaaggaaggagggtagaatagagatttgaacacagatctaattcaaaactttctgccctcaatggctacactatactggctctcgcatggtaatgattcactgagcataaacacagccaatcatcaggggactcaggtcatttttcagtgaaatgcatgtcttcagataaatgcattatgaacacttagagaagcattgatcacctggtaccacatggacttcagtgacctttcaaactctgcctcacacattttcccacctacacatcaagacacaatcccactctagctgagctctgaaaagtagagggtgggacttctaccaaaactctattgtgtgggtgaggatgatggcatgcgtagagggtattccagctgctgaagtgttcaagcgcccagaggcaatcagcgtcaacaaggaacatcttagccatgagaaggacatcaatgttcttgcacagcagtggtgacacaaccacctgggaggcccacggtacatcctccccccatcgccaggtgatagtttctgagacgttttcaggatagcaataaaagcaagataaatcaacagctctttccagatgtatccaagaacaagttaccttctactctgtctgaaatgtatggacaaattatagaccctatccatgaaagtggggctaattttgttctaggcgtccagttctcacctctggctgaacattagagttgcctgtttttgtaaacatgaatgtccagaccttaatctcaaccaattaaattagaattcctgtagagcaaggccaaggaaattatgttttaaagctccccaggtaattctaatataaatagagagttgagaacactgttccacacctagagttaagagacaatacctatgtatctgagttacacagaggtcacaggtttggaaggaaatagctttgatctgtggatagaaaaaactcagattactgtaatatctccctaaatgaactgagtgtgtggtatcagaaaaggcattttgcctctgtctgcctccgtttgttcatctgtgcaaggaagaaactaaatattcgaagtcttattcatgcttttatgtagagtgaacaaaataatgaaaactcagttgacatcaattacaatcaggaaaagaatactttcaatagcaatacttaagaaaacagagaaaacaagcttgtcaggattcttatctggttattaaaggagtccaacttctggcagagaaattaattaaacgtacaaaagatattggaaaatactgtacagttatcacttttctgcaatatcattaattaaaaaccaacgctcctttgcctaagtgggataacatggataactaacatcatttgtatgcaatgttcgtcatcccataaaaattataacatacctgacctaaaaacttcaaatcaaaacctagacataaagttagaggaataagcaaaatgtgatgatctgctaaatacacccaaatgccaaacccttgttaacataagcttgacactttgatcttcaaggcaagcatttgtatccaaagtcaaaggatggtgattactcagtcagatgagctctaaacaagcttcatagagaagcctatttcattctatacggaaacctttttttaccttaatgcaaggttcatgtgcaaatgcataattaaaaagaagcgccatttaggagatgattatcattagctcaaatgaaacacaaagcgctttgctggctcccccatctgaccttgtcatgcctcttgtatcaagtaccagctggagaaagctgagctaataatggcccagctgcataatctaacaagatctttgtcatacaagcaaggtcaagtgctctatcatgttgagattaatctcattgtgcactgagagagaaagaggctgccgggacagagatggtgctgctggctgaagaccttattgagtcccagtctctgggacaacaaaccgaccttccaaatggtccttccatttgggtccttccaaatagcccttctaaaatgagctaagaaaggtactattctagaaaatgatgccctctgtctataaatgtattctatttctgtgacttcaatatcaatgatgattttcgtcatataattaaaagcatatctttataccatttaggtttatgtgaagattttattaattgtattatatttaaagaaactttatcctttatgaccaaaagtacttacaaactcattcaattaccataattgccatttcatacaattcttaaaaggagcttaatatgttaactatcttttttctgctggtgaccaattcattggttgctgcaagttagaagttttactcccaatgattcagatgaaaaatcagtgtttagaaaacaaaatgaagtgtgacgatgcaagattcgaacaagactaacttagcagcagcaataataattaatcaaatttaataatgataaattaaagagagatttcttaaatgtttttctagaaagccattgccttttttttcagaggttaaaaggaaaagaagaagagacgataatctgccatgtcttatggtactaaaacaaattttgcttgtattttttaaaattttaatattttttactaacattaaataatgccttccacattgtagtcattagttgatatgcttctgatctttccatatatatatatatatatatatatatatatatatatatataaaatatgctcattaggtcatgatatatacatatatatacatacacacatatgtgtatatgtgtgtctgtgtgtgtgtatgtgtatgtatacatatatgctcattaggtcataagttcactcagctgacagtgtgaagaggaaatcaagatactggaagttggtcctatctactgtctatctgcaaaatgaaactcaacctggacttcctataaattgagctatggattttgtgaaacagacttattatgtatagtatcaccttaagcatatgaaagacatagagaattatataggtatcccatactcttctgttgcaaattctttatttctcttttgactattttgtattcatgaaataaaatattaccaaaggtcaaaggcactgaaatatcaaaattactttctgagttgcgcataatgccacatgcccgtagtctcagacggttggatggctgaggtgggaggattgcttgaacccaggagctcgagacaaccctgggaatatagggagatcccttctcaaaaaatataaacatttttttaaaaaagtttctgaatcccaatttatcattgcatttgtgtgtttttattttaggacaaatgagataatctgataatataactttgatagtttattattgggtgtatggactagtgcttcttttgtagcattttgataactaaagtatcatattccctaagaagaatacaattttacttttaataaaagataagaaatattcttgttgttcaaacttgcaaagaaacatcagatattttgctgggttttgatttacttgaaaaatattaatattaatggagaattgcacacttgaattcaacaggcactgggcagggtttactacttggtaggtattttaatagactgtggaaaacaaagacaaaggggacatcagacgccacctgaacaagctcgcagtgtcttggaggagactgaggattccagctgagtgagggaagttttgaaaatgaaggaaggcattgaggcacacttgcaggactcggtggggaacaaaataactctatctctcaaaggacaaaataataggtaacacataaggtttttatgccgatttcaggaaataaagcacgtggcatatttttccgatttcagagaaatggagcatatttctagtccccaaatttaataaaaccgattactccaaatgagtcctgccccagaaaacatttaaaggaagatattgggagcatgatgcaagttagcatgtggctctgttgtctgtgctaatgtttgagcaaatttttgtcctcagacatttccagggactaaaatatagtaatatctgtttaaataaaatgctcatactcagtaagtatatacaatgagaggatgaaagagcaagatttcttgagtgtgctagctactctctcataggactatgtgctagctactctctcatacgactctcatacgactctctcaataacctgtgaaatggatgttatggacattttatagctaaggaaaatgaaggccgtgaaataattgagcagcttttttgttttttttttgttttattttattattttgagacaggatctcactctgtcatccaggctggagtgtagtgttgtgatcttggctcattacaacctccacctcttgggcttaagtgatcctccctcagcctcccaagaagctgggaccacaggcatgtgccatcatgcctggctaatatttgtatttttctttgtaaagatgggtttttgccatgtttcccaggctagtctcaaaaattccttgctcaagtgatctacctgcctcaacctcccaaagtgctgggattacaggcgtgagccaccgcgcctatcctgagcaggttcttgaaattaggtcaattcaattccaaaatccatccgaggccaggtatggtggctcacgcctacaaacccagaactttgggaggccaaggtggcagaatttcctgtatacaggagtttgagaccaccctggacaacataacaagaccccatgcctaatcacacacacacaaaaaaaagccaatagtgggggtgtacacctgtagtctcaactagttgggaggctgagatgcgaggattgtttgagcccaggaggtccaggcttcagtgagctgtgatcacaccactgcactagagcctaggtgacaaagcaagaccttgtctcaaaacgaaaaaaaaaggattaactcagtctcctaacactagtctcccaggcagtataacactgactggagactgaatctctgcttcataacgtcattactatgtgatttaggcacatcaattatttctacaagcctaattctctcatctgtaatggtaatccattaaagcttgcccaaaaaaaggctagttactgacacgtttattatgtccacatgatttacaaaattatcagaacaccaaactcttaagagcaaaatgaacattttccagcgtccaaaagcacagcatcggctacttcaatattagcacacgatactatcaccaacatgatagtcgcaaacaaaaaaaaaaaaaattaaggaaagtcacatttgggtaaggttcattgtgtgtgtgcttttcaaagtttcctattcaggcaggacagatacataagctctaagataatatcagtaaagtgaaaggtaacagccccaaatatatgaggcatttagcctgcttccaatgtgtagccctattttacaaggttaaattaaagtgctgaggtcaagcatttactcagatacctgaacattcaataatccagcacaaagaacaactacacatcactcaacgcttaattgctgaaaagggaaactgtcttcagcctatgtcttcaagaagacgtgtggggaacgtattatgctttctatgtgttatcctttacctacacagatcatcaaggagaacttccccaaagcttgtgaagtgacaggcttcatagcccctcattcattcaggccccaactaagttctgcaagaggatctaagagaccgtgcatccaatcctatgttagaggaattttgcaaaaataataataataataataataataagattactctaagtaaaaccagttaaatctgttctctccccactcctactttcactctggtgcacgtcagtactgttgcttggcacgtcgtgggatttttggagactgggttcaaggtgaattaagtaggcacttatttgagtacatttaggcaggttttttttttttttttttttgccacttctgtgcattatgaagttattgctagccatcgtaggacaatttggacagtcttctacgtgaactcaggtgagccatgacgcccaagtgcaggttctgagaatgtgttccacgggccagacacagagcaggtgagtggagaggatggcaagcgttgatgtggacagagcaagaggcctctctgtgaaattaacttgaaggaagttttctcaagtctgaccacagtgataaaaaaaaaatatgacataacaatcatggttcagttttcacactgaaaataacttgtcaataatagtgatatggattaaacaagtttgaccaagtatgctggagaaatgctggaattagctttctattatctctgcaaaaaacatgacaaaatcatcctcacacaaaaaggtaatcaaagagtctttagccaaagctgcagtgaaaaaacatgttcccagggcacgtcagaaataaagtgactagaaacctcttaaaacacattttttcttcttcttatatttgtaatattttagcctataaaacaagtaatttgtgatttcttattgtaaagaaaaattttatgtcccaaactaataatattcacaattttatatatatatatatatatatattattttttttcttagagggtcatcaaaattgtatgaccttgaagcttaacaaaatctggatcaactcctgaaaccaatgaggacagtatgatagcttttgcaaaggataaagcaaaagcaaaaccagaacatttattacaatttttgttttacaaattaaatttataaatattatgaaaccaaaggcaaacgccactgctctacttcctctgcacctgtctagctccagtcccatctccaccattagaatctacttactgtgcatggtgtcttgctctcagttaggagaggtagtcaaggaaatgggcatgtcctcaaaacacaacaaccgcagcaaccgtggtaacaatacagccatcacaataagcattaacattcgctttgtaattgagctcattcaagaaagctatcttcagtaaggaatttcccctatagagagcatgcacactttgattttacctgttgccagactgaccctttgttcattaaaatagtaaaaaacacacccctggttggagatttaagatgttaatgagacatgcaattcatgagcaagcatgtacagttaccgcacgtgtgcacccagaggaccacccagaacttgcttactggcaacacctcttcccatctccttatgaataataatgtaaaactcccataaagggagtctccatagtgctggtcattgctgccacatcctcacaagcagcaagccgttaattgtctctttcacggtgttccgtctattctgcacctcacttaaaaatattctttttcctttgcaaaaactactctatgctacacttcttttgctgtgtgtcttttgtttgaattgttctaaacccagaagacaagaacgcaggtatcacaacagctgtcaacatctgcagtcccatctccacactgtaatctacttcctgtgcacctgtctcgctccagtctcatcttcaccactgaaagctttgctctggattttttctatcacgaggattaaatgggtgttgcaactcaaggggagacacatccttcatggcttagacatttccaaagaccagcataattttacgttttttcaagtaaaagaaaataatcttgaattatcttgagacctcaaatatagaactacaagtagttttaacatttgccaaattaaaaaaaaataatcctatgatagattcctcaaaagtgtacctaaaatagatttctacatcctattgatttgttgtctgtatggggctatttacagaaaataaatgctcagtgctaaggctaaacaagacttcactattaacctaacaagagagtctaattgaaaagttcattgatcctttttcctgcctccaactatatgaattagtttcttgattaactagaattactaaggaagtgtctctgcttccacatgtcaattagaagtgcatagggctgttaaatatttaggtgctctaattcaaattcactgacaagggtttgctctggctctattctaaaggaacattattttcacacctgtcttataaatcctataaaattacagtgggttcctagtattcaacactgtaccatacagatgacaatttccaatatgatgaatagggtaattagaagagtcaatcatgaatctcccatttggtatgaaagcagcttagtggaggccatttgtgaggtatttattatttgaatggtataggtggagtacagccagtggtcattataattaaacattcaaggacttcttaacatattgattaaatgtgattcatgaatcacctagacattggctttatctccaaatcactaattcagagacaccaacaaagtttcctgttactaagaaaatggatttaattaaaataattagtgtttaaaatgatcactgtgcttacaacaacaaagagatggtctactgctttctatttaaattatgtaaagtaaacctatctatgtttattaacatagatttatgtttggagttacaactgagacaatttataacacaagggaaatattttatatattaaatgaaatactgtgtgattgtgggtttctgtggccctattaacacaacagtgtcaatccacaatgtttaaatcttagcagacaaaaaagaaaaaatcaatattattaggcctattatcaatttaagtgtatctatccttagggaataaatatgatcctaaaaggatataagcacatgaaataagcatatatggatttacctttctaatgcccatatatgtaccatttagtaaagtctcaaaaagggaagaatcctatcctaaataattactatatttgagacacacatatttataatccaagtatttgtatttagttcctaacttgtcaatttatttgcttgttctttcacttatttattcattcctaattcagtcatttaagaaatatttcctacggtcataactcttcacactccagttgtacctgcagtgtgagccacagctctgacctggcttgttcccttccagacaagtcggatgggaatagtcaggttaacctcatcccctgaaactctgtatgcacactcaggtgggagaggcaccaaccaataggcactttaggtcccacttgtaaaagatagtcctgttaacctcccctattactgtaaatcattcagtgcagtgtggtttcttccagaaaaagaaaggaagaaatgactgcggagcgctggactcatgtagctgctgatttccatttacacctctgatggtaacttcctgatgggcccattcttggggcttgagtaacaagcccaatttgattcagtcaatgtaatgattaagacacaacaaaaacatgatctagagccctgtgacaaacatcttccaattctatagcctggttgctgtcaccaaaatttctcaaaacagtccttccagaacttgtatctgtctatgagtgacatcgccttgggaaaaatgcataaatgtatttccagatttccatatactcactttgctgaattagcaaaacattaagactaatagtccaaacagatgttaacaacagtgattaatcttcacatggaaaatgctacatgtaatgtctccaaaacgttgaacacttgggagagaaagtaaattcaataaaaggctaccaaataaggtcttgaatattattactattattattattattattattttgagacagagtctcgctctgtcacccaggctggagtgcagtggcgtgatctcggctcaccgcaagctctgcctcccaggttcacgccattctcctgcctcagcctcccgagtagctgggactacaggcgcccgccaccacactggctaatttttcttatttttattggagacgggatttcaccacattagccaggatggtctcgatcctgaatatgttttttttaattaagaaatatacgtaaacagcaagtatattgtctgagagtctgaattgatggtctgattgtgacatcaagtttgaaccaaaaataaatgtcaggaaaaaaattttaaaaagcgcttgtctatcacctaattctatttgatgtttggttctccaataacaacctctatctcacaaatcatgtcatcaatacccctaatgaaatctgcttaacatgacatcctagatagcaattctagttttccatttctcttgagcaacttacttgctccctggatctaatttttgtcttttattaagggaaattattgtactggaagtttccgaatgttcctttcaatactggatgtattcatgacagcactgaaatcacagagacccagtgtttttaaaacaggagtctgaatttcaacgagacaagggttagtagcacaatggtgtcaagaagttatcaaaacaaaggagtgagatgacacagcctaccctttctacagagacaacggtcatagtgtgactagcaattttaattatctacacttaagagctgtgtgcaggagcagtcaaatacttgggtcaggtttctcttataagcagtgtgctctaacagtgattcctacatttgaatacgtgtgggccaattataaaacaaaatgtttctcaaagacctgttattaacttttaattcaatttatgatcttaaagtcatgcatatataaactaaatttttatttatgatcttaaagtcatgcataaacttggaatgcttaaagcctgtgtacactataagttatataaataaatgcatacaaaactacctcagtaaaaaaaaaaaggctatgcattttaagtaaccctaaactgcaactcaaaatggactgctgtaacacaaattatcaccataatcgttaataatagaattattattatcaacttcctttatcatgcccataatcccgtgaggaagccctattaaagttactgcaaaagcctcctccatgaaacattctgtgatatcatttgctttcctttggcccagatgggctatttgcttcgtaagttcatctccatcttttttctcattagcctgaggatattaaagtgctgcttcttatagcctatggaatcttggccacagaacaagtaaggtggccatgtggatgatacagtgtatgtttagatatagttatataatcaccaaatgaagacacaaaatcaaaatctagtcacggagaactggagagctcctaggaggtgcccagatccccagtttgacaatgctattcttaccacctaaattatgtacttacaaacaaggtatggagggaaatatattacaatcgccctgacacccaatttctcaccatatagcagagtttctaccagctgagtcaaagtggagtcaactataagccatcaatccctgcaagccatccagcaacaagcttatgagtatggaaaattcccctacatattgagaaaataaaaatagctcagataaaactactgcaagaagcatgaatacaaccaaaaaaaacccaacatttgaacaattcaaggacaactactctgatgttatgtgagctatgtgtgtagtaaactctctgttatatggcatgatctgttatggggagaaagaaaagttactaatcaagtgccattataaagtgttaaagtttgtgtgacatgtcatcaagtaagttgaataatattatggatgtcgcatcataattgtacaaaacctactgttccagagaatacctgagagtctgtcatatctttgggttgtcacaataaacataaatctatcctgtaatggaatatgaagatagaaaaaagatttgcctgggggctgaatgtttactaaatcaaaggtgcacctatcactcattttgaatccacatgcagacctggtatttgttggtttgtttctcattcagagttcagaatggacaggtgtaggaattcctgagcagaaaatcctacttttctgctattgaaccactgtatatatatttgaggaagaccttctctaaaacattaacatcttccctaaatttaattaataaatcatcaattatttattgatttctcaggacatagctgatagccccaatactctgttggtccccttaggggttacagtcattttaaactgtagtgactctattcaagaacctctgccctcaaaaattttatgggaaaaataaaaaacaaatgggaccatacagtacatatttcagtgctaaaatatgtgctagaagccacaaaggtcgtacgcgtccaggaaaagaaaacaattgaggtcaataaaatgaggaataaatagagaagggttcatctctagttttaatgcataagtactgactggcgccatgttaggtaacaaggacacaaagattgccagtactgtcaaaggtgcttacggcctaggacaggaggccaatcaacaatgaacacaggacggacaagagcacaggaaagttggcaccagtgtgggcagccaagggaaaggagctccccgccctgctaagaaatggcactttcaagtacgctttgcaaaagaggtgctacttcagagcaggtgtgagtttgctggacagattctccgccctggcacaaagagtgactgaacatgacccatatgggtatgctgattacttcaacatgttggccacagggattgtacgtggggagatggggtggtattgatccaaccgcagaggtgggtagaaactagacctggaaggaccctcattttggatgctgtcataaggaagtggaaaaacatctaaggacattaaaaagaaggttgttgttgtaaaatttctgtttctcaaggatcaatatagctccaacataagtatgtagtgagaggaaaaggttttggaggctgagaaactagacaagaaggtggcttttgttataatctgggctaaatatgacaaataactgagcaactgtcctggtaggctggctgaggttagcagttggaagggctgtatgaccagctttcagggcacagttttgacctgactggaaggtgacagtggatagcacccttcagtatgaccctaccacaggtactgtgtcctgaaaatgtccatttcttcagttcctttactccaaaccctgagcttaagaacttgcttaaaacatgtctttaatgtgtaaaatatttataacttaattcccatgggaagggtagttgctctccactgggcttgttgagctgcagctacagctggttgacaatgcagctgggtgacactagctaggtgacactgcagctggccgatgctgtagctgggtaacactagctgggtgacagtgcagctgtgtgatggtgcagctggttggcactgtagctgggtgacactgcagctgggtgacagtgcagctagatgacaccacagctgggtgacagtgtagctgggtaacagtgcagctgggtgacagtggagctgggtgacagtgttaacagtggagctgggtaacagggcagctgggtgacagcacagctgcgtgacagtgcagctgcgtgacactgtagctgggtgacagtgcagctggatgacactacagctgggtgacagtgtagctggttgacagcacagctgtgtgacagtgcagctgggtgacagtataggtgggtgacagggcagctgggtgacagtgtagctgggtgacagcacagctgcataacagtgcagctgggtgacactgtacctggttgacagtgtagctgggtgacagtagagctggatgacactacagctgggtgacagtgaagctaggtgacagtgcagatgggtgatactgtagctggatgacactctagctgggtgacagtgtagctgggtgacactaagttgggtaacagtgcagctagatgacactgtagctgagtgacagtgtagctaggtgacagtgtagcttggtggccctgaagctggatgactgtgtagctgggtgacactatagctagctgccaccgcaactgggtgacagtacagctgggtgacactgtagctgggtgacacagcagctggttgacactgcagccttctgttccagagcttgctcttctcatttccgagcattactttttcagccagctgcatgccgtgctcaggcgtttgcttgatctgagtcctcgtgcatccaaacactatggattattaaatacaagaaggtctataaaggacagaacagagcctgaaactttatgatttttcattattgctagctgtcatagtgttatcattattgacattactttggtaataagatggcttttaataacgattttgtagtaaagaaataatttataacctggagtccaaggttaatgtgtgtatacttttgggggagggtcatgaatgtactgataaccgtggagaaatagtatatcctcagcatgcaaaagcagagaatttattgatcattcttcctggccaatagtatttttatttcaaatgcttagtaatgttcttttccagttgtactgaggtttctttgatttttccactttttccctttttctttctgcatcagtgacactcttgctagcttcaacccaatctccaatttaatttttttcaaagtgtgttgattggaagtgaagatgggcatatttcagtaaaccttcatcttccctgaaatccgtgctgatgcattttttggtcttactctaatgacttcaaattattttccacttgatagatctcacacatgcattgtcagttctgaaccaagggagccacgctttggaacatgtacaccaacctgccgatcacgtttgctcataaagtagagtcctcattcggagagccttggggctcagatcttttgatagtttctctgaaaaccaccgaagtaaaacagtatctggctcctccaatttatgttcacagaatgtacttctgtttaacaactttattagattttgaaatggcaaagaatggaacaactgtctttatgtaggcttaacgcttttcgatgtgacaagccaacataatttctggcgtcaaagtgtggtttattaagctcttggggtgttcacaagtattctttgtttgcatcctgatattaccatggttttattatactgtactcttctctagtgcttttcccattagatcattttagatctcatgccatgatgtgtgactatgaacaagaggaccagacatgtatttcagtgcttagtattggctttaaatggctgtttctcttattctttccctccttttcctcttactctattccatttattatacgttgttcttcttttgcaatgatttgtacagattgttgccagattcctatttgtcttgaaaaccagcctgaacacattgctaagccttaatatgacagaagtaacacaacaatcttcaagcactgtagcaacattgctactaataaaatggagaatctcacttctgatacttcagcattttctatgattttcagcccattgaccacctcccaacccacattctagggtccattgattaagtcatgccctcacccattactgtcaaatcctgttactccaactattacccagtaaggagttttttgtttcaaatcttggcttttctgtttacaaaaacatgtgatctgaggcaaattgttggatcttcctaaggcagcagtccccatcttttttgctaccagggaccaatttcatgaaagacatttttttttccatggactcaagtggcaggggatagtttgggatgaaacttccacctgagatcatcagccattagattctcacaaggagctcacaacctacatccattgcatgctcagttcacagtagggttcacgatcctatgaaaatctaatgtcgccgccgatctgagaggaggcagagctcaggggtaattcttgctcattgccactcatctcctgctgggcatcctggttcttaacaggctgtggactggtaccagtccatggccccgggattagagacccctgctgaggtacacatttctttgtatcaaatagagtagagctgtctactttgcaacattttatgagaattaaattacataatgcactgactggcccatcttggatactgaataaatagtagctacatccaactttccttccatctaacagccattgatcatcctgatcttaaccacttatctctttctccagtttccagctctacctccctgaactcagtagactctgacctcctgaacatgcattgttttattctttctagtcttacgatgaatgcacgtttctgtgttattaaagtagcgtgtagctgaccacctggattggataactgcctgctgtctgtattgctgctgcttgtctgctgagctaggtggagaccttcttactggcactttggagaaacctgtatgagctctgcattccatttagcgattgagtattaagtgttcttcttacccttcagtgtgactctgcaccagtggcctctaaaatttactccttgtctctgccatgtcgggtcagaactggttttcttgcctctgtcccacccatgtgtttttagaatatccaggatgaattaatctgtccagctaaaaaaaaaaaatgtactcaacctacagggttcaacaaaacaattgcactatgtcattatcataagctttccaatgccagagcattaatattaatgtgatattaacatacacattatgtaaaatattactctcaagaaagtctaaagtggtattatcgacagcagagaagtgtgcttctcatatacagatacagtaattgccggcattttgtcctgtttctgaatttcaatgtgtagaatattacggtgcctttttcttcatacttagttcactactctatttggcaactttgagtaatgtgtcagaaaataaggttcttgttccttacaaattgaccctggctgtctaatgatgtgattacacatcagatacagcatcctgaaagaagccaacaggacatcatcaactttcaggtgatggactttgccacctcccaattgagtccacatttgagcctctcggatcagtgttccatgggtcatgttttcttcgagctctgaggtctctttagtggtcttgtttgttagggagtcattgccatatatatatatttttttacctccacaggacacgtggcacactaccatgtacctctttggttcactatttgtttctcatttggattaaacctggaataccttgttctgtagtttcttgattaatgtcctaccgtcctatctgcctatctaggtgggtctaatgtcacttcctgcagccctgatttcctgcaggtgtgatatcttcagtcaaagattgtacattattttgtttatgcctaatgaagtaattcggccttgtaattatatttggataaatattattttcactttgctacaatacatgtttctggagaaccggcctgtgtctcattctgaagtaacttatggatatcaggagctgagttagggtagagacgaatagcaccttcccttaccaaacaaatcataggttcttcctggaggacacccctttctttcatcccaacatcatcaagcccagtcctacaaatagaaaatatgtgacagattcacactaactctttattgcaatggaaacctctttattgcaatggacctatgttagtgcttctcaaacttgagtgtgtctaggaatgtcccagagatttcagtaaatgcacatttggccatggttgttctacggtgcggcttggtattccacatttctaagaaactgacaggtgataccaaagctgttgtatgtgaaacacactttggagagttgggaattaaattatctcaaatatattttttatttcctttttctctttctttctttctcgttttctttctttttttttttttttgagatgaagtcttactctgtcaccccggttggactgcagtggtgctatctcagctcacagcaacctcggcctcccgggttcaagtgattctcatacctcagcctcccaagtagctgagattacaggtgtgcatcaccatgcccaggtaatttttgtatttttagtaaagatggggttttaccatgttgaccaggctggtctcaaactcttgacctcaagtgatccacctgcttccgcctcccaaagggctgagattacaggtgtgagccactgcacccagccccaaaatacgtattttccttatctgacatttaaggtcaaagaggaagaagtaccaagttacaaatatagaatactcttcagctagaacttgtactggtgactgattttctctgtggttccttctccataggacctatgtgtatccaaatgtctgtagggaaactgaggcaattttaatattttccaagaaattcagagagaatccttccatttaaagaatgattaataacaggcaaacatagaaaaaatatgttcatataaaagataatattttttctgcataatataatttttcaaacaaaggaatatttagattatattctttcatacaagagttagggaaaatattcactgaataacttaaagaaggttagtgacaggtacctgatcttaaatccaacataaaagttgatcatctaaaaaaagttctttagattttcttagtaactgtaaatactggtaaggccacaattaaccaggcaggtggcgtcaagtcactgtgcaatgtaagaccccccaacacgggtccaatgacggtgactttcctacgtgtgaaagatctctgtgcacctgctacccagcgtttctcaacattcagcatgcattcccatctcactgggagggcttgtgcaaacacagatggctggaccccacacccagagtttccacttcagtgtgactgaaaatttacatttctagcactgtcccaggcaatgctcatactgccagtccaggaaccactctttgagaaccacactcagtatctccttatccacatccaagtccacgcagataatagactcgtcttaaaattggatgctcatcaccctaaaccttgctcagaattcttcaccaccctctactgtagttaacaaagtccaaacatctgggcctggcattctagttccttccggactgtggacccaatttagcagaaggtttctgatctcttactatttatttgctcctttgcaatgggccaatttataaccatgtttttggtgcccctcaaccataccttttgattttatcaaacctgttcttttaccagatggttgttaggcctggagttctttttattttccccgcttttcaaaaccctaaatagcgagaggaggtgaagagactcacagacatgctctctctttccttcccatgatgctaacctcagagttgctgtgggaattccttccaccccacagtgtaccaggtaagcatcatactacctgcatttgtgatatgggttaatgtaagtgaatcacaagtgcttcattatcttgattgtgaccacaaaatgccatagcattgcattaagttacaatgtgtgctgcttcaaataaaatcaattgtcatagggaaaaaaaaaaccccatgaaacatcaatttggtgtactaattcaaaatcccaagtatacctgagtcacctatagtatggtctagaaatatcctgtgaaaaatgtaatctgtttttaacgaacatgatatatagtaatgtttaatgccttagaaatcatgatatgaattctgaaaagacataatggacaaagtgtatccgataagagaatgaaaaaacaaggttgtgctcactgtaaagagtgaagacaaggttttaggcagaaatataagctgtaccatgaggtgtgggatatcatcataaaaggtaatactctagaatctaacaaacctaagctttttttttttttcagatttgcaaagtacaccttgcacagcagagagaaaataactatgttttatgtaaaaaaatgtgaattcattcactggctgatagattttcctcatctttgatactgtaaattcctacaagaggaaaaatgacttttatattgaacatatatacagacaaaatatatatgaatacataggcatatatcaagaaggacagcattgtcattttgtacataaagtaaaagtattagtaccaagtctttctaggcagctccaacattatcctgaacttgacaagtgaaccttacccatcagagtactgctgggtaataccagttatcagacaactgaaacgcttcaaacatgttgtaagaaggtcttcatattgccctttcatagatgagaaaaatggctgggagagcttactaaagtttccaaatgtcgtagctagtaatcacatcccatgactcaaaatcccttcttcttcggcttcccactattcataaacattacttttcatgttacgttgtgtattactttaaacggcacacacgcatgttacctgaatcagcgatctgatctcatacagcaaataaaaatttcttggaaaagtggaaaaatatattcaatttgatcgtaagtctttacatgcatttttaagactttttaagaagacattaacgtggatggtacatatttgctgtttctaaaagttataattagaaaaaacaaataagttcaatctttttgggaattatctaaatggggtaatttaggtcttttattatgtattccccttagaatttttagagataaagcaaagctgtcgaggtacactttaaggcagtatggtaaaaaatgttacagtggcctattaagtatcatctcacagaattgtgcagatctttgctttatttttaaggaatggcccagccaagtgtgagttaccagtggttgtgccaggtacaggccaacatcatgaaaaacaagcctaagttcaggctcattgatgagatgccacctttcactttgtattaggaagattcaggcagagatcctgagagcaatgtggacttctgtggattgctgccctgagaagtgttatgtgagtaatctcagacctgcctgtgtcagtcagtaacagactgactcttagaatcacccgctgctcgtatcaaacagcccaagatatctcttccgtagttcttctcatcatcaactctgtgctctgcggtccaggcaaataactttctctcttcttgagaatatttcagggattcttgtcctctggaaacaacatgcattcactgattgatttttttggggggtgtggggagagtggtaatttgctggggccagaaatgtgctctgatatgttcacagtttcctctttctaccaggaggactccataggtatttgaccccaaagtctgactctcaaattgcagtcactggaggtcaaagccctaatgtctgttgaggctttatggagcccctctgagaataacaaatacatggcaatcactataaacctgcatttatgcatcaatgaccatgggccaggctagatactaagcacataatagtcattatcaaatttaatttgcataacaattttaggagatatgagaaagctgagtcaggttcatcaagaaatcttcccaacatcgcatatatcatgaaaggaaatgtgaagatttcaacaaaatttttactgaatattttatgctattaatcattatggatacattttcccaatgggaatctgataaatttgcatcagcattctgtgggaatgtaagcacaaaactttgctcgcagattttcggtgcacacacattccctgggcctttacacatccagtatcccctggtaaaaaaacaaaacaaaacaaaacaaaaaaactcctaacctaagggaaacacttttgtagctatggagctcacatttgcctctcccttgtttaatccctggaacatacttttaagaacattgcttaaaaaaaaatctgtcttattttttgtaattgctctgcagggcctactccaataacatgaaacaactctggtgaagcaatcgcttaatagcaggccagaggtctcaaagatattattaatataccttccaaaggcaccaaactggcttacaggcattaggggcaattctggattcttagctattatttgaaacaggatctctatgtgaggaccaacgacattttgacttctcaaatgttactgtgaggtaatataataacacaccttccctaagaggaagatcactcatgcatctatcttgctttgcaagcgctggcaaacagggctccttcactactgttctccttcactactacttcactactacagtgttctccttcactactgtaggaggcttgcctttctttttcacattgtgggtgaaatgcggggagcagctgagaaggcctttggagaattctagtgaacaagtccactgggctggagacaactaaagcaatattctggagaggcttgaagtggatcgtgattggtcctttggagactgggtcaggctgtagctaagatttgtggatgtgacaggctgagacagttatcctctcaacctcgtcctggcttggaggagatgtagacccaaaaggtgtcagtgttgaggcactttccctcattgaagtctgtaacttttacttctcctagggtgattcgtgtgggcatccttgctgggaaatgccagtctgactcacattcgtcaggaggaacccagaccaaatctacaggaaaaatgagctcaagggtgccgagggcaggatacgcagaaaaaggcagaacacacggcgtgctcctgagacagcagtgcggaaatatccagagagctttctcccagaagcaggaatgttcccacagcgtggtcgctctccccaggtatttcaaccctagggaggtgggtgccttttcgtggcatagagggaaaacttctaataaggccctctgttaggctcaggagcttgtttgtgctgcaggaatgggtgaagagtcacctgggaaccctccttttcctaacatcatcattcctccttcgaaattcttgcggcttgtgtagcaaaggcaaaagtttagggaagggggtcttgactctggagctaatacgaactcgacaaatttgaaaagtgtttaataattctcatcacaattttgcatggtgattgtaatagaagcaccacgtatgtcctgctgtatacaagttgatggaatgggtacaaaatcgttaaaagactaagccctgtattaaagctgcttggactctaattagacaaggaagaaaaaatggctttttgactgatatgcagacaacacttgggagtaactagaatgttcctccatttatttataaataaaggtaaataattctttatttttctcttaaaacagaggcatcactagagcaaagaccagctgctaacatggcattggggaaaggagaacggaacatcaactgtggataataacagtgtgtgagcttttcttacaacttatgtcggacacatgttacatcgggggacaaggaattttataatgcacggaaaacaatgttcatgcagttcagtgaattgtggggtggggaggaaaatatgtcagaggcgtttcccagctgctcagctctctcaccacgtttgaaaatatgatggaattcagagcatgcctgtgtcctgcaaactgacgacagggtggcaggtgcaccgaggccacagaatgcaccaggaagagactctgaagatgctgccctgtctgccgtcaagacgcttaatcccttcataaaatcacgaaatttaagtgttcaggttttattttgttcactttatattttgaaagtgaaccaagtaaacattatacaaattttacaaagaagtcagattcaaatggtgccttcagaataacttgagcagacagtattatgaatgcattatttttgggttctaacacagcaaaagacagatgattttaatataaagctattgtgcttaataagaaaacagactgatattgctaaatctataatctattttcccctttgtatttgcatatgcttcttcagaccattaaggatataaaaacacaacgaattcggtgcttctttagagattgtagtgccttctctccagagtacattattacaaatataacttgttattggagagtgcatgctacaggccaaatctctatcttatttctgccttccttggatgcaatgaatttcaagagaactggaaaaataagtgcttcctacacagtatctacacagaactgttattagcttgattgatcacgaccaggaacgctttcttgggcatatttctgtagctattacaagacagatgtggccaagtcctacttattcaggggctgcccagctagccctctggggacactccagaactctagaaattggagatgaccagaaaattctgtcaaatcaccttggcagctgtggtttactggacaggttgccaatcacaggactcaaagagctctcagaaaatcatataatgcaagtgtctgcttccagacgggtctctggggactagatgtcagcatctctcttgaatgctcattccaaaatcaaatcacatcattctttaggtcatttttcttttgtttaactgaagtctctataatcatagatccttttttttttccttattgaaaggctatatatcctagctaacacactgaaaccccatctctactaaaaatacaaaaaattagctgggtatggtggcgggcgcctgtgatcccagttactcgggaggctgaggcaggagaatggcgtgaacccgcgaggcggagcctgcagtgagccaagattgcgccactgcactccagcctgggcaacagagcaagactccgtctcaaaataaaaaaaaaaaaaaaagaagaagaagaaaacgaaggctatataacaccagctggtctttatatttccagtttctctgccatccaattcgattaataactaggagtggctttcataatcacctctttcacatgtcattgcttgtcggagctgccataagcactcccaggctcgcctatcaaactccagaacttcctcctttattctaagacttttccatcagaaatctctcatctcaccagcctcatttctcaatagactgaaacttgtaaattctgtctaattaaactcattttcttagactgccacaaacaaaagattctccttcccatctgtgttccatcttcttacctccgttatcttttctcaccatcattttccaaaggattctcctctatgtgttttccctatatgtccacctgaatcttacatcttcccacaagtttcctgaaccgataaaaatagttcaaaggatcaccaattgtcatatagacacatatggagtatattttctttaaccaccttttatatttgactgagtcttttcaaaccctaaatcaataaatataacagcttgtccaattctgagactgattttctatttttatttaacctgattaatgggaacttcacatttctcatgaatttgtaatgatttcagagaaatcgttttctaactctgattcgacatacttctataggggcatgaacttactgggaaatatcactaattattcaaaaaacaatatacggagggtgaatattttatattttagtgatatttgatacgtactaatcaatctggtttcagtcaaaacatgtatttaggatttactacattcaaggcaatcttctagccaatttgggtgcagggacaaatagggtgggacgatttctacttagagtagaccagggaagacattcctaaaccagagaggctgcgtgctcctagaccctcaagtgaaacatattgcatacaatggaaatacataacagagggggctggttaatcttagcttctctgccaaggtggttttggagatgaaagttgaagcatgatagaaaagagagagaaggagctaaggtgaattgcacccagtgtttacaagcgtcctcaagtggaaaaaagtggagcatgtttgataaactgagaaatacatgcagaatacgacaactgatgggatgaaatgtccaagatgagcctgaagaggcagactgcagtctgctcttgtagctcaaggtcacacgaaggcatgcaatgctagctagagtaaacatggtaggattttatgatttaaattatattctgttgagagttctggagggggcgtagtagtgatggtgatgtaagagtgaatgaagatcaattaatcagcagctatggtggtcattcaggtaagagaacacagggtgtgaacatggattgagaggagtaaccaaatgtgaggaagacacaggaaagcctacgcactggtgactataatgagctaaggcgtggagagaatcgtgactttagcagcagggcaacatggcagcactaggaaaggagcttttggatggtgtgtgtctgtgttgcagtggtcatgtggggttttggcaccttgaaatttgaagtatccatgttacatcgacagggagatgttgagttgagaaccgaatatattggttggaggtcagaacagatatcagggttggaataaacattcaggaatccttggcacgagaatgacaatggaagccatggggaggtttttgtcaaaggatcctgtgaggaccatcgacctgctcaggagtgagaatccaaggccaatccgatatcagaacagaggaagcaacaagcacaaagggaaatgcaacttccagaccagaagaagcaaaccactgggatgtgtcccagaagcaaccagcgaagggaaatgtaacctccagactggaagaagcaagcccttggaatgtgtcccagaagtgaacaaaaatgtgtttcagaaaggatggagcgagccctaggtgcaagtaataataaggcaacaaagaatacggtcagtgagttccagtgcatttgcccacagatctggcaagaatgtacttagggaagtggtggagtcatccagcattgagacatttgggtcagggccatcgaaatatcaaggatgcaaactttcaggaagtttagatggaagcatgcagggaaggcaggagtggggaaggaatgtgggtcacaggatgagttcttaaagagataaacaacttgtatcttaatgctgggcaccagagtactagagtattagaaccaactcagacggtctaatcaccttgactttcctgtgtgtgtatatataatttatgattacctcgactgttttttgtccagctgtataaagtccagttttggactcaaataaattaacgatcacttttgacttcagataaaggaaagtactttagccaatatttaaattttgtaatactttgttattcttgaaacccttctctatacttctaagttaaagaaaaagtaatattaagtggaaatgatcacaataaagagtcatatttgaattatgtaagtgccttgtcttcagcgttagaattttatatgaatagagtatgatgagaaaaataattcagtcagagaaaacaagaaaaagtacttttaacccccaaaaagaggtaagtaacttgagcacctgcaaaagggctagaatagagtagataagagctagttagagaggttgcatactttggagagaaagggtcacaggtagctcatggtttttaagaacgaggaagagaatggggcctagagggtatcaggatgtgtcccattacgttggatagatgtaaaaacatacgggtacagataaagatgtttggtgcaagaaaggagagacaaccatgttctaaatcttctatttctaacgctaattattattatatcatgttttgagtaaggacagtgtgtgtgcaatctgtgtaaagtttaatttttgtagctcctaactaaagtatcaatagtttccactgttgaaatggcagtttactccttaaaataaaataaattaagaaaatagtaccagctagcattaaatgaaactctttctgtctctcagatctccacctagtccacgttagtatgcattaagtcagcttggttgtcaagttgaaagatgtctttattttttgactatccctttttttttcagatcctttgacatgtatctgtctttgctcattcttcatttttaccggttaattcctcaacaaagatttattgacatctactctactgagtgtccttatgctagaatgcaaatacttccaaggcacacatcatacagttttcagttttatgctgctgaaatcttacagaataactcaataattactgattgaactaaacacaacaacaacgacaacaacaaaacagtattgcagtgtgatgaaagctgaacggaacagccttcacacacatacaagtgttcaggatgaggagattctacaaacacatccagggatacaggcagggaatagttattgaattaattagggatcggaaaagccctaataatgaagagtcaagagtttaggtagcaggttgggagtagtagttcacgcctgtaatcccagccctttgggaggctgaggcaggaggaccacctaaggtcaggatttcgagaccagcctggccaacatcacgaaactctgcctctaccaaaaatagaaaaattatctgggcatggtagtgtgtgcctgtagtctcagctattcaggagtctaaggcaggagaatcatttgaacccaggaagcggaagttgcagtgagcttagatagtgccactgcactccagcctaggcgtcacagtaagactctgtctcaaaaaaaaaaaaaaaaaaaaaaagagtttagcatagtaggttcggaagatcacttcaaggacttcagggaagtgcaggaaaggatgacatgaaacaggacattactgggctttgttgatcatacgatcaaattctagctttaaacacaaggatgaataattctataatagtcagacatttaatgggattattactgaaatacttgaaaagcttatcatataattatatataatttaacagaacctgtgtacttcataactgatattactaataatgtagaactctatctctgttataatttattggttgaatgttaatttagctagcagctcaaattatgaactctctcgctttccattgcatctgttcctaaaattttcgtatcaattttattacctttatctagtatgcattttggggtttaacattttacatatcaccccaactagaaacttttcaattgtttttgaataacaaggaaattaaaatcatataaattgtgtgagttatctgaggcagacctacataaactggctccaaactttaggtaaacggactggaagcatttgagtgagattcataagattgatataatgcaattagttggaaaatgtcactgcagacacaagacaaatgggtaacataatactttgcttttcaaagtgtctgctctggaagtctttgactcaatgattctgtcaaaaaagataacatgccagtaaatttcagtgaaaaaaaatgctaaatgctctattacttcaagaaattgaagacaacaatacaatgatgaagtagagacttccagatgttgccaaccggtcatttatgaggtgtaacgaaaatatatacaacaggagcccagaaagcttttgtggaaagtctcatataaaatcacctggttctcagcactacgccggatatttatatagcatgaatattgtcagcgaatatcaagcctctgtacataggaggtaattccatgatgaaataactctcaatttctaaaactgtcttaacaaatgacaaaacacttatatgaaccatgacattacttatacataaaggcttgttagcttgaaatttctgataaatgggaattaacttcctacttagggatacgcctaggttgaaacatttagtatccgattatgtatgaagtatgattgtatgaacattatgtaggtgacaatatgaactttagtaggcgactgcaaatgtacttaacatataggtaccctgacaggcaacccggatgtattcatcacctgatgtaatctgtgtagtttcctactacagtcatcacaaggatagaaaaagtagagataatcattgagaatgtgtcacaaaactagagagagaaaaaataattgagtggctcaatttcaaaataaggctgtgaagatggattatggggggtggtcttagattgctgcaggttagagagataaggacttgcaccaaataaaagtccctagctggtcatgaaacagaatgagacatattaaaaaaaataacaataataatctgcactaaaagctgctccttctcctccaatttattatttcctgaggcaaaatggtgaaactccactgccctatgaagcattgttgatactggaaattgattttattttcttcctctttttgaatgttacataatatgtttcttaagacaccaggcatttattcagaattttaaaatctttgtcataaaagatagtctaagagaatgagtgcttacctgctgcacagaggaataacgattacaaatatttatggagcgcttaatctcagctaagtgtttcccatgagccatttcctgtggttgaaatgcaaccctatgagatgctgttgaatgcatgaacgaactgaagttcctgaaattaggtgatgcgttgggagtagcagactcaggagtgaatgctaagttttgcaaatatacagtccactcactttgacacttcaccgcactgcttccctctacaggagtttgggtttggttataccacgaaacacacacacacacacacacacacgctcatgcgcgcacaaatatgtttcctgctactatggctgaaagttttgttaaaagataaacataaaaaatacacaaataacaaccaatgttttattacctggaatgccttttttgaaactgcaaaatatttgcaactagttgacataaagttcagattggcttcatatttatattttacctttttcttaaaaatgcttattatggtacgactaacatgcaaaaagttgtacacatgtaatgccatgaactagattgttttggagatacgtatatatccaagaaaccgtcaccactctcaaggccacagacaaatctaccacctgccaaagattccccccacacctattattagttttgccattagcaatattagttgtgtgtatgcggtaaaagcacataagatctacatgcttagaaattttaggcctttaaaattttacttaaattttaaatgaaaatttaaagttctcagtgtgttttttaagcatttaaaatctaattttaaatgtttaaaatttaagctggtttatttcatttaccacgatgtcttcccgattcacgcatgctgttgcaaatggcacaatttccttcttttttaaggggtgagtaatatttcattgtatattccactttttcttcctccactcattgatcaaagtgcatttatgttgtttcctaatcctggcaattgctaatactgctccagtaaacatgggagtgaaagtgtgtgttcaaaatcctgatttcatattcctttggataattacctggaagtggggattgctgggtcatatggtaggttttgttgttgttgttgttgtttttagcagcctacaaactcttttcataaggactgagccaatttacattcctaccaccagtgtacagagttccttactccccacgtccgcatcaacacatatatttttatataatggccatcttaacaaatatcacgtgatatattcttgtggttttgatttgcgtttgtctgataattaattatattgatcacctttttatatacctgttggacgtttgtatgtctttgcagatatatctacttgggttatttgcccatttttaatttttaatttgttttctattgaagtatatgcatttcttatatattttggacattaaccccttattgaatacgtggtttgcaatgtggaaccagcataaattcccatcaaaaacgagtggataaagaagctgaggtatatgtttatatgatggaatactactgagccataaaaaggaatgaattaatggcatttgcagcaacctggatggtattagagactattcttctaagtgaagtaactcagcaatggaaaaccaaacattttatgttctcattcataaatgggagccaaactatgaggatgcaaagataattagaatgacacaatggactttggggacttgtggggaaagaataggaagggggtgaaggataaaagactacaaactgggttcagtgtgggctgctcgggtgatgggtacatcaaaatctcacaaatcaccactaaaaaacttattcatgtaaccaaataccacctgctccagaaacacctatggaaatatttttaaaaaatatgtggttgtaaaaattttctcccattccatagggtgatttttcattttgcagattgtttcttttgctgtgcagaagattctgtgtttgacgtagtcccacttcttttgatttggttgcctgtacttttcgtgtcatatccaaaaaaaaaaaaaaaaaaaaaaaaaagaaagaaatcattgtcaagatctatgccaaggatttttaaaaaatgttttcttctaggagttttgcgggtttgggtatcgcactgaagtccttcatcaattttgtgtggtctaacacgtgggccagtttcattcctctgcacgacatactcagttgtctcaatctcatgtgttgaagagactctcttttcccccattgtgtctttttggcatgttttttggttagttggcagtttttgcttgagttcactttctggctttctattctgtattattggtctatgtgtctgtttttattacagtatcatactgcttttattactgaagattggtaatataatttgatatcaggacatgtgatgccttcagctgtgttattcttgctcaagattgctttggttatctctggtcttttgtgattccatacaaattttatgacttttttttctatttctgtaaaaatgccattggaattttgatagagattgctttgaatctgtagatgactttgcgtagtatggacattttaaaaatattaattattccaatccaggaacacaagctatctttccatttgtttgtgttttcaattttcttcataaatattgtataattttcagtgtacagatcattcacctccttggttattttttccccaagtatttcattctttttaatgacattcaaaatgagatttttttgggaatttctttatcagataatttgactcagaaacacaactgagtcttgtatttttagtgtgtaatctgtgaatataccaaatttttttttactttaggatttaccaaatttgttttttacttttttgtttttcttccccaagacaagatctcactccttctgccctggctagactgcagtggtgcaatcatagctcactgaagtcatgactttccacactcaggtgatcttcctgccttagtcttctgagaagctgggactacaggtgtgtgccagcatatctggctaacttttcatatttttagtaaagacagggtctcaccatgttgcccgggatgctcttgaactcctgggctcaagtgatccacccacttcaacctcccaaagtgctgagattataggagtgagccaccgtacgtgccctatttttctaagatgcgtgtgtgtttgtgtgtgtgtgtgtttatgtgtgtgtggacactgtaggttcttttctaagactgtaacatctgaaaacataaaattttacttcttactttccaatttgagtgccttttattcttttactttcctaattgatctggctaggactttcagtactatattaagtacgtttggcacgagtaggcaacttgtcttgttcttaaatttaaagagaaatgctttcagcttttcatcattatgtacattagttatgggcttgtcatatatgacctttattatgttgaagtatattccttcaacacataatttgttgagagcttttatcaggaaaataggttaaattttgtcaaatgcttttttgtgcatctattgagatgatcctataaatatcatattttgttagtggggtatatccaatttattgatttgcgtatgttaaaacaaccttgcatcccagcgataaatctcacctgactgtggtgtatgatccctttaatgtgctattgaattcattttgctagtgttttgttgagaatttttgcatctattttgattacagacattggcctgtacatttcttttattgtaatgtaatctagatatgacatgagggtactgctggcctcataaaataagtttgaaaatgtttcctcttcttcaggtttccgaaagagtttgaaaagcgttggtttagtgtttctttaaatgttcgataaaatttagtagtgaaggtatctatttatgggttttctttgaaagaaggttgaacactgacacatttcccttatttgtattgaccctttgagattttctgtttatttacgattcatcttggtaggttatccacattttgcgtatataatttttacagtattgtatttatatttctgtaatacctgttgtagtatcacctctttcatttctaattttgagtcttctcttttctacttagcataagagtttatcatttttgtctatcctttcataaaatttcagtatttttcatttttctttaaattgtctttctagcctctatttaatttattatctaacttgtattattttctttcttctattaactttgagcttggtttgttcttttcctagttcagtgaggtgtaaagttaggttgcttatataaaatactttttatttttttcatgtaggccatcatttctgtaaacttccctcttagaaccacttttgcttcatctattttggtgtgcttggtttccattttcatttatttccatctatttttggatttcccttttgatttcttccttcccccattagttgttcaggcgtatgttgcttaattttcacatatttgtaaactaattttcctcctctccctgattttagtttcataatataagagtcaggaaagttaccaaatatgagtgcaatcttctttgatttgttaagagttgttttatggcctaacatatgatctatcctggagagagttttgtgcaaagcttagaaaaatgtatatgctgctgctgtggtctggaaggttctgcatgtgtctgttaggtccatctggtccatactgttggccaagtacattgctttcttattgatttgatgtctggatgacatgtctattttggaaagcagtgcattaaagttccatactgttaatatattgttttctattttccctccagttctgttaatatttgctatatatgtaggtgctacaatgttgggtgcatatataattttatatagttttcatgaattgacccctttatcattatattatgacattctttctttcatgtttccgtttttgcctaatgtctattttgtattataaaaatatagacaaccctactctcttctttttaaccacttgcataaaaatatccttttctatctctttactttcaacctatgtgtgctcttaaaaacatagtgagttccttttaaaaagcatatagttggatcttatttatgtcaattcagtcactctgtctttggattaaaaaaaaattaagtaacttacacataaagtaattattaataggtaagaacttactactgccatgttattaaacttcttggactgtttcatcattaatatattctgttctgtttctcgtcacattttctttcataatttgataatttttgtattcataggctttgattcttttctatttattttttgtatacctactagagtttttgatttttgttcatggttacaagtaggattaaataaaacatcttctggttaaagcagtctattttgtggctgataaaaatgtaaatttggtcacataaaaataacttttaattgtgcttttcatccaaatctgtattttatgttgttgatattactatctacatcttttttatattttgtatttattaaccaattattgtaggtatggttatttttagtacatttgtctgtacttttaaaactttttaattgatgaatataaaattctatatattcatggtgtacaacatggccttcagatattgggatatgtggaggaaaagttaaatattaaatttcaactcaactgaacatgaacacaaataatggtcaacaaataccgaaacagattgtgtgagccccttgaggtgttcatccagggctgtttcagagaaatctctatttccatctattcttatatgttagttattgaaaaacaacagacaattgcaaaaacaagttgacccttttgtgttcctggagcccagttgcgaagggcccttgtgactgggactcatgccaaacaactcattaaaagagagctagggtcccagaccacgccgaagcttcatgagacctctcctcatcagtgcactaatgagtggctgactctggagctcaggctattgtttccttgtctggtggtgaatcttccagagtctggtgagtggagtgtctgactctggagcccaggctgtcccttccccatttggggagtttatgtatgtatatatacacatacatccacatacgtatatttttttcgcttgtccccttcccattgcaatttccttattatatcatttgcttattttgtcaatttgattatattaatttgcttattggatcatttgcttattatatctgcattgccatttatgtgggacatgtttacccttaaaggtattgtgtgtgtgtcttttattctcaccttgcgcatttcccacacagaacaggatacactgtgaaataattaaatgaagctaattaacatactcatcacctcatatactcaccatttttgtggttcagtaattttaactctactctcttagaaattttcaaatatataatacattctttttatctgtagtcaccatgctgtacaataaatctctagttcttatgcttcctgtctcactgaaactttataccctttgacaaacatctcctcattttcaccttttcaccaagctcatagttaccactgttctactccctgcgtctgagtttcaattttttacattccatagataagtgaaatcatgcagtatttgtctttctttgcttgtagctatttttaaaatatattgtcctttaaatttcataaaagagttagatttttcaccattattacagtattagaatattctgaatttgactatacacttacctttacaggtaagttttgtgctttcttgctgctaataagtgtcctttcatttcaatttgaaggactccctttagcgtttcttgcagggtatatctggtggtgatgaaatttctcagctcttgttgatgcgggaaaatctgtatctctccatttatgaaggacagtttctctgagtatagcattcttcgttggcagctctttactttcataactttggatatatcgatccattttttcctggtcttcagaaagatgctgatgttcttgtagggataccttatatgttgtaaactgctttcctcttgatgctttcaatattccttcttgtctatgacttttgacagtttaaagtgtctcaatgagaatcactaaaagctcaagctgcatttaattcattgggcttcatatacctagacattcatttccctctccagatttggaaagcttttgtcattattcctctaagaaatttatctttctctgtttcttctgagacttctatgatacatatattgattcacttgatggtttcccagaagctcggtggacttgcttcatttttgaaaattgtgtatcagttttgtccctgtgactggataattttaaatgatctgtcttatatttcactaattctattttctgattggttgagtctgctgtttaaacacttctttaattttttcagtgtaatcattgttctctttagctccagattttctttgtttcatatttataatgttcacctctttgttgaactactcattttgttcatatcttgtttttctggtactcttcaactctctattcgtgttatcctgtaagtcactgaagttaagatgataattttaatttttttgtcaggcggttcaaaaattctcatttctttagggtttggtactggtgctttgttttgctattttggtaccattatatttcctttatttttttctctcttccttgaagttctgcattgctttcttagcatttgaagcagtatttctttagtccttgctgactggtaagagaaagactttaaatagttatcctgcctagagatactgtgggtctctgcatctgttctatggctatgcctgccccacttctcttattctttcttaccagtcagtaaagagagcctgaggcagagccacccagctaatccacttcccaaatcctgacccatagaaattatgagaaaagaaatgtgtgtgttttcaatttgctacattttgggctattttgctttacagcgacctataagtaatgcatttggggaatgtgcttcagcgattgctacaataacccaagaggtgaagcatcagagtaaagtacttgtgcatttatatattatatgctatcctattttaattagaaatattcaaatgacaatttaatattaagtgtactttaaaatataaaagcatgatgaaagaaataatatttaaattatacagttaaacctgaaatacagttcaaaagataacgttcataatgctgggtggtaagacactgatgcggtttggctgggtccccactcaaaacttccagaattcccaggtgttgtgagagggacccacggtgaggtaactgaatcgtggagaccagtctttcccctactattctcgcaacagtgaataagtctcatgagatctgatgggcttatcagaggtttccacttttgcctcctcctcatttttctcttgccaccaccacgtaagaagtgcctgttacctcccgccatgattctgaggcctccccagccatgtggaactgtaagtcccattgaacctctttttattcccagttttgggtatgtctttatcagcagcattaaaaccaactaatacgggcagtgaaagatatttggggacctttattaatttattttattcaagttttattttttaaatatatactatctgcataacaaaatgtagaaggtacagcagccaagcagtaaaggcttttccttatacctttaacctcagtcacccaatttaccctatgaaactaattgtctatttgtctatacacacacacacacacacacacacacacaaacaccatatacacacacacacacacacacaaacaccatacacacacacacacacacacacacacacacacacacacacacacacacacttgtggtgtgtataggtgggggtttatgtatactttctaagtcatatttttcccagacatgattttaagtactaataacgtatgttgatttatttcctcttttatgtgttaatggtaaaatcacaatccatgtcctctctaaccaatactccccttgtgccatgtatttctccttataacttttcaatctattacacactatttattttatcttatcttattttatgttttttcaccagaaacaggagggcagtaagattttttctgtcttttgttgagatattaccagtagctaatatagagtctgttataaatatttgttgaatgagtgaatacatgtgttgcatttcattagtattttaatactaaattctttattatttttcacttacaaaaagcaaataattgtttcttttttgatttaatttttgatgattattctaacatttatttctggttaattttatcagttgtttaaaatatgattttatgaaaagcatattattagaaacaattaattgacctatacttttatgtgaaacacatttgaaaacgcaattaaattcaagttaaattgacacctttttttttttttttttttttttatggagtcccgctctgtagccagggtggaatgcagtgtcgtgatctcagctcactgcaacctctgcctcccgggttcaagcaattcccctgcctcagactcccaagtagctgggattacaggcatgtgccacgacacccagctaagttttgtatttttagtagagaaagggtttcaccatgttggccaggatggtctcaaactcctgacatcgtgatccacccacctcggcctcccaaagtgctaggattacaggcgtgagccaccgtgcccggccaaattggcatctttaaaagtactttttgtgctttatgtttttataagaggtaatttagtatttattgtaattatctttaggtattattatcgtttttaactgagaataatataaattattataaataaaagatagggttgtcataaagttttgaagctataatttattagagatattatatctaacagcttctaataaataaatgctaaccttctttatattattccaacaattacaaataaatatatagcagacataagctaataattattaaggtgccagacagcatgaaaattattctgactttataagaactttatgagtattcaatggaaaaaggaaaggtatcactgtataacagaaaacaatacagccagacacagtggctcctacctgtggtcccaacactttgtggtgccgaggcaggtggatcacaaggtcaggagtttgggaccaccctggccaacatggtgagaccccatctctactaaaaatacaaaaattagccagccgtggtggtgcatcactgtaatcccagctactagagaggctgaggcaggagaatcgcttgaaactggaaggcggaggttgcagtgagccgacatcacgccactgaactccacactcggcgaaagagtgaaacaagtgaaacttcatctcaaaatagaaaagaaaagaaaacaattaatattttctttacctttgttaagcagaaaaaaaagaagatgctaatttgattgcgtataagcagaacactaagaaaaataccaaatctaccaaatattttagttttaaatttaaaaatatgtctctcagtgatgtttggcagatacttttttataaaatagtttcataaacattcttaatatgagagtcgaaggttacctaaaaaatcattttacatcaaattctttgttttgttagattatctgttaatttcttaagttcatttaacataatttttatattgaagaatatgatggttttaaaatattatcttttctaattgatgaacaattatagcatcaatttttttcttaaatttccccactttattcaaggaggcctgagtttatgaaagtataaaggacatacaaaggtaaataaactatctatagatttaattgcctgttggacatttacatttcaatgaagcagctcagaaaagaacatgagaatgatgttaatgtaataatactgaaaggaaaatagaaatagtaggtataattaatacagcctcataattacatatgctgtgatataaatgttacattgattattcaacttcttgaatgtatttttcttttaattgccaggactgagtggtaaacaaatgatatattgccctttttaaagtgcataaaaaaatgtgtaggtagcagtgaaatatcagcacaagcaatgagtcctaacttttcaaaaaccagtaactgctgaattaattcaatctttttgtagaaataaaaatgcagttaagtggaacagggggcactgcccagctgcattcacaggtttcacggccgtttgtaggcttcggtactgtactaagttcagatctacaagtagttccatccaccaatataatagatgatgtcataagaaggagaaggaagtaataagagtatacatgacaataaaaatggtttaaagaaggtatagatttttttttaaattgctcctgctctttggatctatgctatttcttaatatacgtgaatacttttgaacccattctgaaatcaaaggtggtccagatcccacccaccccgcccacccccgggccagttctatgcattcccagcgattccacctaccccaggtcatgctgtcactatacaagggtaggagaaatgtcatggagctttccactgttgcttatcagtgatctttcttttcgtatacctggaattattttatcaacctgcaataaaatgaatgctgtggttttgtgtgctaaaacaattggttgtcattgtataagaaatcttaccgatttttggtttccctgtaactctcagggccatcagcattgccatctactaattgcagaaaattaaaagcacagagaataaagaaagacttggagtgaggagagatgaaactctgcacataagcaagatgctttctactgccccctctggaaggatacacttaacaagagtgcaaggctgaggaaagctcttgcctctgcacatggtttctcttacataaaggaggtgtttgtccatatacacatatggacaggatgattttccccctacattccctcaatgagaaactcaatgctgaaattaaaaactcatcttccaggtacaaactgcatacataatttttaatactagacattatttgaaaaagttcgtgaatgttcacagccaagggtgacaatgtaatttcaaccttccccacatgagaagtgggtccaaaagctggaggggacagaacaaatcagctacaggtgctgtctctgaaggactctgcaatctgcatattgaaattcaaagtcaacgtccattggcaggaactgggttgtctgtctattctgatggaatgatttcatgttataagataaaaaataaatgtggctgcattattttgtctttaaaaggaagagtatattgtttcaaaacatatttgtatgaataaaaatactattttttttttttgagatggagtttcactctgtctcccaggctggagtgcattggcacaatctcggctcactgcaacctcagcctcctggatacaagcaattctcctgtctcagcctcctgagtagctgggactacaggcacatgccaccatgcctggctaatttttgtgtttttagtagagacgcggtttcaccatattggtcccgctcatctccaacccctgacctcaggtgatctacctgcctcagcctcccaaagcgctgggattacaggcctcatgtgagacactgtgcacagcctatatgattaaatttttaaaaactattttattgttaatgcaaggttttcttcttacactggtttatataaagatgtctctgagagggggtatgtgttacctaggcatgtttttcttccttggaagattatctttatttggtactgggaaaacctacaaaagcagtaccctaccattgtaaataagctctattccagtgagaacatcagttatacttgccgtatctattagatgatgattctatacgtgacaagtaaagtagaggtccttcttcaaagactttcctccccatctaattaggaataaatagtaacttctcttagaagcaaactttattcaaagacctgtgctaacactcttaaatatctgccagccataataaagaaatcaatgtattttatgttcttagctcacacaacttagccctggcatgcttatactggtccaagcaagcattaggtcaaagcctgttcttcttccttatttgaaggtctttttacctttctcaccattccacaagttacttcctccttcctttgttctcctctgcctttgcctcttttcaaaagttctaagttgctagccaatcgggacaaatacagaatctgaggtcccgttccagccaaaggaaacgggacacagcagtagggtggccgtgtcaggttataagtgaccctgtctcctttgttcggtgtactgtcatggcaaaactgctggcaagtgtaccctttctgcagaaaggaaaaaaatggccttgtgaggaaattaaatttatgttcaagtgctacttctttacggcaccagggaacaagcatttctaacatgtacaagggtcaagatttcttataaatttgcacttaaaacaaaataaagtaatagatatcttaatagttaacttacattttagtctagttttaaaacctaacaaatgtcacagaaaaataatttacaatggttcaattgttgctaggattcttaaaaacctaaaatacatcagcaaaaacgccctgtggaatatcatcttatttaaaggtgttaactagccatagtgctaatttccacagggaaaatcttaactgcggtatgatcgctgagataaagttttaaaaatgtgacatctttctttacatatatcattaaagcctaggccgatattgcagggtaaccatagataatttcagctaaacatcgtctgcatcttttaaagcatcttcccctcatatccatttaggaagacactaaataaatgaggttcggagaatgataatacattttgttagtttctcagaacgctctgcattttgaattgttaataaatggtattgtgaaattttcaaataaaatatttaagaactagaagtcagcagaaaagggccactctctctccctccctcatttctcaggcttctatttgaatgtcacattcattcttttacccattctgggtattgtggaaaaaaaaatctttcaatccatggcttttaaacctcctgacaattcatcagattggagcatttttaaaaggcataaaagctcatactttctccaatttcattgaattacagtaaatttgtttaacaaacttcttgtggagggaggtcaggcagcagtcagtgccatgaattgcctcaaatcattgcgccaagagttagagacagagaaaagtgcctcaggatgtcttttcaccttgtatagttctaaaaaacaaacaaacaaacaacaaaaggactatagtttagaagaaggacagcattacaaggctttaatctcaatccacaccagaggaaacaaggtgagcaaggagcacctaagaccccactaaggaatattaagtgggcaatgggacttcctattcaagcagaggactgggctatctttaaggcagagttgcaaagggagaagtgattttggttgtcagacattgtaggaaaagaaacagaaaaaaaaaaaagatcacagaacccaattgtagctgtagaatctaaaaaggactttttaaaaaattaaaatagtattgatttagatgtagaaatgggggaaaggagaaaacaataattttgtgacttcagttctaatttcatcagagagtaggattcaatataaacatatctattggaatgacacacatccagaataacattcttgaaagtagatgattttatggcttatatattgaggacagtgctggaatgaaactcagatattcctaactgtagacactgtttcatcgatactttggtcccatatcatgttactgaaaagggtcaaacttaagagcaggaaaatcgacgaaagtaatagttggttgagaattctcaagaagttttgttgctcagttaaacatgtgctcatggtctttaaactttccccatttattctgcgactagaggaatgaatataggcacttgggtgttttgctatgcctgcaacatatgccatctgcattgacatttctcatggtatttcactctcataacccagcctcagcacggtaataagaccttgatatgtaggaccttgatgctaagtctagggaaagcagcagatgttagccttattaaatcaatcaagccccacaattaaagttcaatgcattgcagtctaattagtactgtggctagttaaaaatccacaaacagtatcatatttcaccaaacatttatattgacattttgcatgttattagggaattctcaaaaagccggtccaataaactcataagatcgtaattcattgtggtggactctaatgttaattgattagaaaaaatagtgtaatgggataaaccactaataaccataaaggttaatgaagctgagttttcatttcaattggagataaaaagttactaatatatttctcttttttatgctattgttattagatttcactattgtgtaaagttaaatgtttttgaattttctattccaatagcaacacacttctatttagtaaagtaactaaatcttttttaaaagtgtatgtgaatttttaaattttttgctttctaatatcctgaaaaactttttaaatgtttaacattatagaacaagtgaaatgtatgataaaaaaaaaaaactgcttgtggcaaattatctcattaaaaaaaaacaaaagaaacaacattattttcctctttatatatctggtttatatattttgatttttaccaatgtaatacatttatctaaagtccacctccgtggtaatacctagtgaatctccattttttccaaaacaatttcttgttaagtagaaaaggagaagaaacaagatttagagtacgtgttaaattgactaatctaaaatattttgctttattcactttaaaatatatttatttgttaactgaagctttcattaaattacttgaaccattaagctgtttttggcgacatttcagtttagtactaactgaaataaataaatgagtctatcaggacttgtatgtatgacagataaaacatagactaagcatttcccgcctacatcttcactcccacccactcaacccctttcagccatggtcttctttaacagagaagaccacagtctgcaggcctttgagaagaaagagatgagagtcctggcaaaacaggatacattgagaaaatataggagtgtgtagaactgttaagatttgcttctggtaagatactgttagtctctatattgaagagatttcagaaaaacagttattattttacaaaatgtttcgcatgcaatttgtgctccttttgtatgcaaaattacgttcaaaaatcctaaaggagaaatgaggtgagatttatttaggttttatatattttcctgctatatttatttttataattcagatcttgcacttaaaaccaattagtccaacatggacatactgctgtgctctgaactatttttttcacatttaacaaagctttatttactttctctaggccacctagtaaatatgggtgaaaaatgcgatgaaaaaccagccagggacctaggcagggaccacacagtcgggctagtgaagtggcaaacccatggcaaatattcgcctaaggcctgaatccacaatgagtaggaagccactctgctctacactgagtatcagtgacaccatggccactatttcttttctaaggaatgtttttgaaaactaaaattaaatgattacccacttcacaaaaaagatgagctcatattttacagaaataactgaatagaatctcggctaaaccatgatcttaatttcattacactcctacctaatcaatgatgaaaactgatgaacttgctcagaataatcattccgctgttcttcatcaatttaatctgaaccaaagtgcctactatgtataaatgaaaatttcaaaaatagttaacacgtacaaaaagaggagaaaaatacatatttagtcttgcactgattttttcatcttgtattcattgaaatcagtaatgaacaccggtagtaattgttaaaaattgttctcataattttcaaagtaaatgaatgtctttttttctgaagtatttttaataattgaaggaaaggtaatgaggccagacctaaacaagtgctgcctttatcactaactaagggttaaacaattggtatatttggccaggcgcggtggctgatgcctgtaatctcagcactttggcaggccaaggaggtagatcacctcaggtcaggagttcgagaccagcctggccaacatgatgaaaccctgtctctactaaacatgcaaaaatttagccgggcatggtggtgcactcccagctactcgggaggctgaagcaggagaatcacttgaacctgggaagcagaggttacagtgagccaaaatcacgccactgcactccagcctgggcaacagagcaagactctgtctcaataaataaattaattaaataaaataaaaacaattggtatatctgtttgagttttccaagaagaacattataagtacgggagtagagggcatataaaagtaatatttacaaaaaactaaccaggcacccagatctaaactctgtaatacacataatcaagtgcatggagtatctgaactccaaagctagtctcgtttcttttgcattgcactggcttcataactacaatatgcttacatctaatacttaaaacaacatgccttctcacacattttctctgtatgtcagaagtaagatttttaagaagcaagaatatggccacgactcgtctccaagaaagttcttactaataacaaagctccaacagaacaaatggaaatcgttcttaaaatgtagaagaacagaatcattatatgaaagaattttcatagatactgtatttgatacactccatatcagcatgaaacacttatatatattagtgatacttggttgtttcacttaagaaattgtcatacacaggcatacctaatctctttggactttgctctattgcattttgcaaataactgggtttttgaaaaattgaagtttcctggcaacccgacattaaacaggtctattggtgtcattattccaattgcatctactcgtttttggtgtctgtgccacattttggtaactttcataataacccaggcttctaggtatatgattgtacttgctatggtgatctgtcatcagtaatttttgttgtaactattgtaattgtttgggggccccatatgtgtccatataagtggtaaaattagtcaataaatgtgtgtgttctgactgctccactgactggcctggtcactcccacatctctctacctccttcattgggcctcgctattccgtgagacacagcaataatcaaattaggccaattaataagcctacagtggcctttatgtgctcaagtgaaaggaagagtcacatgtctctatcactttaaatcaaaagctagaaatcattggccttagtgagaaaagtatacttaaagatgagacaggctgaaaactaagcctcctgcactaaacagtgagccaagctgtgaatgcaaaggaaaagttcttgaaatatagtaaaagtgctatttcagtgaatgcaaatgataagaaaggaaaacagccttattgctgatatggagaaagtttagagtgtcctgggtaaaagaccaaagcagccgcaaaattttcttaagccaaagcctaactctctgaaggtagagagaagtaaggaagctgcagaagataaatttgaagataccagatgtcagttcatagggtttaagaaaaaaaaaaaaaagccatctgcgtaacataaaagggcaaggtaaagcagcaagtgatgatggaaagctacagcaagttatccagaagatctagctaagatcagtgacgaaggtggctacactaaaaggcagatattgagtgtaaacaaagcagccttgtattagaagacgataccatctaggattttcatagctagagaaaagaagtcaatgactagctttaaagcttcagaagacaggctgactctcttcttaggggctaatgcaactcaggattttaagttgaagccagtgctcatctaccattacaaaaatcccaggatccttaagaattctgctaaatcaactatgctccatcaatggaacaacaaagccgggaagatagcacatctctttatagcatggtttactgaatattttaaggccactgttgagacgtactgctcagaaaaagattcctttctaaatattgctgctctttaacaatgtacctggtcacacaagagctctgacagagatctactaggagattaatgttttcatgcttgttaacacaacatccattctgcagcccaagaaacacgaaaaacttttgactttcaattattgttatttaagaaatatgtttcataaggctattgctgcatggagagtgagtccattgatggatctagctagacaaggtaaaacaaaaccctttggaaagaattccccattccaatgatattaagaatgtttgtgattcatgggaagaggtcaaaataccagcacgaacaggagtttaaaagaagttgatttcaatcctcgtgaatgactttgttgggttaaaggtttcagtggaggaagtaacttcagacatgttgaaaacagcaagagaaacagaattagaagtagaactgaattgctgcactgtcataagatcttaatggacgaggagctgcttcttatggatgagcaaagaaagtggtttctttagatgaaatctactcctggtgaagatgctgtgaacattgttgaaatgacaacaaaagattgtgattatttcataaactcagttaataaagcagcagcagggttagagaagactgactgaattttgaaagaatttctcctgtaggtataatgcttcttaaccagcaacacatgctatatagaaatatttcattaaaggaggaatcaactgacgtggtaaactttactgttgtcttattttaagaaattgcaagtcacctcaattctcagcaactaccaccctgatcactgatcatccatcaacattgacgaaagaccttccaccagcaaaaagatgatgagtcattgaaggtttagatgattgtacatgtttttaaaaacataatactattgcacactcaacagaatgcagtgtcatgtaaatataactttaatatgcactggggaacccacaatatcatgtcacttgctttcttgcagtcatctgaagccaaacttgcaatatctctgaagtacggctgcatatcaataactacagacatcttatcagacattatagtttccacattagtacaccaggtacgatattactgattaagatgtaatatatttttctgtcatgagagcctcacatagaatgttacttcaattactgcttacacaggaaattttatgatttaaagtttataattaaattcaaatattactcgaattactgcatacacaagaaactttatgatttaaagagttataaaactttattaaacctcagttctaatgtttagttacatactaacttacggtgaccatattaagttatatcacatgaatttcaaaataactaactataaaacccagcatctaacataaaataaaaatgctttcctaattgacttccaacaatattctggggattacacaggatcgtgtagtagaaattttgaaagtgtgaagcatataaaatgttagatgtaaataaatattttattaatttctggtaattgtgtcaataaaagttgggcattgacattgcctgtcatttttgggtaacatccagtcactgatgaagccatgtgtaaaatgctttactgtttaaaaaaaattaaatctacagagcacaagggaaaaaactgcatgctggagttccttaaataatttgtgttttggaagaaaaaagcatataatacaacataaagtaatagagtcaaaactgaatatgctgaatgcaatcggtggtaggctagttttgatttgggcttcaaaagaatagtagagcttaatgtctttgtgcagtggatctgtggtggggataagtaaattgagtacagaggatggggagaaggtttcctcggcaacaatggacagactctgttgggggatgatttgagaggaccgatgctaccaatgcatctctttttttcaggcatttcttggaaatcatgctgtagaccccgaataagggctaggctgccccagcaggtcactgcaagtctctttgaagtctgcttctgttaattactttgaatggcaggagttgactctacaacaattatagacccaaacataagttgttttcctcatctcagcaatctatgtcaagtgcctttgttgttaatgtgacacgtcagatgaatccaaacattttcttcagtaaaatatttagctaacatatctttattttagacaaagtaaaccttttcagaaggcaagtgaatcattaagtgtgacaactgtatatctatatgctcaatactctatcattctcaaacacagtaacattttattagttcttaaaaataatattcataggcagggagtatgagagtgtggaatggggtggggtagaatattacatgtatagtgaaatggatttttattccatcatagtaattattgagccaacagtctgacagaataaataaatctcctaagatgcataaattgttgagagtttattgaattacagaaaaactgttcttgccctgtggagaataaaccaatctaacatagtttctgagtgacagactgtataagagaacccaacacaaaagtaattcatcacgaataaacttttaaaatccatgttttacatatgaaaaaaaatgctcaacatcattaattatcagagaaatgcaaattaaaaccgcaatgagataccaccttactcctgtaaaaatggtcctaattaaaaagtcaagaaaatataaatgttggcatggatatggtgaaaagggaacacttttacactactggtgtgtgtataaactactacaactactatgaaagacagtacggagattccttaaagaactaaaagtagaactaccatgtgattcagcaatcccagtagattcatttggtatctactcaaaggaaaagacgtcatcatatgaaaaaggcacatgcacaagcatgtttatagcagcacaattcacaactctaataacatggaagcaatgaaagtgatcatcagccaattagcagataaagaaaatgtggtatatatacaccatggagtagtagtcagccacataaaaaggaaaaaacagtgccttttgcagcaacttggatgaacctggagaccattagtctaagtgcagtcactcagaaatggaaaaacaaacgtcatatgttctcacttgtgagagctaagttatgaggatgcgaaggcataataataatataatggacattgggtattgggagaagggtaggaagcgggtgagggaatgaaagactacatattgggttcactgtaaacttctcggatgacaggtgcaccgaatctcagaaatcaccactaaagaacttacccatgtaaccaaaaaccacctgtaccccaaaaactactgaaataaaaaataaatccatgttttaaacagaaatactgaagatgtgtagatttacatataaaatataaaaacttataaatgcagatacgccttacacattttcttttataaagtaaatagtactactatacaagttattttaagcttgtcattgtgtttcaaacatgaaagatctcatgcttattatttttgaaaaagttctaccaccaaaaaacagagaagttaattttgcctacagaagaaatcagactctgaaatatctattaatgatagacattttagggtggtgaatttatatatacacttaatatttttcaaaatttgtatttcagtatgttagcaatggtggggggaaaacagtatgttattttgaaaattatattgaaaataatgacaaaaatgtttataatatgtatgttgtaaagaagtaaaacataagcacctttcaaaataattcagtatattcagtaaaatttaaattatttcctctgtgtgtgtgtgtgtgtgtgtgtgtgtgtgtgtgtgtgtatgtatgtgtacataggtttctttgtgtggatataggtattcaagaacaacaacaaaaaagaacatatacaccacaacactgccaatcaatatgtaaccttaactttcttgtttgggtttcctagatgttcccaaatttctataacatacctacattgctttttataatacaaatttcatactagcattcatttttaaagtagcttatttttcaaattgttttgttgtatacacagttctctttttattaaaatattattaagactataacaaatatcttaaaaaccacaacttaacccaagaagtttattaaaaactaatcatacgcttcttccttatgccatctcccttctccccccgagattatgtctacatttaaaatatatgtatgtatttgtccatattttacatatatgtccaaattgtcatttacttttctactgtttttattttttggaggcataatagatgtacatatttccatgctacatgtgataattcaatacattcatataatcaaattggggtaattataatatccatcaccttaaaatttatcatttatgctagaaaataaaaataactcatatgtatacagttaagaagaaataaaagcacatttcaaaataaaatattcagaatattcagtaaaatttaaattgtgctagagaacaattcaaaagttcctagcaaatgtattaattaaacatttagctgaaacctgacttgctgaattacaaattcccaaaatattattttaaccagattctctggaaacatcctatgccatttacaacttttcttctacattgtataatgaatgctgataataattttcaagtaatttttgatttctcaaaagtttaaaattgtaaatatttctgtccatcagtctataaaatttgattgattcctgaaacactaaggtcctattaaatgcatcctcaaggtatctgaataaaaggagctttgatttaaatgtgcttagttttaaagtgctctctctccgagcagtgggtttccttggatattttactacctacacatttctattaataataagcatatggtaattcatgaagataagacttaatgaaaaaaattaaactctttttcaactgcaagcccacgcagagtttgactagaatgtaatgagattttttcccagatgttatttatttattttttaactacagagctaaatcttgcctaaaacagcatggacacacacaattctttgattccaatttttcctctgttccctcatacgcaaggaaaaataaaaatatagcgcaattccttaaaccaaaagggtccccaaccctggctatgggccagtgtcagtctgtgcccttttaggaattgggccatacagcaggaggtgagcagtgggccagctagcaaatcctcctctgtatttacagcccctccccattgctggcattaccacctgcactctcctcctgtcagaccagcagtggcattagattcttataggcgcgcaaaccctattgtgaattgggcatgcaagggatctaggtttcgagctccttgtgagaatctaatgcctgatgatctgtcacgctgagatgggatcgtcacccccagatgggaccatctagttgcaggaaaacaaggtgtgggctcccactgattctacattatggtgacttgtattattttcatcatatattactgtgtaatcttaatagaaataaactgcaccataaatgtaatgcgcttgaatcatcctgaaaccaatccctcctcttccagtggaaaaattgtcttccaagaaactggtgtcaggcgccaaaatggtagaggacggctaccttaacccaagcaccttttctcaaagtgacactgctaaggcaaagcattacatttatggtacctgaaccacaccacacctggcccatttgactatttctacacagatgcctggatgagcaatttaccttcagggactataaccctcaacccaggaggacaccggtgcatgaggactgaaaatgtgctcagttcagcttcacagagagatagatgtagtttttcctctaaaggcgacattggtccggccattctacttactggttagcctcagtttatctttaaaaactgtttatgatttataggtccttttccctaatgcccttttaaatttctgtgttcttaatataacatacgctcaaaatactaatgcatgtgtgaagtctgtatttattactggttatttaaacagttactgggataagaaaaatattttggcaatacctaaccataagggcaatgattgagctatagtatcgtcccacaaattgatgtgataatgtcataaaatcaaatgaatacatcattgtgatacttttttttgtcttttaatttaaaaaatactggcacgacaacacagtgacttagatatattgtgacagtttcaccagtacgttactaaggggaggtctaaattattaagttttattttgttactcaggaaaatcctgcttttcagagaagataaatgcaataaaatctctctattaccccacattacctgggattcaacttcggaatttatgtttgtcattaaacaagctgaatgcattgttatcttatgataaataatataaaaatgactcaattgaggatgtttcctggtgttcgatttttatcaactgttttgatttaacctttgtacaatcaacattttaaataattttagttctatattttataaagtgtatgcaaagcactttatcacccttgacaactgcagaactagaagagtgaagtattcttgtagtgagtgaactcaattttgttaaaaaaaaaaaagtcagatagctaagttatattagaatgtcttataagttgtttttttttcattaaaaaaaaaaaaacagaattccagcaattgtttctgacaaaaatgatcagtcagtgggtgctgaaattagtgaacagaagtattattgaaaatggaatctgtacagagattcaaagaatctctcaaaaaatatgtattatttacaaaaagaaaaatagtgacttttcatttgaaatagctggtaaaccccatgtaaccaagagatcaaagttactatcacaattaataggacaagtcaacaggggtcccctgctataatgaactgaagacacaatgccaattctggacatttctgccaaaaaaatatgaatcacctgaatctaatcacaaagaaacagttaaataaacccaaatttagggacagcctgtaaaataattggcccttactctccaaaagtgtaaaggatatggaaggaaaaaattgccgtttcctatttagggaaacgaaagagacatggcagctaaatgcaacctgtgatgctgaattaggttctgagccagaaaacacaatggtggaatgttaggtaaaatttgaattaggtctgaaaattaggcaatgatattaaatcagagttaatatattgactttaatagttatactgtggttgtgaaagaacatgttcttgtttttgctctcaactatttcaagaaaaatatacagtgagaaagaataaagcaaatgtgataaaatattaatatttggggaatcttagtgaaggctacacagaatttttttactgtttatgcaacacttttgtaagtctgaaatggtttgaaaataaaaagttaagaaaactgtctctcaggctggtgtttttaaaaggtgtctccttcaaagagagagcaaagtagagaaatcaaacctgtcagtttgagccccggataattaacttttgcataatgccttattttttaaagaataatttttgtaccaaaataagatgtgttcctctctacgactgaatattgacaattaactgagtgggtgattcttcttcatattcaactgataaaataagcctttctagttttggttttttttccctgaaagttttgatgttgtcagatcactttaacctttagattaggcagagtttgagttttaattaccacacatatattcaaggaaatttaaattgtctacaactttaaaaatacttatcatgcaaattcccagatatgccaacatattcaccaacagagacttttcctttataactggtggattcatttttggggaatggtgggaaataaaaagatctatgttgaaaatgcctcaggacatttgtctcttgacaatatttcaaaataatgcacttttcaaaactatactctcaactcttttcttacaaatacccaaatgatctattctgtttttgcgtttcttcccccgccaatccaataattagagctagttctatgagttggccacagctctgacagttgattctgggttgtgttttctaattcatccccacaatcagtgtttctgaacgctgtctctcactttgttattcttcgacattacaaggatgacaaagatatctaataattatccatctaatgcggttcacccgcaagtcaaatgtgaaatgtcagatgtccaggacatccagagagagctctataatccctcattttataaatgtttaagacaatgtgaacaggctgaccccagataattataaaattaagcctttgtaagtgatacacaatttgaacaatgattgccaataatttgaccatgagaaagacaaaaaaaaaaaaaaaaaaacagaagctaactatttcttctggaaaattgtctttagacgtgaaaaattaatataagctgaacaatacattctccatcatgtaaattgaaataatcactagtttaataagaaattaacttatacttaaaattactatggacataatgatgtccacaaagctttcataaaggtaacaaacctgcacaatataaatgaacggcttaacttttttgggggggcatattacaaataacttcaatagtctaactgctaatcttttcaattgttttcttagttactcttcaactgtgaacttcccatatttccaaagtttattggtaatagtgaaaggcgttgattcatataacttttgagagacaagtttaaaaaaatctcttaaaagaactcacaattaatatcatcattaggcaaactaatgtactggttaactcacagtattaactaagcctgatgtattattttacttaggtgaaatgacgacagtccagatagctcatcgacatttaaagctcatttccttaccttaggttactaggggatagaaaaccaagaaatgggctggaactggagatatgaaagtagatgagaagcaatttcagacttcacacaccaacacacacatgaggtagtataaaaggtaaatattgattgtagtgaatcattattccagaaatgctgtagacataagaacgtactgactattcactcaagacgtggctccaactaagactatcatgattattattactaataacttaaatttattgaaaggttatgttccagaccgtatttaaagcactttacttaaattttgctcataacattctacgatgtaggcgctacttttacctttctttcaatactaacgtaaagtgtaatggtgatctgtggaggactttatcgcttgcaccttggaactgattccatgcacatgatctcacataatcccaatgcaccctttgaaataagattattacaaagaataaatctcagtggtttagcaactgttctaaatgacttgatcttccaagttgtatgcatcttgatattgtaatttccatattagagaacacagtaaactagtctcatctcctcagtggaagtgttatctcttctttacggaattacctcacattttcgtcaaaaaaatcattttatcacgtatgtgctggcctgtctctggattttctcgtctataccattgagcaatcccgcatcaccttggctactttagctcaatattgacatcttcaaatcgtattatgtaagtcctcccactttgttctttttaaatcatattgactattctaggcccttggcaatttcatatgaattttacaattagtgtgtcaattcctaaaaacaaacaaacaaacaaataaatgatacatccttttgggctcttgactggaattgtgttgatcctacagaccatctacagatgaataaacttacatcttgaaagccctgcatcttctcattcatggtctagtgtatctccccttttcatttttcatattttgttaggtctttagtaatttctctcagctatgttttacagtttcagcatgcagtcttgcatgtatcttcttaaatttattactaaatctgtcatattttaattctgtaaatgttataattttaaaaattttgttttgaaattgctcattgcttgtatcgatttatattgtgatctcaaaccatgcaacagtgccacctcacttgttatgtctagtaacttttgtatagatttaaaacaaaattcacagcaatcacatcatataaataaatacgttggatctcatatttctaatctctatgtctgtatttttcttgttcatggcacttgcttggtaacttcattacatgttgaatagttgtaaaagtggatattatttttgtttctgattttatgaggaattgattcagtctttcatcattaagtaagaaattagttataaaatttccatggatgccctttactgggttcaggaggtttctctcagttcctagtcagctgaaaagctgcatgataaacagatgctgaatttttatctaatgttctttccacatttattgacgtgattatgtatgcagcttttaatttccagtctgttaagattatgaattacaatgattttcaagaatgttaaaccaatctcgtattcctgaaagtgaccccagtggtcatgacgtgctatcctttttataaatcactggatcttatttcacaacatttttaaaaggttttttctgttttcgtttcatccagtttaattttttaatttttaggtaatatgtacttcatatttggaaattaaacaacactcttctacataacccacgggaaagctccttatatttggaaattaaataaaccatgggttatatagaagtgttttgtttagtttccaaatacgaggagctttcccacatattctgttatcaatttacagtttaattatgttgtgataagataatataacatagtatcaaacatttttaattgactaagcctttttttaacggcacagaatatagtttatcttagtgaatgttccatgtgcggttgaaaggactgtgtcttccgctgttcaaggggaagtgtttcatatggttcaagtaggtcacatttgttaacagggctaacaaaacctccacagccttttcaacttatgtctacctgttctattagttaaaagtcctgttaaaatctccaatggtaggctgggggtggcgtctcatgcctgtaatcccagcactttgggaggccaaggcaggtggatcacctgaagtcaggtgttcgagaccagcctggccaacatggtaaaaccccgtctctactaaaaatataaaaattatctgggcatggtggcaagtgcctttaatcccagctactccggaggatgaggcaggataactgctttaaccgagaggcttaggttgcagtcagctgagattgcaccactacactgcagcctggcaacagaccaagactccgtctaaataataacaataataataataataacaacaagtgtcgcagacatagtatgtgctatatatatttgttaaaaaataaaaacaaaaagtcatgttagtctgcatttgaagagtataaggggcttagaatttgggacagaggctttaataaatgactgaagagcactttggaagcactgatgcatacaggagagggagggagaacaagaaaaataggggaaagacgttaggttttgtgacacactttgaatgtgacccttctttggcagggaaattttctccagaagttgttttgaatagtttgtcttcttatattttctttattttatatatattatatttggttgctggacaaagatcttgactgtgaacttgctcatgataaacgatgaacgtgttttaacatcaattccacatacttactgctttccattatctaaaagtacaactttcctaaagaaataatggaaggaccaatgagttctattccaccaacttaataatgaataaaaccaacaatcaataatacagtgacttaatcagctagaaaagatgagcatttcttcaatatgactattacaatcaaaagcagttttactacccagttatcattttgaagagacatttttatttgcaaggggtatccaattttcaatgttctcattattcagaaactaacaaaaaaggagattttttttttcagaacactgactggtacaaaaagcattagtagaataactgaggatgggctactggaaaatatttatcaccagggtaagaagttgtgtatataacaattaaaatgtattaaatctgaactagaattttctaattcatgagtgtgatattactgtttttaaaagctatttttaattaataaatacaaattatacctatttatgatgtgcgatataatattttaaaatatggatgcattgtggaatggctaaattgagctaattaacatatgcattgctttacatccttatcatttctttatagtgacaacccttaaaatcttctgttagcaattttgaaaaaatacaatataatgttatcaactacagctatcatgttgtacaatggagctcttaaactttctcatcctgtctcactgaaatgttgtagcctctgaccaagatctccccaacacctcaatctcacagtccctggaaacaaccactttacttctcagactattctaactatcacatggatgaggtatatagaagctctaacaatttaaggaaaaggatacattttaagcaccaatactatataaattaaaaggttattattacactgtcaggagcaaagagagaagctagcaacattaagtgtgtctaatttggggttattttggggttcttttgtgtgggggaaactaattgaagaacatgagggtgggtggtttgtttgggagatgattttaggtacaagattgaaggggcaacgaggatgagagaaaggaggaggagaaggaggaatattataagggcacatttcctgattcatggtatgagcaatggggacttgatcccaccaggatctccaagaagcgcacaagacagccacaagcactgttgcctctaacacatggaaagctggggcaatgacctgcttccatctttcattgattgaggggatccctggggacatggcctcctcattcagccccaattcaagattgtgcctccatgggaagctccaggtgttgaggcaggacgtgaaaacacacatggagaggttcatgccagcagagcgacgtgtctccaggcttgcatgaaattacccactacatttgccagggtccacggcatttcctgtgcgtatttgctgtcacgctacagacaggactgagttgccagaaaataaaaagaaaatcttccttaaaggcaatgataataataattagacacgttacactgacctgcatttatacaccagctgacttacagaagaaaggtaaaccacaagaccctagaggccacgatccaatactgactgtgaagtttctcatcatgcagtggaagaattatgatgatgaattagtagtttgatacttaaacacaaattatcaaaataaaagaacctattctccagtttgatagtttccaagtagaaaagccatctgactctagctggtctgcataaagtttaagaacagggaaaactctccggtacagttccaatcggcctacgggtcaatgtaagtagcagaagagaggttcttctggatctccaacgcatgagtggttcagctgctaatgcacaaacataacacgcccctttacttctgcagactccgtccacttgctgccagttttctcagcatgacagagcctcaatacaagcgttccgcttgcccatagcaatattgcgtgaaatatgaaaccaccattaagtcgtggctcagcaggaacgtgtttgatctttttcttcatgatggttaaaaagttaatgtttctcctgccactttaataatgcattatggagcacaggataaaacttcttcctcaaaatgtaattggggttttcaatcttttttatctcttacctcatcgctaacaaacagtacatggtataaacatattcttcggtcataataggtttagtatattaaaatactgtgctaagtagaatattttctttaaaagattaaatttcattttatttctctttcaaagaatacttaataaaaaataaggaaaaccaatattcataataagccctgaacagacaagaagaaaaaacgattcttttcatcacataacagttacagtaaaagcataattcaactgagccccgtttctgatctacaaaagtcactttagtgagatttttaaagctgtttcaactatttgaaaataatacttgaattttatacattaatctgaaagaatatatctacatttataggcaggagatgtctcaaagttgtttgttttacaaagacagaagttttgaagcaaattcctgccatgtgagacaagacctgtataggtagtttgtggggactgcacaggcgggcacgggtctgacggtgactgaggccagagtggatttcctcctcagccctggcccacctttgtgtcttccatggcaccttctcctcgttttaagcaccagcccagtgtcctgaacggagcaggaattcaagaattcaataagtttgttaattaaatgaatgcaaaaggcatttggggcagaatgtaacttaaactctgttcattagtgggatgtagagtgctgtattttcctccgcttgtgggattccaactgcttgaataacaactggttgacctgagccccagaaattaaccatgtaaatatgatgatctatctaagtaaaatacatcgccaaagatatgaatcatcatagaaaacaacgagagaaatactactactctaggaaacagctgacaaaaatattggaagaaaggttaaaattttttaaaaattaaaaaataaacatttgcagatatttagttctaatttaaaatgagacttcatgggtattaacaacatggggggcattaaaacgtaatagatgagtagaaaatgagggtgacctgtgctgagaacaaattagtgagctggcaaagaagtgaaaaatagtaactcaaagttaacccaaaaagaaaaattaaatacataacttgcacattaaactacataagctatcctggaggaaaaaaaatcttaaataaccagtttcccagaaaaaaaaatagatatcgaatacataattatgaaagtaataataaaggaaattttccctgattacacttggaacaacttcaccatttatgtccaagatggatgaaaagatactgacctaggtaaataattgtaaaattcattagttgtttgaataaaaataaaaatctttaaatttccgacagaaagaacaaattatttaagtagtggttcacaaagtatggtcgcagaaaccttcaatgggacagagcagaaactgttcatggtgtctccgaggtgaaaagaattttcataataagaagattaagatggtatgggccttcctcactcttattctcctgagcacacagtaaatacttctagaggctacgcgaaaggtgtcgtggctataaattgcatgcagaagccaatagaataattcaaccatcttctgttgaaccaaacataaaatagatttaattctacttagtttcttcattaaaaatatgtatgttgatatgtaaagggtaattattttcataaattaattgattcacatacactttaactcagttttactttctagtactaacagatacaagccacataaacaaaacctccttcaggtttggaaaattttttaacagtataaattcacagaggcagaaaacagatcagcagtcaccaagagacagggagagaggagaatggaagaaattccttaatgggtagagctgttttcctggggtgattacagattctgaaatcaaagagatattattgttgcacagcattgtgaatacactagatgtcactgaattggacattttaaaatggcttattgtatgttatgtttatttcacttcaataaaaacaaaagaagtacttgattattaagcaatactctcattaatcaaagaaataaaagcagaaagttattttgaatgcagtgaaaataagagcaaaaaacaaatcatctctaacccaaggcaactcagcgaaagctgtattgagtgcaatttatgtcttcattaatgaaaaagaaaggaatacaaaacaaccttccagaatacactatttaaaaattagaaaaataacattatttaaaaaaatacatgagaaggtttactaaagacaaaattataatcaatgaaaagaacagaaaagaaacagtatttgtaaaggagaagaaaatcaaaagctttctctgaaaagatcaatgatcataaaccctaaaaaataccatttataaaaaaaaatcaaactggattagagattttactttgtgtagaagcactataaacattataggattaaaatcaagaaaatatataactgatataggagttaaggagaagtttttaccctggattaagagaattcaactcagaaattctctcataaaataaaagattatttagcatatattttacatagtatgtataaacattacatgccatataatgcaagttaggtgtttatatatacttagatattcatgtgtaatgagtatatagaatgtttctactcaaaaattattttgcacagagaagagaccataaacacacacagagagaggtgtatgggctgagtttgggggtttcactgggaaaagataatgacattgccctgagtggagttttacagcttcaggacttccctgggatagataattggagctattaaagtgggtcactgcgcccaagcatacgcatttcaaggtttctatgttaggtgcctcacctaagaacgctgggactgggagcctggggaagtgatggcggggaggggtgaggggtggataggcacggggactcaggagaagcttcccccacagagcccctgagctgctccacgtgacagctgagcttatccacaagccccgcaacacctcagagctatacagccatgagaggtctcattttccctgcagttcctagagagcctaatgttctgggtggtctcctgtgtgaggtgctgtgcaggccccaggactgtgctctgggccactgtctggaacggccctggcaagggtggctctgggtctcgccttaggctgggagcgcacaggagcccttccttcctctggtggtgatgcctccaggtctcagcgccacctgctcatggtgagcggggcacatgcttgggagctcctgtccccgggaccccgcctctaggaagctcgtgcaggggcctaggaacgtggccagtgggagagatcccagtttcccgaggggaatcacatatgggtctgtagaaacttcagcccttgcatcctcagaagaaggaatttgactgaggggcataaaggagaaaaagagacccaggcaagtccagagcaggagtggaagtttattttaaaagaccttagaacaggaaaggaaggtgcgcttgggagagaccagggcatgcacgcgaaggctgaagagagaaggtcaagagccatttaactgggatcctaggacttttttttcttttttgagacggagtctcgctctgctgcccaggctggagtgcagtggcggtggtgatctcagctcactgcaacctcctcctcccgggttcaggcgattctgctgcctcagcttcctgagtagctgggattacaggcacccaccaccactcccagataatttttttgtatttttagtagagacggggtttcaccgtgttgctcaggctggaacgcctgacctcgtgatccgcccaccttggcctcccaaagttttgggattacaggcgtgagccaccgcacctggccggatcccaggacttgtatagactcccctctttcccatgattcttcccttagggcaggctgcccgcatgcgcagagccctccttgcccctcagaactgagcatgcgtaatgtggcagggagttacatgcacgcagagcctccttgcccctcggaagcgagcatgcgcagtgtggcagggagttacatgcatgtgcattggagtctttcttccttattctggtggagggtacgtggaaactcatgctcctccatctttgtcctttaacacttatgcacagaaagttgtttctccctggggtctgcattcagttaacattttgatgttaataagtgtggaccatcaggaaatggcctctcctttgcactgctaatttatcattttcaaagaggcaatgcgataattatgaaccatcacctgacatttctagtgggtgcgggaaagccgtctcctgcccccctcatacctaactaccggtaacgggaagacagaagcactgactgtcctcctgtcctccaccacccgtgaccacgtgcagagcaccttgaatgcgcctctctctcctgtgagaggcccccacagatcccaccggcaatgccaaccaacatgcaaaagaggcatgcagtgtcaacaccaaacacacatccagtgtgttcttggtgaaactccatgttacgccacagaaacaaaaaccatacatccctcatcttactggttcagagattttccaaaaatgactctaagcttccatttaagacacaggtcaacaaataaaccagaatgaaaaaatgtagaaataaagtagaattttgtactgatatgtcattctctctactcatgtttgaagctgtcagccaacctctaataagtcagtagaggatttggcgtctgaaaaaatgtttacatattccataggagattggtgctacctgccctgctccattttgtagtattgaatatctcatcaataaatacctcactacttcctctttcaccgattctaaaagagtgtctcagaggatgaggaaagaggatgaatacgtggacacaaagattcttcgagaactgcctcaagtaagaaaaaaacagggtcaaatacatagaaacccagtgaattaatatcccttagaaatcaatcatatctctggttgattaactgaggggttcactttgccccctgccacactgagatctctgttcccccaggctgggtgcaatggcacgatctcggctcacttcaacctttgcctcccgggttaaagcagctgggattacaggcgcccaacaccacgcccaactaattgtttgtatttttagtagagtcagggtttcaccatattggccaggatggtctcgaactcctgacctcaggtgatctacctgcctcagcttcccaaagtggtgagattatttggcattagccaccgtgctcggccaggtttcctttctaacccttttaagttctgaccagatcctggaccaaaatctaataatcttagatgcaaaaaggttgtacaattttggggtattaaccataactaaatgtagatagcatataatgtgccaggtggtgttgttaactttttcacaaattaatacatttgacttttaaaacaatgaaaccatcacatcaaaactgttattatccccatctcaagatggggaaactgaatcagcaagatgttagtcagttgccttatagaacaattagaagtgagagagctagaatttgaagcccagaagtctaactggaggcatgtatgtttagccactatgctgttgccttgtgatagcttgagtttcataatcatccacgtacattcctaaagagattgtaggaaaaataaagaggacaggtggaaactcagtaaaaataatggctactttttatcaaatacttaatatgtatcaaatactgtgccccatgttttgcatacataatcattaaattctgataacaagactaaaatgttgttattttcatttttggataagacgactgaaaattatgagttactacccgatgtggcagaacctatatttgaaaccctactctaaggaagttcagttgggctgaacgttctttagcccaactccaaagcttagttttagcctctggaagaatcgatttaggagcttgaaggacacccagccgttacggaaggaagagagaatgttggtggctcttcctgactaggaactccttggaatgctgcaaatgtacaggtgattatctctgcattgttgcaaacactaaaggctattttcatatctaaaaagaatattactttttctatacggaaaggttggacctgtttttcttgtgggccctaaaaaatgaaacccacatggaagtagagagtgacaggcctatctcagaaggaagaaataacgtaggagacaaaaacgccgggggaggctctgtatatgtctttggaaactatttcctcacgttcctgctcctaatgccctgcctctttctccccctacttcacacccagctctgctagatccctgatgtaactgcagaactaaaacatttctcaaaatgagaagacagaaatataggagcaaagacagtctttgtgtgtaggtttcactatcgcagtggggatacatgtacttttgtgccctcagaaatatttttttagttgtttctttcattcaacaaatatttatgagtgtgttctacgtgctaggcaccaaggcaggtgttaagcataaaaatatatgtcagtctgggagcagtggctcccacctgtaaacccagcactttgggaggccaaagcaggagaagcccctgagcctaggagtattggaccatgtgggcaacatggccgcactcttctctataaaaaataaaattttaaaaaaactagctgggcatggcggggcatacttgtagtcccagctactcagaaggctgaggtggacagatggcttgatctcaggagttcggggttgcagtgaactatagtcatgccactgcactccagcctgggctattaacagagcaagaccatgtcggaaaaaaaagaagagaagaggaaaagagaaaagaaaaaggaaaagaaatgtagaaaagaaaaaagaaaagtatgaatatctattttccatgccaagaagaataatgttgttagtttcataaagctcagaggaaatgaagggataatcacaaattatgtagcccataagaggcacatttggagccgatgtggggctatcgctgtataataatctcctttgtttggctggtgatctacttctcagggcagcaaatcctgcagggtataaaatatttgaaaatatttttactttctttttgcttgcttaacgttctagattaaaccagagaagacaactaatagaatatcattctcttagttgtgcctgtatactgttcatgtgctatcttaacttttattactataatgctacttgaagaaaaagtcaacatgttaatgaagctgccaaagtcttaatgagcattctgtccttctggcaagcaaatgaaattattattttggagaaaacaaatatcttaacccagaaatccataaccaaacatgaagatagactacgtcttccatcgttttgtaatattacaatgtggttttttgtggggatgtggaaaaaaagtttcatttttttaaactctctcttttttttttttttttccaacttgctctttgaacattaacttttaagctgtttcactctctaggaaaccaaaaaggaggcagaaaaaatggtgagttcatggaagcatgtgcacgtttttgaaatatttgttttatttttaaaaatgaattataattgaaattgttcctgcttatcactaacattttagaaatgcattcttctgggtttagttctattattcatttactgaggtatcaatttactcatttatctgcttgttctttatccattcacatacccgcatttgaataatttaaatgaggtccaccacatattgtaaaatacaaattagcctataaaaacaaaatgtcaaagagggaaatggatcaggacataactgagggtcaaacatgaggcttttgtggtttaaatactatgggtgaggtcacacaaagcacccttctgtccagttcaaagaggaacgacattatggctttatctatgatacacatcaggaggatctgcagaggaaattgtgtagtaggtgaagtgtaagtagatgataatggaaaaagagaacagatattcagtgaacgtgacaattctaatatacaatcatttgtgcaactcacattttttgagccctgaccttggcttaggatctgtgagctcccggtctgggccttctcccatgcgtctccctcctccctactctgcggcggcttctccatgctcctccatacttcctactccccagcaccatgtttctcaagctcagctcttaacaacgcctctgtcacatgctttcacttttatatcgcacaccagtctttacatatttaaaagcataatttgagtataagaagttacagggcatctttttaaaaactgacttaaaaaattcttatagtttctagacagagcagggtgggacacgtgtgtaatcccagcactttaggatgccaaggcaggaggacttgaggccagaaatgtgggatcagcctgggcaacatggcaaaaaaccctgtctctactaaaaatacaaaaattagctgggtgtgatggcgccagcctgtagtaccagctactcaagaggctgaagtgggaagatcacttgaacctgggaggtggaggttgcagtgagccaagatcacgccattgcactccagactggatgactgagcgagactccgtcaagaaagaaataatcaaagaacaaaccaacgaacgaaagaaagaaaagagagacaaagagttcccatagtttttgtctcttttaatctaaaaataatttgaccaaatgctccaaatcacagcatctcacttgtaatttatgtttttgccatgctttctcttatttgacttatgtcctagtacagcaggtaagtttctttatatgatatacctgaacacagaatgttttgaaactgcagcgggaacacactcaaacttaggtatgtcttcagttttgtgattggaatagctgcaggtactctgacctgttagcaccttctggcattatacaccaagtgatgtagagaaaaactttctatattgtgaggtatataacgtgtgatctgccttcattccttttattatttagatgtatgggtattccctgaagccctgtactagccatttgatcatgtggtacttgaacatttacgaaataacaaagagtgtgttaatcacagtatgtgcgtgaagctatttcaagcctttgcaaggagccttctgggcatctcagggaatgtgtttcaggatgatcatcttattagacaacagtgctggagctaagtggaaacacaggttgttcaaaatgataatgatagaaacttacagacattttttacagcgtatcttcttgtatgttgcctttacttgtgaatttttctttcaatcatggaatctatttctaagaaaattttatttcctctcctcacattctggaaacagcaaatcctaagtgccatctaataaggaatttagcaaatgttactctgcaaacctttaaagtacattaaactttccaaatgtaattgacaccctttcctcatcacgctactacttaaaagcatggcgtgaatgtcttctatgcaccagacagaagactagatagtccctcaatgctagtgagaaatacaattttcaacacaggggcgaatattatttatgcctttaaagactgattcttataaatattgagaaaatttaaaaattagcatttaagtgtgccaattaggaaagcatttttagtcttgaggatttaattactgataaagcaaaaaagttattttaaatattgtatataacattaatggaaatattaatatgcactgattaattgattataaatcaagaagttatgataaaactttttataaagataaatttaataagatatatttctttttaaggataaatttaattcatttttataattaattgatttaaaatcaagaagtgataaaaacatatgtagaaactggaaaattacaatttattatttttactgaattaaaattaccttgcaatcgtaacattgtcataaaatgacacacttttatacctaatgtttatacaaagctcatatcacaaaagtcctctagacttagattattcctctggaataaatggataatactatcctcttaatattgtatgatttaaattcttttaaaaatatattaaattatctgaaaattataaattgtacaattcccattttaaaaaagaggaaaagataattcagaaatcaaacaaaattgaacatgaacaaactcaaaggctacaaagtctccaagaagctaataattaaaaattgcatctcttcttgcccataatagtctctgtatttcactaagttatcattttctctgcctataagcatgaaagtcattgtctcaattaaggagattttctttaccaagtaagctattgaagaaaaaaggattctgagttataagcataaaagttatataagcataaaagttatatgagcataaaagtcatcctttcaattaaggaaacatttttaaccgggtaagccactgaagaacaaggattctgattatctagactccactgtacacagtttcagtttattttccccaagtgccaaatattcccacaggtgatctttgacacagatttaaattaaaaatgacattttaaaagtctagccccatatgcgttcattattaagattttgttcttgctttgtgaagacaataggaaatctatcctaggcagaaatttccactaaaggtatctataaaaacgctttgagatcataatttactcaggcaccatttgtaacacaaaatctgttttatgtaacattcttgataataaacaaataataaataaagtgaaagcaaacttcaaaaaagaaaaagattgctgcgatactcatgggagcatttcctgcgtatgtagtaaagcccggtctttcatgatgaaggcatcagctttgataatggtgcactgggtttttaatatttcccgctagaaatgctattaaataaataaggcagcatcatgaggaagagatgtccctttagtcctaaaacagcgcatcctgccttacgacttcttgagtcattgctcaaaaacgaatgggcttgggcgctttcttcctcaaataccacatattgaaaggaaaagcaatgcagcaaaacatcacaaagttgcacaaagacatgcgtgcttgtgtcatcttatttcctcagagttcctggacatgtgagaaggtgcacggaccatcattctcagagataacttgagcttggactcagacccagccaggaccttcctcctctttctgtgtccagcccacacctgagcacctacttcatagacctgctctgctgaggtggtttgaatataccacattccagaatgggattgttttgcacctgtcaagattttcttctgttcactccagatttggtcatgatgaggttcttctgtcctggaactgccctacacattcaacttgggatttggttccagcagtgacagattatgcaggattaagatcccaagtacagtgcactagagcagagtcaggcagcacgggcgttgtcaccacgcagtcctgaattcaaggtctaccaccctcacctctcagctgggtgatgtgagagggagcatggatctccttggatgtcaccccctgtttatgacagccagcatgcaggaacccctatattaacgtaataggctaatcgcaggtaagcaaagtgtaggggtcatgatttcacacgaggagtaagcaatgaaatccatgctatgaagaggaaaggagaggatcattggctgaaaaggagagcatggacattcaattgcagttagatatggaaatcagagcagctgggtggggagtgtggtgcagaggtgcggccctttcttgcagactcttcgggttggactcaaggctggacactctcagaggctggcatctatgtttccacaatattcatatttttaaaaacattgagggcaataagtttcttttcacattttacatgttgtgataaaacagacatgatttctattattcaagctgtaaaacaactgaagcctgtttttatcattatgtctattttttccacaaaacttttcactcagtttttgtttcgttttgttttttagatggactcttgctccgtcacccaggctggagtgcggtggagcaatctcggctcactgcaacctctgcctccgaggttcaagcaattctcctgcctcaggagtagctgagattacaggtatgcacaaccacgtctggctaatttttgtgttttttagtagagacggggttttaccatgttggctaggcttgactcaaactcctgacctccagtaaccctccattctcggcctcccaaagtgctgggatcacaggcttgagccaccgcacccggcctcagtgttttgaatattgtaattgtaataattacgagtttgaggaatgcatgaaaaacaaaggttccaaatccatggctctcacccagataagccaattaaatatgttggaaagaacgtgtggtgtttacttagcaagattttcagtaatatatgacatcctatactccatggttcctaagtagcttgaaaatatctcgctggtctctttgtccaacttaaggtgaatgaatgcctcataactgaacattatgcaatagaagtacctggggtgtacattttaaaattcagaaaattttctattataaacataaaattcgtatttcaatttaaaaatattaaaatctactaagtaaacaaaaaataaagtttaaatttagtagcacatatggtatattgtttcatttttaaatactaaagctatgtgcgtatgattttgtatgtgtgtaagtgaatatacatagatttcatcgtagacaaactgcaataattttgatagcaaaacaaaagctatatgaatatcacaatagtatagtatatgtatagcaacctaagtcagacagaaacttaatattttgaaataaaatcaacatcaaatgtaaatataatcttaaaaccgcagtttaagaaatgaaggtatagatgttaactgacactcggaagaatttctaactcattgtatcccaaatttcctccctttcagaagaaaaagaagaaaaagttcgttggatttaaaggtattaagtcaaacagaatgagttgaagcatccccagaatgcacaaagaaacttcatgctttgcataaattactttcattgatagcacagcatgaggtgcttgcttgaataacttttttgtcaacagtaaaaagaacctgctttcagaaaaaaaagttttgcgtaaaattcacccaagagggtgaagaccaattttcatcttaacaagtaaacattaaaggcatttatttttttaaagactgtataaatgagagtgatttactaaattatactttttgtggctatccctcctttggggcttagagctcacaggctgctttagggagcgttccacagtcacgcggccataagtctcattgtgtcaccgtgacttatttgagcactggtacaacttaattcacatttgtttgtatcaattccaacgtataatttagcatagctcctgttttttgactgaggccttaatcagccagtggaaggagacacaggtgctggtatgcctcattttgccgcatttgtattctctttctagcctgccatactccaagctctcataggaagaaatgagcaccaccaggaaataaatacactggagaagtcttgcaggttaattctctgatccacttaaatcccaattgtaatgttttagctagttgcaaagaaatatttaaatttgctattcaagttgaggtgtctctatatttttacttttaaatggaccatagttattaaataaacgcttcaaaatccattgcaatgtacttgcgtgacacatacattgtcctgtatccttcataaaggactaatgtatccaacaattatttgctgacaatctgttaagctcacaaatgaaataatacacggttattcacttagtggggtttccacttttgaaaaagtgtgattgcatattatgcctacttttaaaaagttcaatacaattaagttcttaaatatttgtcttcattttgggggtttatcctcgtcatgtaattcttggagagtcacagcaaactctctaggccacggttttttctgtgtataaagtaggtgatagtttctacacaatgtgcttgtaaatattgagataaaatccataaagcactcgccgcagtagctgacttagtaaatggataacttcaggctattattattgtaattgtgttattaatattttaatagtttcttgctttttaacagtaagagttcataacaaaagaccaggagacaagggcggaaggaggggctgaacttgaacagagacggcaaatgctttccactcagcctttggtctcctcccttaaacagggaactcaggtctctaagcatgggtttctgaaatgctaccatgaagataatgttctttgatgcttaaataagacaatgttttgaagagtttgtgtgaacaagcgttctacaaatacattgccttagagacatggttttcgtgatggccttcggaaaaagggtagaatgtttatgcgtagaattctctgtttgagtagacgatatcacaaaaccaaagtaaagttgaaaaactatggttcggctgaaacaatagagcctgaacaactaggtcaggaaagagaggtctttcaattccaggccttagtgttaatggttatgattttttaaaatttctttttatttatttatttatttatttttgaaatggagtctcaccctgtcgcccaggctggagtgcaatggtgccatctcagctcactacaacctctgcctcccactttccggagattctcctgcctcagcctcccgagtagctgggactacaggcatgtgacaccacacctggctaatattttgtacctttagtagagatggggtttcaccatgttggccaggccggtcttgaactcttgacctcatactgtgccagccttggccttttgaagtgctaggactacaggtatgagccaccatgcccggccaatggttatgattttataagaaataagaactgtcaaggtcttttgagaaagcataatttagcgagaataaaatgttaatatgaagcatagattcaattttagaaagaagcagaagacactggtgagagaatgaatgactctagaataaaataacgaatgtccaggagtagggactacgaatgtacttcataatttagggaataggctcccatccatgctacttataatatctcagttaataggacggcaaaggagaaaatgtctaaggtaccacggtataaaatatgccagattgccagcttattggctaaatgatttccgcccatatttaatcaatattgcaaagatacttaaactgaatgcagaggggcttggacagtaactgatggagaagagggaaagaaatagcatcttgctcagtcatcattcactctcccaaatttataaacatccaagtcttgcgtcttgaaaacaattctgataaatatataatacatatatatcaggtattatatataattacctacatatattttttatagatatatgtttccatttctgttatttatttattgggagaaacaggagaatcagttcctgggagaaaattgtattcttttgtttcaggtttattttcttgccaatttcttttctgtaaacattggtttgcagtttttggcatgcactactcatattcattattttttcaattagcctgcaaggtctttgagggcaaagaccatgtgctgtgtttcatgctatctgccaccacagcgtatgccatgcctggcaggctgcaggcattcacacacacagacacacacacacacacacacacgcgcgcgcgcgcacacacactgatttataggtcttagattaaatcccaagaaataatgtattttctattttaatcaattctgtacagacactaagctctattatgctgcatacaacacactggatgtatcagattttcagtatgacttgaatgccgatgaattaaaaggctggtctttatgatcaagagataattcaaattctccattctgttttcaggagtggagggtacatcttccactgtagagtgtcaattggtgaaataatctccaaggccgttttagttgaggtaatccagatattgaaatcagacatgagcaagctattctaacaaggaaagaaagccatgattttcatagagaaacggactaattttgtctatttgcatctttctgctacttaaaatgtttatgtattccttttcactttctaacttgattctctctactgctttgctcttccccacttcagctattttcctattctgatctaattcttctgcttttttaattctctctctatactgttcttgttccctttgttccttcccttacacctgaatggaaatgatggtacggcttctccattccgaccctgaacttgtaaacatggaactgcaggctcattattctctagggaggttgtcattcaacctgtatcacctgatgctttcaaagtcctcattcaggatctttgctaaaaggaaaaaaaaaaaaacagatggaaagttgttgaaatacatgtgttgcggacttggatggagaattaaagagaactgaaataaatgaagcatgagtgagttcagcaaatatcaccagcttgacctctgtgtagagtcagacggttcacaactgatttatttttacgtgcattactcacatttcccctccattccctgcctacaattgtccttgtcaatacgtgctggggtgagcttcaaagggaaaataagggaagtgggcaagagatgagtccaacaaaggccaagaagaaagaacctaatttaatattacgtgtgaactaactaccttaatctacatatccaatttgcttgagaatatacgcttatagataaggaaagtaacttatgatgacagcatttcccttgctcgcttaagaatgtgccacaattggccgggcgcagtggctcacacgtgtaatcccagcactttgggaggccgaggtgtgcggatcacgaggtcaggagatcgagaccatcctggccaacacggtgaaaccccgtcactgcttaaaaaaaaaaaaaaaaaaaaaaattacaaaaaattagccgggagtggtggcgggcgcctgtagtcccagctcctcggcaggctgaggcaggagaatggcgtgaacccgggaggcagagcttgcagtgagccgagatcgacccactgcactccagcctgggtgacagagcgagactccgtctcaaataataataataataataataaataataaaaaacaatgtgccataatcatatttctcaatgtactttgttttccaggtataggtagtatgagtattgcctggacaatactcataggcagcatgagtattgcctggacagagggctataatctccctgatcctacaagaatccaacctgggcaccagctcagtgtggtcactgagcacggctcttcttccttcatgggttcacatggacacacactcagcaacccacacaatgcttttctctttaagaatctttttagttaagtacatcttccggattcaaaatacttaataaagcaacatactgcaaatgccattttttttcagattttcagaaggtttgaacaataaccaagagaacaggtgtatttcagatggaatattcgctaaggaagatgtctttctctacatagaacacagtctgaggctctactgtcctaaatcccgaaagctgatagtgttagtcattaagcttgctcttactacagggtctgtgtattatctaatgtgtaaatagcatttaagcagcctcaacaaccaaaatgctgaagatgggtggggatttgtaattacaatacaaaattaacagagaaaacactgatccagtataggacaagatttggctgctggttatattcgatcacacatcatcttttcttgcaagaaagattcatgtaattcagatgtaatgatttatctcaaagttttcaaggcattgaaaccgactactcttctttactaagacctaatgcagggcagggacagtggctcatacctgtactatcagcactttggaaggccgaggcaggtggatcacttgagttcaggagttcgagaccagcctggacaacatggtgcaagcacatctctactaaaaatacaaaaattagccaggcttggtggcatatgcctgtaatgttactactcgagaggctgagggaggagaattgcttgaacctgggaggcagtggttgcagtgagcctagatcgtgacactgcactccagcctgggtgacagagtgagactctgtctcgataaataaagataaaaagagtggctgtagctgcaaaagatgaggctgggtggagaaagggcttcccaggcccatgctctcgctacttgcttcctaatggaacatcacagaatgctcagaagctgaaaaacattgctccaatctctcacttatacctcctcttccatgcagcagcctggagatgggtggtcatggtcactagtgttgtttaagatcctggtctataagtttgtgttttttttcccctttcccttgtacaagttatttaacttggtgaaatctctgtaaaatgaaaataaaatccacatcagaaaataggtgacggcataattgaaatttcattccatcgtaacttgacataaaattaaataaagatttaagaaaatgctaccacatttaaaaagtgtaaaggttccttgctttgatgtcagtagtggacatggttcacacaccaaaggatgattttgacaataaaataaccatgtgtagatgccacagaggaatcatacatattaccattttaaatcactgaagaagaaatctaacctcctaccaagagaaagacggggagatttttaaatgaagtatccatctataagtgcatttctagaaagctgtcaaattagaaagcaaagctctggataatttgcaaaaacaaacaaaccaaaaaaatccctcattttatttaaacaacctctcccagcattttctgtcactcagggaagagttgtcagtcaacatttgattcagtaatttggcaataattctttctcacctttcccttcagcatactgagctaccaaactactaagtagtctatgttaggtgctgctctaaaattaaaaaccttcctttgtgagaaatcttaaaatgctcaatcatgctctaaaataatcattttatgtgacatttggcagttgaataggaacctcttgaacaagggactttcttttacaaactaaatgcatgcccagaagcacctcccaatttaatcaactaaacagaccagaacgctgtatgtccgaagcctttgaaacagtctttctaagagtagaggcacggtgatcaacacagagaatcctataccagcataagatcgcagcagctcattttgcaactccgaccaaacagtaaatctgaaacgagattgattaggagggaacaatatggattttattaccccaggacatggccatgagaaactcttgtctcttctgtaaaccagaagaaattatgagaatgttcacattcttggttttaaggactccaggaggacgattaaggaccctgaagccagatcttagtgatttgcaacggaaatgttgttaaagacccaacagaatgaatagcaaaggatctagggaaactcaagaggaatcttcatagatttgctagaaacatgaacatcaagtagcacgtggaacctctaataaaatgtatatttatatgtccatgaatgaggtgcacctctgcttaacaggtggcatggcatcttgttttttgtttttttgtttttgtttttgatggagtttcactcttgttacccaggctggagtccaggggcaccatctgtctcactgcaacctccgcctcccgggttcacgccattctcctgcctcagcctcctgagtagctgggattacaggtgactgccaccatgctccgctaattttgtatttttagtggagatgaggtttcaccatgttggccgggctggtctcgaagtcctgacctcaggtgatccccccgcctcagactcccaaagtactgggattttaggcatgagtcaccgcgcccggcctacatggaatcttaatacaaatgggggagccgatgtctgatgacatagaaccatgtgatccaacatggtgctgaaatcacacggtgttaaatattctatttacgctgcctcctggcatgatggagggaagcaacaccaaatgtcctcttcgtgttcagaggcgctgcttctgcctacagaccatgcgcacttctgcctgagtttttaatctctgcactgtgatttctattctcctcacctcctcatgggttctcctgagtttccagtggctgcagctgccggttcacatgtgttctctttctgtaatgttctgaaaatataaatgacgactgtccctattaagtttttataaaatgtttttcaatatattttttggccctctctataagctttgggattcgactaatgcaattgcaagttgacaactttaaaaaatctatgtgataaatcagaactcccgaatctatgattaaattttaaatatgaagcagtcaaagtcaatgaaaaattaaaaaattaataccataattttgtagaatatgttcagttttgacggtcacttctacttctatttcctcaagggagtctcaagacaatcctgatccgtgtggaacatgggggtactcagagggagaaaggatgcaaggatacgagcctcttccagtgagtttctcgtagaccaccaaggccgatgcattttcttaaattcagtaaaaggaattaccagtgtagagaacagaattaaatattaacttactttctctgtctgttgcatgaattatttgaaatatttagcttgcctgtgtatctactaggtttctgtttctttgttgatttttttgttgacttttttgttcttgtttgtctatttttttgagacagggtgtcattctgttgcccaggctggagtgcagtgggtgatcctggctcactgcagccttgacctcccaggctcaagtaatcctcctgcatcaacctcctaagtaatttgtaaatttttcatagagacaggggctctgtatgttgcccaggctgatcctgacttcctgggctcaagagatcctcctgcctgggacggcgaaagtgctgggatgacaggttgaacccctgtgcctggcccttctaagaccatagatgtgatttcctatcactttgttgaagaaagcagggagaaaaaaaaaagaacttcaattaaatagtattgaccttgtgttcatttttataagtactagatacataaggtaccaacacaatgttagaaatccagttttccaagattgtcactttttctcaaaatatcatttaatttttgctaaagctcttttttctttatacaaacacaagtatattagaaagtcaagtgattaacatttaatgtaactttaggtctttgtaaacagtgattccttggcttctttcattcctttctcattggaatgaatttttgcctctgtcattctttaggaatatggttctctgaataagcacgtgtgaccacatattgctcacagggcctcttatgctattcatctttataaaacggcctttatttttaatgtactactaagccatttgcttaagttagtttacatgtgatagtaagaatagtaacagattatgaccagtgttagcatggatattgcaaatagcttcttttcaacactacttgtgggagtaaacacacagcaccagctaaaagcattaaaaatgtatatattcaatgatctagcacattttaggaatctattttatgggaataattttggatattcacacatatctttgacatttacctcagaatcttataaaagagcaaacggaaaaaataaaaaccatcaaaatgtaaaaatggaaaacaacctaaatgggcaaagtaggaaatgaaggaaataaaatgaaataaaaattactcacaatacttatgtggaaaaacatttactgcttaaattttacatttatttttctcttctaacagtgtttaccaataagatcacagataagtgtgctttgataacaaatgtttgttttacagaatacctaatttttgcaagcctgctttcttgacagttggaaagttatgaaaataaaattctaacgaatccatgttttgtctgaaaacgtggaaaaactgttaccttaaatggtggtgctgcatgcagctgtgccctacatagagctgttccctggcaggtgggagtgagagctatggcttggtcatgagcctctttagggttctcccacctgccgagggatttgaatatcagttgaatgtctgcactctgcttggtgctagatagaagattttcaaaagaatatttaactttcatgtattcacctactgttgtcacctgtcacaccctactagtgaagtttatgcaaattataaaaattttttgaaaatatgttgcaatatttctgaagttgtttattttaaaaaatagcatacatcccaacaaatcattctggtataagaacaaacgtacttctacaaacaacaaaattctttcttgtcattctagaattttaaaaaagaaggaaaaaagggaaagagaaacaatttcatcattgtgatgcttcctgattgtcatctgtttactccctcaagtacctcacagtatccttggtactggcaacagaggtgtgaatgcaagacctttatcactttgcaagaacagtggctatttcattgatacactaatgcaaaccaaccagtgtttcattatttgagacacagtatctatttctcagaaaccagccctggccttttatgtgtttaatatgtagttgctgttttttaattttaagtgtttatgggtaactatggtagatgaatatattgatgggttacatgaaatgttttgatacaggaatgccatgtgaaacatgcacatcatgaaaaatgggatatccattccctcaagcatttatccattgagttgcaaacaatgcaattacactctttaagttactttaaaatgtagagtgaagttatcattgactatagtctcctcgttgtgctctgaaatggtaggtcttatttattatttctaattactttttgtacccacataataggtagttttgtgtgtgtgtgtctacatgtacagaggcactcgcacacacccccacagtttattagctgaaagatcaaagccaggaaacctttcataagagttatttttaaataatataattatcttaaataattatttttctttgatttttaaattataaatctagtattcttttttgattttttattccttttgccccttaagcactgtttgagtagttgaaagaaatggaatcaaatatacagcttttaaaagaaggaggaaattaaacatgtatttttattttcacttcgaccaggatattcataagggtatgtgcaaataatagtatatggctacttattaaaatgtattaaaacagaaaaaaagtatttatttttaaaaataaaatctttcatagtagttgtttagttgtctcaaaatatttaaatgtttgctttcagaactagtggcaatcctttttctaataacaacccttgtttttactaaacattcagtaattattagatgaaagaactgtttaaactgctttaaaaacagcgtgcagctctttttttttttacataacagaatgaaaattttatataagatgaagaacagaacaggcaaaactaaattttggtatacttacggaattctttacagttattggtaattcaatcattaattcacaattttttataaagcatctccaatgatgcaattaatgttttaccagagtaagatataaaatcaggtgttatcataatttaagaatttaaaaataacatatatttttatctactacaataaaattatcttgattacttcgaacaaatcaaaactaacacctgttaagaatccaggattttccctatgtggaatgcttgagttctttgcagtgaaaatggaatataaattttaaagtattttaaatcttatttgctaatatacatctgtacactgaagtttatttcttaacgttaaaaactagttttaataacttgaaaaccactatgcatgtttccatggaatgcaaacgagaggcatgcctcatcttacagtatgattttcattcagcatcctgttacgatgttattgttacataattgattacttggtttatgccattacttgcttcgttatttatcagtatgagagcttggggttgttgctattttattttataccttttttacacaaaatgcccttagaacagtttggatgtttgtggacatgaactgcaatataataatgttatgtttctttttatgatatgagctacagtgagcattatttttaatactagatgataaccatttacaacccttagaaaaattcaattagaaaatgcactaatacatcacagtggagtgacactgtctccatcaagtagcacagaaacttcatccacaggttgctgctgccatggcttctcccactgtcgggatgacgggcagcgctttatcagagagaagctgggcacctcgtgtggattagaaaaagggttcccatgactaaagtgcctgtaggtgcccagcagtgcttaatggtcccgattcaggaaatgtacaggagatgatggatttaaaagccatggttgacaacgacttcattacatgcaaactttaaaataaaacagaaaatgtcatgtccaagtcttcaaaagatttctctgataacttaaaaaacccatataggtttatttttattcaaatacattcttcatataaaatttttagttattgttgtccttcatttttccacaaatattatgttttcattagttgcaaatgagtgaatgtattagtttcataaaagttatttgcagtatgttttatctatcagtttttaacattaaaatcagtttttaatctatcagtttttaacatttaaaatattatgatcctgaaaagatcaatatattcaatatatactgattgaaatctgtatttgatatgttaaatttttttgggggggtcacgaacttgtaagaatctaatagagaaaatacattacctatatagtagaaattctacaccaagaatgcataacctaaggtttcaaatacgagataacttatgcttattttaaaatgacatatgtactggtttcaaaaatactttaaataccattttaaaaattatttaaaaatgtaacttcttaattatttttagctgtcaggttatacttatcatttttttctcatagagtcaatgcgtttttaattactaaaactgaaaggtaactatcatgacgttgatgaagattcctgaactttcttcaagttgctgcttcttctactagcatgagcttcatcaaggaaagcagtttccttttgtttattaattcagctgtctcccgggtctagaagtgtgactaacacataacgcttaataaatatttgttgaatagtcaaatataatatcacaagagcctgtgaaacagagtgtcttctcagcaattaagacaaagtaaaaccaggcaagatttgcataagcattaattatttcatcaatgcaaccctatgaccaccctgatcaatgtgactgacagctttcttgcgcattccctattctaagatattttacttatgaacccttttaatctccacaagaaccctatgaagtgggccccattactctcaacattttgtagagaatgaaattcttcaggctgaatgctgctcaaggtcgcatgcctgtagaatagcatctgtgacctcaaccactgcactgacctcaaccactgcactgaccagcactagcactgagatgtgtaccttgaatttgtttgcaaatgacttgttagccatttacatagtgtctagtacagatttgtcacagggcatagtacacatgtcacagaacacataggtattagtgtgcagtgggtgggggcgtgaaggtgcctgcagggaatgggtgagacgggattacaaccatcttttcttgaatttctttttccatttagatttttgcttctttcctttcatcttaatttctgcattataaaatcctcagatgaaactttcatgatgaacattttctcaatctcttgggctgaagcaatctttccatttccctgggatcacaatcagtgaacacgtgctctatttctgacactccttgctacattccacctatgataatttcccacactatgatccaaggagattgtgggttccctgaagacagatcccatttcattcctttcccaatgtcctgccatactcagcaaagcaatgtcaagtagaaggcactcaatacattttgctgaaaagagaaatttctaaaggttttgtttttgttgttgttcctgttttttccatgttctctgagttgttttggatggcattggtgcgacttaaagaaaaaaaaaattaaggaaaactcacaggtaatttgctttgacagttttggattctgctgttcagagcagcaaacatttttaatactttgtgactctggcacaaagccccatgttaaattttattttcaaagtgagtgctaagaagagcattgccactcttgagagaaatctggaaccttctcctttctgctcataagaatgtggtaaatcaccaactttctctttctgtcatagatgcctggaaatgaaatattaattttggtcttcacaattttgtgaatctgcatgtatgcttagttaatttgctcctccaggctttcattacctatttccttatatgattctgtaggttttcagcaagtcacaagaaataactaaggaaaataggctgagaataaatttaataaactcaagaatggtaactgacctccaatttcatgtcagccacatcgtgccatggagaggtcatgtgcacggctgccttttacgtgtccatctactagctcttaccatgagagcatctcatagctcttactcagatggacacttgcttgtccatctcatagcttcctcaaaaagcacgttgtactggagcaactgtgaaactcggtgtctgtgagaaagtctcatggggataacaaaacgaaaagcaagccctgccctcaagagaaacttcctctcgagtgaggaaacagcctgtctgcaggactcctgttattaccaatgaggtcactgctgtgtgctaggattcccagcgcctggcagcctccagcagaggtgacctgacatgggagcctcagtcacccctgtaaccacacaaaccccacaaaaacaactgttcccacatggctctcttttttcctttttggtaagcacatataatttttacatcttatttatcaaatattcataattcatagatttcttccactcatattttttttctattcatactcttggaacctacctaccaatacaggcattattgtaagaaatccatgaatatggggactttacttcaatacattctaccacgcagcctgaaacacacttatgtgagtttggcaaagggtttcaaaaatatagatcctcatagggtctaatgaatagattgaggcatgttgggggtaaataattggaaggaaacgtctcgtcgctgctgtctctccacctcctcgtggtgatgatgaaattactcctgcccaacccggctctacttatcactaattgagcactctgatattgatgtaaaaagacatatccccagcatacgacatcagtgcatgacggtgctcatgcttttaagggaaagcagctttcctttccggagacatcggtgatttactgaggtctcgtctcctcttgatcccttcccagcgctcccattaggtttaatgaaaggaacacaatatgggaacagtgagaagacaaggaattagcgtcctaatgtgcatttcattgccagccacaggttccactgtttttacactgcctcctagaagcttgcattttacaacaattggaaaatcagaaaaagaacaaagatgctgcacaacacctggaccacaagaagtttcctcctttccttcagatgtgcacagcgacctttgaacagtagccagtgcatttagagagctctacttcacagtgaaacatggggcctcaggccctgatcacattttacaacacctgtgagatcttagcacactaacagacagggacagccaaatctcaataatgtataggaagttttaggccaggaaatttagggcatctttttgttttgggagcggattgcaatgtgctctaatttgttctggatgtagtaacagaggtgtgaatcaggtatcacgctgttgtgatggctgttctaaggcatgagagaatgactaaggacagctggaggagacatcagcgcagctacagaggctacatggaaaagctgcaggagaaggcgttgataaatgtgcatgcaactcacaggatacagtgtgtctttggcttagaatgttgtgtcactccaaaattcatatacagaagctgtaactctccaagtcatgatattaagagctcaggcctttggaaaacacctacaggaagatgggatcatgaggatgcggccaacatgatgagattataaaaagaggaagagattccagagctctctccccgccttgtgaagacgctgaaagcaggtgccatctatgagccaggacgcaatgcgtacccagaactgaataagctggaaccttgatcctaaacttctagcctcagaactgtgagaaataagtgtgtgttatttaagccaccgtctgtggtatcttgttatgacaatacaaacccatgaagaaaatgtagagaagtgtctaaattttcagagctatttatactgtagacagtcacaaataaactttgtaaactgaaaggcatactccataaagaccctttgtcctcaataatatgaactatagcttcagccaacactgccaaagttaaatattaagaactgggttgaacaactcacagatacttcaaactgtgtattcacatggcaatggttcaattattttaaatgacagactcacacaagtaacatcttctattcctaattgattacttttgtctgttttttctagaaaataggttttatcattgtatagtgctgtacggtttatagagcattttataatatatgacacaatgttatcacttttcacaatcaaaattagctatgcctcatcttatcaaccattggcatagatgggaacttaactattaggggaaaagctgaactagcattgtatccgaccacagcccaatgctattcttgtcacactgtaatatgcgtccggaagcagttctgagataatcctgaatttcagctttaacgcggtattttaagtgttgacctattcctggcggcataaaatattcttcccacttctatggtcagggaaatcttcacatcttacacgtttgtgaagatttttttttgccaaacttcctcacaattcactctgctcgtctctgcttctatgttgtttatgccatttagatttgtcgtctctctttggttttccactcaaattcgtagtgaaaatagtttccccccttgttaatttgttttttatgccccaatgatgccttactttttgcttatggcttttctgtatcaaatgaaaatatacaagggtttctgcctattgagaatctggagaatttaaaagaacgatgtgacaagaagtaagaagcccccacccttctgaattcctgaattttcatttctgctgcaggcgacattctcacttagactggggatacataccccttggccaaccactaatgtccccactcccagcagttggctactttgaaaatcctttcaagttgggaatgaaggtggagactgtttttattttcaggctaaaattcacaattgttctaaaacatcccgccgttcccagtggttttcccataaagagtaggggccctgctcacctttccccacctttgtacccacacccagaggttcttcaaggttcaactatcctgtagtaaccatgaattttcccacagtcaaaaacgcccgtacttgtagttccttccaaggacttgctatttgcataatgcatgctgaaatgtcaggagtcctccagatggaaaacagtgatagttacgctgcatgtacaagagactccaagaatgggtatctccatagttttcttcagtaaagaacatgcaattattctaagtgaagtaactcaggcgttgaaaaccaaacatcgtatgtactcactgatatgtgggagctaagctatgaggacacaaaggcaaaagaatgataacagcggattttggggacttcaggggaagagtggaaggggggtgaaggataaaagacaacaaatatggtgcagtgtatactgcttaggtgatgggtgcaccaggatctcacaaatcaccgctaaagaacttactcatgtatccaaataccacctgtactccaataacttatagaaaaaagtaaaaaaaaaaaaaaaaaaaaaaaaagaacatacaattgtgtttacctaagtctttccacaccgtgttccatcacatcactcataatttttcctttaaattgtatcaattagagcagtattgttccctttgagttgtcttttaattatgtctcttgtcatagtttccttctttgacgttaattgtgccccaaagaaaggctcttttgtatttgatttcttcagtcctacatttaataaacgtgcttggagaccctgccgtccgacaggctgtgcgcttcacaaagtcaagagaagaggcagttagcagagcctcacttttcagtgagtcagcaggagggcgtgcacttgctgcagggagtaatgcagctttatctgtgaagtttcctgtcatacagaactagttacaattgcctgtaatcccggcactttgggaggccgaggcaggtggatcacaagttcaggagattgagaccatcctggctaacacggtgaaaccccgtctctactaaaaatacaaaaaattagcctggcgcggtgacggtcgcctgtaatcccagctacgcaggagaatggggtgaacctgggaggtggaggttgcagtgagtcgagattgcacaactgcactccagcctgggtgacacagcgaggctctatctcaaaaataataataataataataataataataatattaataaaaaaaataataataataaactagttagaattaactacaatctgagctaaaacttaagaatgctgggatttaaatcctggtctacattcctgagttgtgtgatacagcataaattacacaatccttctctgcctcaatattctcacctgcaaaatgaggataatccttgtacaaacctccatggttgttaggaaaattaaatgagctaatatatggaaagcacaataagacatggaattaatagaaagatcttaactcacatgattactattagtatatactccataaggaccagaaaaataacgcatcataaattatgtgcataccatttagaattatgtgcactaggattatgtgcactagaattatgcgcctagtcatttagaatttcactactattatgaagtactgctgagagagaaaaaaaaaaagccattaaattatgtggggcaaagatagggcagatctgagaccagggtggcggaccggaagcctcataagatcaggaggcagagggaagcacccggcatctgtaggaggcttaacgtggaaggagctgcccacagataatggacagggccagaacgagggcaagaatccgctggaggattctgaggggagcacgatggtcactttcatcattgcagctctacgcataccaaggacaaagctaaaccattagcgtttcctacccttgcctttacaataactttgaaaaatagatattgttatatgcactttgcagatgaaaaacaaaacaaacaaacaaacaaacgacaaatagggcccctagagctagttagtagcccaagacagcacagcgggataaatcatggggccgggatcccaatccaagttggctgactcttttccccaggagcctctaatgatgtaaaacgcctcagacatcgttatgcatcctcccacatctttctttctttttttttttttgagacggactctcgctctgtcacccaggctggagtgcagtggcgcgatctcagctcactgcaagctccacctcccgggttcacgccattctcctgcctcagcctcccgagtagctgggactacaggcgcccaccaccacgcccggctaattttttgtatttttagtagagatggggtttcaccgtgttggccaggatggtctccatctcctgacctcgtgatccctctttcttgccctcccaaattgctgggattacaggcgtgagccaccgcgcccggccgcagcctcccacatctaaaattacctataagtcaccagggtagatatcaagtcatgaggaaaatatacttacaggacttgggacaggaaactgcccttggatgccatttcagtgccgtggagaaggacagccccaattttgtttttgatgtttctattttattttttcataaaccccatttatcaaactgtatttttcaaaccatagcccacgtgtatcatgatagagatcatgtggagtgtattttcaggacaagttctaatcccatggattgggggccattgctaagtatggttagatgttcccctagtctggtagcatctgatggggctgtcaactgcacctctagagcacgtcgcagttctgatggggctgtcaaatgcagctccagagcacctggcagatctggccggctgtcaattgcaactctagagcacacagcagatctaatgggactgtcaattgcagttctagagcacaccgcacatctgacagggctgtcaattgcaactctagagcacattgcagatctgatggggctgtcaattgcagctctagagcacagggcagatctgatggggctgtcaattgcagctctagagcacacggcagatctgatggggctgtcaattgcagctctagagcacaccacagatctaacagggctgtcaatagcaactctagagcacacagcagatctgatggggctgtcaattgcagctctagagcacatcgcagaaaattcaggtcaggaacctctcagactgcgcttgcacccagccacctgcacagtgaagccatcctgcaaagcgagtggcaagcttaacttcaaatgtcacattgatgtccccaataaaatgtcacacatgcacagagtttactgagccaaatttcgatccactgccaaaagaaaatgctgacgacagatcatgagtctctgttttcctatttagacttttcaattctaaactggtgagtacttttggttctaagataacaaacctaaacagagaggcacattgatatatgtttctataaggtaaagcagcattaaataatgactagctcattttgaatccagcagtaataagtacactattttgatttttcgtctaggtatattaaaaaatatatatatagccaagtacaatatttggattcttcaagtaagaaaaaatacagctaggggtttcatttgaacaaaatgccaaggcttgttacttgtgttttatgaaaacagaatgatttatgggttcaggattcagtgtatatatcatatatatatatatatatatatatatatatatatatatatatatatatttgtatgtatttgtgcgtgtgtgtgtgtgtgtgggtgtaaagggagatcacacacacaaaaaactagagggaatggaagagaaaaaggagcaagaagaaagccagaaatgaagagaaagtttgaatctatgtccataaaacgaatactttatttcaagcttcattgtagttcattataagcctttaaaattaacactttagaatttggtgaagacttgggaaagatggattattccgatactgggaaaatcacggatctcataaggtggctctgaccacattttgattactgtgctcatgttcttagctttcaaaaacactgtggcttttatgttacttaggggggacttgtcatgaagaattacaccatagatcatgtacttcaggagagggtgtgatggatgccagctgagccttccttgtcccttctcacagtttgtggtaaactagaaggtatctgagaagcattgacgggttataaattgaagtcccatttcatgctttacaaatttcccacaccatgcacaaagcacatttgcagataataaattatttttaaagcaggcatatatgttttcgtttattagggttacagattgcattgttttgttttcctttcttccatagaaagtaaatgaatatacatctaccctcttgtctagtcttatgtgcacacacacacaaacacacctgggcgtgcacactcacacattttagaacataattgctgctcagaagtctccatcccaaatgtttcaagagccagatacaacgaacacatcattttactccatggattgctctactatggaataataacagtttcactttatttgaaggggcgccaccttctagtacaggaagatccttgcacggcagaaccgttgcactcacagaagcttgctaggttgatgctagaattctcattacaacctccaagaatcaagtaacaacttgattcaagaagttagattaaaaaggctgcctttaaaatgttaaagtgatttttttttttttttttgagatggagtctcaccctgtcgcccagattggacagggtgagacagcattcttcaatgctgagactgtaccctaggtctgtctgagcatcagataatttttcttcccaattcatcgtgcactcttactttgaacatttcaaaccattttgcataactcaatttttttttctaattctagcctaaaagtttccctggctgtcctctgactcccatttaagccaggccccacccactcccctgcttctctttgctatctcaaagccctgtcttttcctcttcattatatgaagaccccatccaaaaatcaaggatctcgttcgtatctgggagctacaagttcagatgaacaggatttctcaagtgacttgaaggcatcaccttaaagtctctccaaagagcccttttattttaagctgcccctcggtcctgagatggtgcaaagacaccagatggaggaagagctttataacttccctcgcctggctgagggcatcaacattctctctacaatccttccctatgtttctaaaagctcagtgaaaacccttctagggtgttcattgaaatgtagatccctgagcactgagacacccccagccaaccttcctaaccacaggccctggacatttcactgttgaatacgtttccacttcaaggtgaaatctgaaatatcagggtatagccatgtgcaaagccgagcaactgacttccctggctaccaaaagcaagatccttctcctttctttttctactcccatgatcagcagacccgtataaattataagtatcttaatctttcaactttctaattatttattttttcccaagccatgcaacatacctaaatcatgattttcctaaagtactgctttccttataccatgagatatgagggacagagtgaacattttacaagcattttaccatggaaaatttatcatgtttcagttttgctcaaaggcctgcttttacaatgtttaagtgatttttctttttttttagatggagtctcaccctgttgcccaggctggaatgcagtgatgcgatctcggctcactgcaatctctgctcccaggttcaagcaattctcctgcttcagcctcccaagtagctgggattgcaggtgcacgccaccatgcccagctaatttttgtatttttagtatacagggcgtttcaccatgcagttcaggctgttcttgaactactgacatcaaataatccacctgcctcagcctcccaaagtgctgggattacagacgtgaatcaccgcatccatccaaaatgttaaagtgatttctatcattttgtgaaaacgatgggttcctttctcccaacttactggaatgtatttacacacacagcgtctatccgagttctatgggagaaagcaatccagtatatacacttcttactttacacacaccgtgcccacaacagcagcacgcactcttcctgtgaacatgcttcccatgctcaaaggctacacacagcccagtgtttctgtaacatgttctgtgatgacctcactgagcagtgctttctttctcctccaagtaccgacagcatctttgcaactgcattgcttatttgttgtttatcacatatgccatgataacgactaatggatacaggggttgtctgtctccgttcctggtacagtggtaggtttctgacttttactttcatattcacccagctagatgagtatctttaatctcctttttaaagtcaggaaaccaaaaatctgggagtctgactctagcccaaatggtgcagctacgaaggggaggaacaccatttttaattcctcgttcttctcactctaaggccaattctgagaactgtgaaggatgagtagggctttgctgataaagcagaagagacagttcccagacagagaaaatggattgaaaacaggaaactgcaaggtggaacgaggtcactagcagcataaagtgcaaaatggaatgtaaatattgacaggactcaggccaaagcaggctctgcgccacgtcaagaagcatagccttatccaaacccatagttccagatgttaattgacagcctgccaaaaagaaatggttcagggtccaatctgtttggcacattgcaacatcttctacctgatctctgagagtcacaccgaatggtctcacatcaaaggactgagaaatccacaacaaaggaaactgctcaactttttaactcaattttcttgaaaagagctcaaaatgattttactttcaacacacagctattaatagatttggaaacactactgtgcctaaaaacatagggaagctgttgaaatattgtgatttttttatacccttttgatgtcacctcttattcatagtcatctgctgggcagttgggctggttcagaaaactaaatcagagtctctaagcagtaagaccctggtgagtctgtgaatcctaaatctgaaactcaatattgaacctcggctttctggatcatctccatcttgtcccagaaggccattataaacatcacacaggatttcaacagagacaaaagagcttgcatcaaattctgaaatagcataactactgcaatgtttttcagtttggaggaaaacctgaaattattatgaatgataattagttatggttttaggtctgtgtttgtcaaatatgtacgccactcacaaacaccctaacctctcacagctcaggctctggagcacggaacagcagcaccaaccagagctgaacgattgtcagaaacagagaatctctggactcactccagaactgctagatcacggtctgcattttgaaaagatctccagtgagtcctgtgcacatgacagctggagaggaacgtttaatagataaatatgtacttcggtcaaaattccactgttatcacatttcatttttactaagtgatatacaggatctaaaccaggatagcattttgattttcattcacaaagttgacggacatatacaaaaacagccctgaatgtgaaacaatgctgattatggtcaattatatttccaaacaacaaggaagggtcatcatttaggtcctattttttcctttaaagtgatattattactgttgttattgtcacacaattcataaccaaagtaagatcaatgttttaaaagttgagtggagaagttaacagcttttataactcaaaaaatttgaaggttatttgctgaacatagacttttagaactagatacaggtaaaaaccattgttcaaaacacattctatttcaaaaagtttttctttttcattgtagggcagaaatctgaactctctatggcactgtttcttacagcagtaaacgtgcagctagttatagaaattgctatgtggggcgggcattttgctaagggttttccaagcgtctgctcatttgctctagttagcagctctctcagggatgtggcaatcacttctattttacagacagtgatctgggacttccagagcaaacctgctctacgtcatcaagctcagaagtcataaaaccaagactacagcctaagtctcactcaaaccgaggtctgaatcagtcatcttggcttagcaactatgcttttatggcctgctgatagaaaggtaatgaaaaaacgacagaggacattgcccaacactctccaagctaggtaagagcggcttcttagcatgctggaacgagttgtggtaacacagacaaaaaacctggattctcttctagccaactaataatactccacagggtaggataaagcacatgatctatttatgatgcagttcctttttccccaaacaagaaagggattgcattaagagatttctcaggtgccatctattttaaatttataattcaaaaaaaattaaagtctttatgatgtatatgtttattaagaaacgatactgtgatactctaaagagattcgaatcagaagaacttagatacttgtatttactaaagtcataggtgggaaacgctaatgttctaggccactactcatttaaaggatgtattaagcttggatagcacgtgccaacaggaagtaacccaagcaacaaaatgtcacattttttggaggagtataggattgcacaaaattaccttattctcctaaccagtcctccatgaaattgtgcaaactttcataagaaagagaaaaattagatattcatggcttcaagagaaactctaaatgaagatatcaaaatgtacaattggaacacgaggatgtgccagttggctgatttgaggaataaatgagagttaagcagcattatttgagaatgactaaaatggagtgggcgcaatggcccctcagaaggcagagtgtttttaaatgagaaatttatttaacagcgttaatttagttttacttttttattgtttccaggattaagggccacatacaaaaagaaagaagtgtgattacaaacaacaggtatttcatagttgatgaaatacattttaatccataaaagacttcttttttcattgcctacagcttaaataatttataggaaaagtatttttcaataaaatgaggttaatttggagaaatctgacatgagagaaatattacaccagaactgtagagttcaactctgccctaagaatggtaaggatggagacggggacttctctcccgggataactatttttcctattggtcccatctttagagaccagggatgttttcttcttctctgttactcctcagtctggacaattttatggaatcttagggtaaaatactacattttatccatagctaccaccattcaataaattagaaaagtgtcccaaatttcaaatacgtattctttgaaatagttttttaactttattgaaactctggtatttacttaacccgaattaaaggattgctctagaatgctatttctagaatttgtgaagaaatctcaaattcaggcttaattctaggcaataagacagtcgatggcttctcagagttgcaggggcacctgctggtgagtccatccctttcatgaggaaggagaggggagggcaggaaataattcctagggtatacgctcctggtagtgaatcagagagtgcagctgccccttcacagagagccaccttctttgctcctggaggtccattctgacgtgaaagacccttccttcactgcctggtgaaagcatcatctctagatgatgcttttcagaaggacaggagagaaaatgtgtcttgcaaaaacacacctgacaaaaacctctaaaacacagcctgcctgcttcactccacttgtggggctgcagcatctttcccagaaattccttcgctgcccagcggcttcatccctggccacgagccgagagaaaaggtagagactggaaattggccccacagtagacattgtggagagggtgcctaatccacccaggtgaaaacaaaaatatccaggataaggcatgtgaaagaaagccaccaatcaagttagaaattatccgtacagtagaattagctggtattgaaagaagttcgcattatttgcctattgagtttcagggtggaggtacctaggttgtggcgtagtctgggatggccagttttctccacctacctaagacttcagtgcgtcacggttgcatatataaccctgtttagtcacatctttatgcgacagcttcatggtaacatcagcttgtcattcatgtgtcctcttagaagcctgataatatctatcattatgttatacccagaaatatgctcaacaagcaagtatgctaagatgattacattactgtctagtgaataatgctggaaagaaacacgtaagagtagctagtgatgactccaccacacagtaacagagatgactacaaattagaagtggagggcactttctttgtatgcactaaggcagaaggttgctgaagaaattctaggatgagagtggagtgccgacacactgcttccatcttcctgttttgaaattagcgatgaaatgtggtctcaacttttttaaaaggaggaggaaatataccttgggactgtctctcttcaagtctccacactgcctctttgctttttggatggttgaatatttaactactttgaagcctatttttctcatctataaaatgggaatagtagtatctccaagtagcagtagcaactattgtttatattttcttgttatataacaaacactcggtgattattaaatgtttttttacaaaaaaaatacactattgaaaaaacatagaaatggcattttaattaaagcaggggtttatgaatagagctacaatatcatgttaattatatccctacaccttcagctggtatgcagagtatcaagaaaaggagaaatgtgtatatatatgtgtgtgtgtgtgtatgtacatatattatatatatttttattgttagatatatataaatatatttacattcatatttatttcccatttatgctatactaaacacttctaaaaaacaacacttctaagctctatttttcatgaaccagcataacttgacccttttgcctacctggagtacgcaagtttacaaggggaactctggggtgacagttttgtaatcttattttgttcccgttaaaccagcacaagtttactattaaatcaatctaatcagtgattggctgaagttaaaacaaaaataagtgttgaggtgcatagcttacaacaggtttgtgaaataaaattactgaatccaaatttaagatagaaaatatgggactggctgttgtggctcatgcctgtaattccacactttgggaggctgagccagcagaattccttgagtccaggattttgagaccagcttgggcaacacagtacgtccgtgtgtctacaaaaaatgttttaaaaattagccagggttctgcacctgtagtcccagatacaaggaatgctaaggtggaaggatggcttcagtccaggagtttgaggctacagtgagctatgacagcaccactgtactccacactgggtgacagaaggagacccagtactaacattaaaaaattataaaggaaagcacaaaaaacaattcgcccattttaattggtggcactgcagcattgctgcgtggtctcctccatattcataaacgatgtcactgcttttccaaagccatttttctcacaaaagattgaattgttaacatgggataggtcaagttcatagaaacaaagaaagatggaaacggccacagttggacagggccaaggaggcaaaaccaaatgctctgtgggtccctggctggagccctggaccagaaaagacatcagtagaaaaggcagaggaaatcaaacagagtctgaaaatgagttagcagcactgatgctacatgaatttcttggtgccaataattacactatggttatgtaagatgttcacatgaaggaagctaggtttaggatatacagcaactctctgtgttagtgctgcaaattttctgtaaaatgaattcaaaataataacaacatgaggagggagaacatgatgcctccttcctttaattttggggcacgtgagagaaggattgatttcagggagtctgttactcagcatgttcctctataattctccctggttagaaattaaatagacaccaagtcaattatcaattaagtgacaagttgggtaaacactggaagcattaactgacccattcaagcgttctttgaaattcactcagctttccccatttctctgaagttttgttttaactttagccagtcaccaattagattgacttaatagtaaaattgtgctggtttaacaggaacaaaataaactaaggttacaaaactgtcaccccagagtttcccttgtaaacttccatacaccagataggcaaaagggtcaagttatgctggttcatgaaaaatagagcttacaccttaaaaaatcataaagtaacagatgtttcttttgaagtcataaggcagccctaatccaaagcggaagaaatgttcttgcatttattatggctgatgttttccagggagggagatcacacaacctgtttgtttcacttgcattatttatgtagtgttcttccaggtactctgcatgcccctctaagcattatgataatgggatcgacaaaagataggcagtgggcgatttccacgtggaaacgtgcagctgaacaaatgcaccagggatgaaaacgcccagtaacataaagacagggatgggttcacaggggcaaactgcaaggggatgggcgtgcctggcagggagggagccaggatggggccaaatcggtagctgtggacagcttgggaaggcacactgaggcttccaggctctgtctcagggagctgaagctcagtcatggaagttaagaatcgatgcatttatatttgttttgggacacattttcaatgcatttatttttattttctttttccttaccttctctatcctctacacattccctgtcacagaagggtatggaagcctgtttcttttgttatataagttcatattttaaagggagtaaatgctccctcagtgttcccagccaagactatacaaccttaatcccgttaaccatcatgtcttaatttagaaaccatagagggagaactcagaaatgaaatcaattttctttcttcttgatattattagaagtacaagttataggctacaccatcaaatctcttcagaaaaaaaaaaaaaaaaaaagaacacttggctagtctcaccactacacaaatccttcctaattgcaagaaaaataatgactagaccatgctataaagtgaactcaaaatggcaactctctgttaaagcaagggattgataggaagccaacctgcatgaaattagaatccgactagttaaaaaaaaaagtcagtttcaactaatgtacctatagcctatgaggcttaaattacgaacccaacgtatgtttaatataaagataattttggcacatgacatcatcccctatatttagactgcctccactgctgccatggcaaccctgacttaaaacatagctcagtgggtaatttcactccaaattaaatgaaaataaggctaatcctattattgttcctaacaattttccaagtagcttcttctgagagtgcccttgcttatatgcccttttttaaaaatagattattggaagatcatatgtgtatctgccctcactccactcacagtcactcgcaccaccctcctggctctgtggaatgaccctgtgcttgggaagaggtcgcagcacccacaatgctccccgtccctgtctatgcaattcgggaatggggaaaccttttaaatacaccaatttgattcatgaaatatttcagagactgtcactgtagaattactgtaaaataataggctttttaagataaatcatattatgcatttgtataggccttaaaagggtacttcaaattattctgttttatgttttaaatgtgctcctgtaggtttccatagttatttaggagaaccatcttttgcttttcagcctccactgaagagtcattgaaagctgagagttccacttaaacgtagtccttgtggctgtgttaagatacttcttttgactattatgataaacattaaatgttacacatacacacaaaacactctgttgacccacgacatatgctaaattgcttttccatctttaccccgacagttacctgttcaaggctttatgatccagcctgtagtcctgaaacagagaaactctacttctctgacagggcattgaagctcagacctggactacactgactgaggggctatacatagagagaagaaaatgccgtggagtcagagaccttgaacctgagctctgccaagggctccatcagctttgccatctcttgtcctctgcatatctcagttttatttttaaatctacaataataaagagacaatagtagacaatagtaagaataatgaccccacagggcttttgcgccaagcaaataggacaatataagtcatcccaagaatacaagtataaatacaactctatccccggctaatcatggctatttgaagagagcagctaagctaacaggcaacagagtttattagacatgaaggcacacaggatcatagttcccactgataactttcccaccagcttccctagcaaatacagagagagattccagtgatgtagaagatgtcttccagcctggatccaggcaccaagaagacagtggtagtctctctggctatctgtgctgatactctctatgacaaggatgatcaattgttgccataaagtgctacaatggtcccatcaacttttcagaacacgcttctcatcacactcatgatctgtattttctgacacaaactaagtttctttggcaaaagctgccactgatcataggttctagaatcactaacaaatcggcctcacttgcttctacctctctcccaacctgacatcttactagcaaggtgtgcagtcaatgcccaatacctctggactgtcctaaaaataagacctttaactttaagcatataacttctgagaatgagtccctatatattttatacttcaattattttctgaaaaccacaataattttaaaactaggaagaggtgagatcacttgaatatctttaaatgattagtagagcatatgtactaaagagatgcttaataaattcatttttaagattttttttttagcacagcctctctttttacaaatcgacttgtctgaagtcataaggatttgcttttggcagaacctgtggtataacttaggttatccacctctcggctcagcttttgcttccatgaactctaatgttagacatagcgagataggtaataatttaaacaaattcctgagtgtttaaagttaaagtcatacaacctacattaagcagattggtcctggctaatctaaaagtgttgttcagcatgaaaaaaattgaaaacaaagacaatctaggtagaatttgtttggtttcttcctccctcctatttgaaataacatttaaaacaagcacaataaaatcaaccaggaaaggacttctccatgaataggaatcatcagcattgagccttgtgatttggaaaacaaagtgcaactcaattcaattccaataatcggtttaaaacaggtgctcatatttacaatatgcttcatgtttgacatgtttgtctggtagccttcatactaaaatgcaaactgcaacctgccgacatgttcacaatcactcattccatattcccctcttcctactcataaatggccaacatttcctctgtgtctacctgagtttcaacatacccattcttgtttagtcatatttcaagatctaaaacagataactgaagcagttttaaagtgttcaggtttaaaataataaaaacaataacacaattttacatgcaacaaatgacttaattcaagatagaaattaaggccttaaacatctatgctatgtttttaagtctctcaaatggcacttatggacacaaacgatactattcttgcaatcacgaccatcactcctaaataggcggtacttcattagatcttgttttcctttgtctctactggggtacacaccagagaactgaccaccctgcggttaattttatacatatagtggactaagatgtgtgttaagttattttgcctttgaggatcttgtagccacgggcacttccccacaggtggctacagaatgtggtacacagtcttcacgaagaaaaaggaaagcacaatcatatatctgcagcagtctgtcaattctcgctaacgtgagataaaagaaaatacacaatctaaaaatctctgctcacagtgaaacagcttcagaccaaacccaaaactaactcaccttacttggttgctttaaaacagtccaaaaatgacagcactacaagttcaagcacacagatgacttcccgagctccaaacaccagcacaaagacatcttagaaactttgaaattactcacagtaaaggtaacttttccagagccaaaagagcaaggcgaaaaaaggaacacacatgcttgcccatgaacgtccagagacaagcaattcttgaagctcgttgggggaaaaaacggggaaaacacacctgtatcctttgtggcatctcttcccgggacttaccatatggatggagcttccgtgccactgatctctaagaaatcatatccttcttctagctgaaagtcagtgaagaccagcgcaatggtgtccccgggctcagccagaatggtccaggtgcagtccgcgttgttctcgtactctgaagggaagtgcgggctggagatggagctgctggtcccgcgtaaggttcctccgcaggctccctcagctgcaggggcaaaagcagaaagaaagcatcacatttcaggatggttttcatacacgagtgtgtccaccaagtgtcactcttgatcagcgacaaatattttctgaacccaaaattgagacactcaatctgaaaaagaatcttttggtatgttaatgagttctatgaaaaggcttacaagactctaacatttaaattatcttattaattgaatggccattgcgggaaagatggaaacggtggcttttctgaaacatggaaagtgtagttgccatgtacctgacattgataggcagcctaacaagattttcagagattttctccgaatcctggaagatgacactatgtaagcaacattttgagacttaaaaacatgtgggcgtttattcatggatacctggctttgagaatactgtgctcttaaaagaaatggttgtcttaaatttattttccataaatttgggattaatttgggttttgaatttcagatagctattgagtaacataaaagaggcacatcacctcataaaaaggttctgagtagaaaacagttacatgaaacttaaaatggaatatcttagaaaagtgataagtgaaaggccagtaaagataaaagtgcatttaaaatagaaactaacaattaaaaaattattggttagaaaggaaacagatcttggtaagtttgctatagagtaaaaaagcttctttgttacatttattttatctattacaaaatattatatgcattttaaactatatatagttgatatatataacatataatctatatggtagtttatatataaataacaaactatatagtagtttatatataaataacaaactatatggtagtttatatataaataacataaactatatgatagtttatatataaataacatataaactatatgatactttatatactatatatagctatgttatatatataaattacatatatgagagagaagtattttaaaataacatgttttaaagcatgttttttaaaatttcttccttccctcctttctttcttccttttctttcttctttttctttctttcctcaaatacttcctatccataatatatatttaacagtcattaattctgatactgcaatgtggatgatatgtaaaagtcagcctgttaccaagatggggggagtttgctgtaagcagaggttgtgtgaccggcctgagctcttacaaagtgcatatcttcgaccctacccaccctctctccaccaaaattataccgaagtgagaggaaatgacctccttttattaactcttcccaagttgcaagttccaatatttctttcatctttcagcgatgttcgttttattttggcaggatctaagcctcacaaaaacgtcaaaatagaaccaatcttgtcggcaacagtaagagggtgatataggtcccttcaaattagctgccttcagtttactcagaagaatgccaggggcataggggtagttgacagcacacggtttttgttcccggagtttggagtattgcatttcccatccttcctacgggatgccaggctggtctacacactaggcattctcatgctgtttatgtcaactaatgctaatggcagctttagaatggacgtctttgagaggtacacttggaggaaaattactaccttcaagtatgaacgaaatcaagactacatgagggatgggtgttctcatgttttaatagttagccagtctgtgactcccatccaaagcacgtgacgttgtggaaagggctgcccatgttttgtaggacatctcaggaaactcattttttagatcccaaatttattttaagattaataattattaagtgcacagattataaaaattatgctaccacggtagtgtttccttttaaaagtgtaaaaccaaacacgaataaaaataactgtgtgtatactacaatttgaaaactgcaaaagtacttcctgtgcccactaccaaatgtctgtcctgccccccgccctccgtgggcaccactgtgcaagcacacacacttccctggtcaactgagaacaagctgcacaactgcccagctcgccgcagtttttattacattcttgggaacagccgaatgtctctcctgccccccgccctccgtggacaccactgtgcaagcacacacacttccctggtcaactgagaaccagctgcacaactgcccagctcgccacagtttttattacattcttgggaagagctactgggaatgtgatcatacatatacagttccctgtcaaaattgtatttttgaacagagataaaaatcagtaccatataaaaataagaggaagaacatattccagccatgaggaaaaatacagtggctactactgagattcagatattgggcagaattcagctctaagccccttgtgttgggataatggtgaatcaggttaacaactaaaagtgactcatactctacgttgtttttctttaaacgcaaatataaatatctccttcataaagggatgaggtaaacaggatcactagagacagatatttacttttattattgattaaataactctatataaacatatcacacacattaatatttccagagtaataattgtttttcatgtataaatatataattttatttaatatttagattttattcttttctctgaattcattatatactacaaaagttatggcatctcaatgtaaacacagatgcagaagaaaagagttctaatacctttattacctaagaagataaaatatcatagatgtgtggaattaaaagaaaattatcaaagtccacgttaccaaaatgatgtagttgaaagattaatgacatattaattgaaatccaactgctgaaactacatacattcttcataattcaccttgttggcaagaaatcccccctttcaatgtttcagaggggaaaataaaaaaaggaaaaaaaaaactgacatcaaatgattatgaatttttgtcatggcagtcgatgagctgaatcactttctattatttaaaaagctttgaaatagtcgtatttatgtgcatggtatagaataaacatagaatacaagtgtatagaataagaagcttaaccgattcttctgggaaaacctctcagtaaccttgaccagaagtgaatttaaacctatctgacaggagtgtttacaggcagccaacataacagggacaccagccatagctccaggacagagtccagggcccccaccctgcagccattagccccctggtttctccactgctggaaggttcgatgacctgcagaaggtgtctagggagtttgtagggctccgggtagtggatatgagttaactggtaaaagagggttcttttttattttaacagctgacagaactgtgctggtgcccacccctgagtaccaaccctgatcaaatgagcatacctcactgccatgcagtttccttctatttaaaatgccagtggctgagctggataaactgcaatgttatgcccctgtctaatatttgagtcccctgagtctaagatcttagacacttactatctacattttcctagaatttccgttgatgaatgagtggatcatggagacccatagttcactgggccagcatgagtactaggctcactgaatccaggtaagaccagagcactgactgcaacagacaagtggtgaaatttaagggtaactttgttgggaaaggagtagatgacataaagaaggcaaaatagaaaagtcaaataaaatgaagaaaaaaacaattaaggtagcacagaggaaaaaaaaaattcccaaaccttatgactattgcatttcttcagtagatatgttaatgtccatagaatattccggaatgagttacagttagaatcaggccaaaataatatatgcaagatatattagaattgtttgtatagcactccacataaaatatagtagaagattattaagatagtctgattgattaattgaatattacacatataagacaaacaaaaaaacttcatggtactcatgggataaaatgcttaaatcacagaaaatctttagcacagaatgaggcaaaattagtgttggtgcctgtgagtgtgtgtgtgtgagtgtgtgtgcatgtgtgtgcgtgtgtttgtgtgtatgtgtgtgtttgtgtttgaaagcacctgctatagtgctgtaagtacttctctaacaaaactttttaactcttaatttctccgctatttttgtaagggattttactttctaaacagcaacattttaaacataatagcatttgaagaagagctacctaactaatatgtttgatgagcaaaacatttttaaaaataaatcagtttgtttcctcttagatctatgaagctctacaggatgatcaattttataaataatgccacagaggaaacagttttcaaagcccatttcgactgagaaaaattaattacttaatttttgatataatatttacttgtgaacttatcttccagtttagctgctaaagatattaaattgctcccacatatcgctaaaggataaaagctttgctgacagaaatgggaaccattatccctgcagtgtggagtgctacaaggacccaatatgattaaatgtacatcataaatgatgagtgaagagacattatttaacaaagtatattggaagaactgaatagaaagttttaaaatatcaacttaaaaattccctcatacaaaatacctgttacacaaattaaaatgtttgaatgtattaaataatgggtaacttgttacattaaaatataatatatggtctcaaattaagcattatctcaactaaacagaaactgtgaatgttacggaagcaaaaataactttataagtaaaccaatctacctgtttaattttttcaaaataaatgtataaaaataaaaacaacacaataaaaaaatatttgcaacaacacagcagggggatattatttatacttacttgctttgtattttaagaaacaagatacaggcttggcgcggtggctgatgcctgtagtcccaacactttgggagccctaggagggtggatcacgaggtcaggagatcgagaccatcctggctaacatggtgaaaccccctctctactaaaaacacataaaagtagctgggtgtggtgacgggcacttgtaatcccagctactcgcgaggctgaggcaggagaatggtgtgaacctgggaggtggagcttgcagtgagcagagattgccctactgcactccagcctgggcgacacagcaagacactgtctcaataaacaaacaaacaaaaaaacaaacaaataaataaataaataaatagataagtaaataacaagacacaaacagatacatgggaaaaaaagattttaaatggcaatttaaataagagtgaattctagaacaaaccaaaattaaaaacaaacacaggtgaagtttcaatctttcttattatgataggcattcaaattaaaacaacactgaaatgccttctaatatacattaaaaagataaattctgaaaatacataaatacgaagagtaaaactgatctagttgtatgttcctaatatcaacatgcattaacacagtgcttcaggcgatttaccaacacaggcgagtgacactgagagggctcatatacgccggcaaattactcaacttagggtctgatgtctactgagtatattgtacgtgtctgatattctaccaaggtcattatgtgaactatttaatcacatccaaaacgtgtgataaaatgtttgtttttgttcctctttcacagctaccaaaagagaaatgtttttcatttttttagaaaacagaacaaaacaaaaaaaccatcaactggaaaacattcagagactcagaaaatatatgatcaactaaataaaattaaaattaatcaccataaatactctatagtaaaacagaaaaaagggtataatgtctgatctgtgaaaaagcagaacaaatttatctacgttaagctgtatacatatgtatatttcaagttaactataaagactaagaaatataaacattttaatataattgtggtattatagtaatataattgttatgagggatttaaaaactccttcaatcttttgtcaagaaatagtttaacatctaaaaaacatcccagtaacattcatgaataatgaatgaaacttgggaattcttaatcatagtacgtgtagaactttatgtgtttctgagagagtatatccacaaacaatatatttaaaacatattagagatgctgttgtttttgttttaaaataaattctgccatgaatcttttttttttttttaaaggaaaggctattttatagtaaaataaaatggcctaatttatctattatatatctggatttttgtgttatattcagcaacaatgaaaacataaaaatgaagtagtatttttagcaacctaatttggtattataaacaaaacatatttatttgggattttccttctttccttcattttactattctacaatatattttagatttcaataaatttgtgtatgaaatagtcactttcttaaaaagattcagctggttaggttacaaagttgacctggatgagattggtgactattattctttattctttttttgttttgttttgtttttgagatggcgtctcactctgttgcccaggctggagtgcagtggcgcgatcttggctcactgtaagctccgcctcccgggttcacgccattctcctgcctcagcctcccgagtagctgggactacaggcgcccgccaccatgcccagctaattttttgtatttttagtagagacagggtttcaccgtgttagccaggatggtctcaatctcctgacctcgtgatctgccagcctcagcctccctagtgactcttattctaagtgaagtactgaggaatggaaaaccaaacatcctatgttctcactgatgtgtgggagccaagctatgaggatgcaaaggaataggaatgatataatggactttggagatttggggggaagagtgggagtggggaaaggggataaaagacaacatatatgatgcagtgcatactgcacaggtggtgggtgcaccatctcagaaatcaccactgaagaacttacttatgtaaccaaacaccatctacaccccaataacttatagaaaataaaataaaataataaaaaaagtttcaagcctacagacattcattgtacttgcagaaaacgtaatgcaggggcgggtccggctccttgaacagacacacgtggccgggtggtcactccctctgcaaccaattagacacagacaagtgctttgcagggccactgtctcaacatggtggccgacatgaacactgaattatctccagtttcaaatcatgtggcgatacacttgcctttctcaacgaattggctcattctttattttctgaattgtcttttattgtgtaaggacgttccacatggtattataaggtttgcagtcataaattcactctcaattgagagaacatagggtgtctcccatggatactatatttggtgctttcttcccacttcaaacaacagaagaactttcaagactccctcatttgatttgtttcagctaaatatgtggaagtgagttattgtatacaagcaaacattaacatcagaataattagtgtcagaatctcatttgcacttggcattaacagaccccggattgctagcataagcactgtcttttaattccctggtccccatgaacaggagctggctgccaaaatcactgggaattggcttagaagttgactttgcagaaccatgcatttatgttaattaatttattcattcaatacatacgaaaactaattctctactagaatgagcagagaagggttttctgaaaacacaatatttaggacagatttgaaaaaaaggaactattcaaggaatgagctggaggaagagcattcccaacagatgcaacagaaagcaccatgtccgaggagacttgatattcacatatcaaccacagatgatttatgtactgcaaattccccatgacatttttgggtgcattctcatgcagttgctgagaattccgggacagaaatatattgactttgtgcgcaggagtaaggatcattcacccacaggatcatgactctggaataaacaaaaaatgaaaagcatttgggaggctgagatggatggatcacctgaggtcagcagtttgaggccagcctggccaacatggtgaaaccctgtctctactaaaaatacaaaaaatagctgggtgtggtggtccatgcctgtaattccagcttcttgggaggctgaggccgaagaatcgcttgaacttgggaggcagaggttgcagtgagccaagatcaccccactgcacttggcctgagcgacagagtgaggccttgcctcagaataaataaataaataaataatggcaatattcttgggatgttagttttatttataattgatccttccccttgtcaaatccataggtaagcaagagagggaacagcacttgtttatgtccttttccttttaatctgcacatgcagatggcaatgtcagaatatctgatttctataaaatgaagtccagactggaaccagaaggaactcaccactatttattacggcttatatcaccattcatatttcttttgtcgctgagagaatccaggacttttcctattttttttttttttttttttttgagatggagactcactctgttgcccaggctggagtgcagtggcgtgatctcggctcactgcaagctccgcctcctgggttcaagcgattctcctgcttcagactcacgagtagctgggactacaggcacacaccaccacacccggctaatttttgtgtgtatgtgtgtatttttagtagagacggggtttcaccgtgttagccaggatggtctcgatctcctcacttcgtgatccagccacctcggcctcccaaagttttggtattacaggtgtcagccaccgagcctggccacgacttttactatttctcagtgaaatcaagcactgatgcccactttcatagaacatgccttctatatattttctattcaaagctgtgaactactcaaatcaccactcataataaaaccaaagcttaccaggccctgaaaggcattatgtgagctggaatgttggcttcttctgttcctcatcctccacctcctttggctcccatttcctcttttcctcactgggtctagccacactgcttcctggggccagggcacctatgttcctgccctaaggcctttgcaatgaccacctgcctgagaagcacatctccctgtctgacttcagagcccctcacaaggcactttcctgcccgccctctctggccaccatatttaaactagcactcacctagattgcttcccacctctccatcctgtatgcttacctctcggtgcgtgctgagtgcaaagcaatggaatgcaagctttatgagcctgttcttgcacttgcgtgcacctgttcctaggaggcggcctgatagaagtattctttcttcctctttttttttttcatgcaatgaatgaaaattgaatgactctggctttcctacagttatatcagttgcaaacaagcctctattcatttgtctttaacaagtgttgggactatgacaaaatatatttagggggctatgcacggaatcaaaccatatcctctctaagaatagaagaagaaaagtttatttagttatagagatctgtggctttcttaagaatgagtgttaaaaaaaagtagtctataaaaactgcctcaagaactcttaatagagcgaaatttcagataaaaattaattaccaaaaagaacgattcataattgtagcaatccataagaggtttatttgtgtgtttttgctttgcttgttttcagcaagcaggaaaaccacaagtccaggaggttttttctttgtttttaaactcaccagagctgcatgaaataaagtcaaggcaggtagagaaaacaaaatagtcacagcaaaacattttaaaaggacaaatatgagcaagctacagggcagctggaaaaattagttcaagttccatcaagttcaagtttaacttaaaaaccacatataaaatatgaaatgtattaaaatatgtaattattaaaacaaatatagttattctgttcaatttttaggtgatctattaatataatggaagctccttttattccatggatactaataagcatgaaaatatatcaaagttttcagacactaatatgtattatataatttttttttatttggaatctgaaatttggtgacagaattaaataaatgctatttaaaatttcagctctcccttgtttacacatgatgcagaacaaaacttgaagttattgttgaaagttacagataaatacttgattgttaaagttagcacacaacacatgattcagtattttctttctttttttcttttttttttttttttttttttttttttgagacagggtctcgctctgtcgcccaggctggagtgcagtggtgcgatctcaggtaactgcaagctccccatcccgggttcacatcattctcctgcctcagcctcctgagtagctgggaatacaggcatccggcaccacgcctggctaattttttgtgtttttggtagagacgggatttcaatgtgttagccaggatggtctcgatctcctgacctcctgatccgtccgcctcggcctcccaaagtgctgggattacaggcgtgagccaccgcgcccagtctgattcagtattttctaaattgtgctcctatgatttccatgccaaagagttaatgtttacaaacagcaaaatcgtcagtgggtaggttttgtgcccataccgaatttccatcagagtaattatttttaaaaatatttttcctttattgagttatcataaaattctgcatttgaagaaaatgttgtgcagttaaaaaatggttgaacaccactgacttaatccaagaagaacataaggcatttaaggaaagatgcatttgaatctatttatttctgtaggttgggaaaataattctaaatgtaagtgcaaatcagaatgaactgatttctatttcctcccaagtaatttcagactttttaaaaaagtgtatttctcaactctagaatttttgtgccccttttgtgggtataaaacttgctggaaatctatcttacggacataatttaaaatacagaatagaacattacttagaagcaaactgccatgtttatcataaagaaaaattgaaataatctaaatattcaacagcggatacatcattaaataagctatgatacattcaaaccatagggtcatcaaatgtgtttaccaagcatttataatattccttcagtgaatttctaagtcatgatgttaaatttaaaaatgcaggttatacagttggatgtgtaattccaactcaatttttacaattgcatggggaaatatccaggaaagaaataagaaatacacccacatatgtaatataatagcttgtaatactgggagatattattgaggaaggaagggccacaaagagttggtggtcaggatgtacctacctccacaggcgctcactcctccaggagccagaatgaaaggaacccagagacatggaccattcctgctccatccccctccctcctgttctcagagagtcaaccccacttacttcatgcctgaggccattaagagggtactctcgtacatcctttgtcttcctttacaacagtccctgcaaaaagccctggtctcctctgtcgccctttatccctccaactctcatcctctaaaagatctacacatcttattttctgaccccctaatcttaattcttcctatgctcctgaatgtctcctactacttcctcgaaaactgaaagtcaattataaacagaatttcctacattccaactacttctgacatattttccttcccttcttcctctgatggaaacctgaatgtcttctctgaagtcatctcagtagccaatgttttacatctgtagtccacgtacactggtcctgctggcagactgtgcccacccacatgcatctcatggctacttccaggtgactcatggtcttccctccctcatgtgcccagctttgagtctcttgccataataatctggcaccctctgccttgtagtcatctacaaacccctacttgaaatccactattccaagaagatttaaacttcgggccctctgtcagcctcttcacctctacctctgcacaaattctcggtcatttcaatgtcaacacaggtaatcctgggaaaaacataacctctttgattaattctcccctctcttccaacagcccaactctacctcagccatgccatcaccattcccatcatcaccctctatcttctcactaccagtaaggcatcagtttctacagctgcagtctgactacattctgagcccaactctccataccaggtcacttacccaaacacctaaactcataattttttgactcatgggacctagagttccctgactctgcctccccttcactttcttttccttgtccctatcatgtcctcatctcttgtcttaccatccttagggctcatggcctaatgcacttccttgcatttaccataactctgccatcatcacagtaaaacacctttggttccagtctaggccaagtccacttttatatccttgcaggtaaaacagctggaggaattccaaaaccaaaaacatactgaaaggtctaactttacatatatggccataatcctacattggcccataatgatgcccagcaatcccgcttcactttctgtatctgttcactgctccctttctgggggatgactgtttcatgccttcttccttctaaagctgccagcatctcttgccaaatcctcactgccacctgatgactttggtttccatttcacaaagaaaatagaagcaatgaaagataaattatgtaatctataaccttcaattttgatgcctacttataaaatatctttcctgcaaatatttctacctagtgggtacacctgtttgtgttctacctttcctctctgatcaagtttttaagccacgactttaccagttttcttctctttcaaaacgactatttgtgtttttagtggagaattgctctctgcatataaccgtgctccaattgcccccattcaaaaacaatgttatagacttttcttttgattccatgtctgcttccagactccacattcccctctagccttactttctgaaattcctttcactgcaacacgtctcaaagatgtccacatttgcggtctttaaccttgttacatcctctcttgaacccacttgagtcagagtttcaccctcctgggtttcctgcagaaggcccacatgtcagccacagccagaaatccaagagtcagttcctaggattcatctcactcaagatctcagtgacatttaacattcatccatttcctcatccttgaattcttttcattcctacacttcctaaatttttaaactacgaaataattagaaagtcacaagaacttgcaaaatagtacggagttatcagcatacttttttctcattttctcccagtggttacatcttatacaagtgtagtataatattaaaaccaaataaaaattacactggaataatatgtgcacagtcatctttggtatccattgggaattggttccaggatccacaatgctcaagtcccttatataaaatggaattttatttgcatataacttatacacatcttcccatatactttaaatcatctctccattatttataataccaaatataaatgtcacagaaatggctgttatactgtattgtttaggtaataatgacaaggaaaaaaaaagtcagtacatggtcggtacagatgcagccatcatatgcctagctatattgtagacatagccacaatgaaacattttctagatttaaaatatatatatatttttcatccacatttcattgaaactggatgcagaacccaccagtaaacagggctgactgtatatgattctatgccgttttactcactcgtctctttagatactactcttcaggctttctctaatcttattggccagttcttctgagtcatcatgccagtttcatttcatcttccaatccttggtagggtgtccaagattcattctcttcacctcttctcttcctaaatacattcattcattgccttgttgatctcatccagtttgcgtcgcgtggatttatttttatgttttattcttaacttttatttttgtttcaggggtacacatgcaggtttgttacttgcataaatcttgtgtttcgaggtgtggtgtatgcatgatccctacacccaggtagtgatcacagcacctggcaggtagttattcaaccgtcaccacctccttcctcccctcagtaggcctcagtgactatgtcatctgtatgtctacagttttcagagtgtccatcagttccatgaatgtctcctgaattccagctttatgtatccaactccctatttcaactccatagaatgtctaaatagcaatccagactaactagccctaaaatggttcttttgctctttccattttcaaatctgcaatctcacagtcttctccatctcaataaacggtaactccattcttccagtgttgcacgagaagacacacggtgccatccatgactcttctatgtctctcatgtgtcacaaccactgtgtagggaaattccatcagcaccttctttaaacagcattctgagtccaaatgtgtctggccatctcctctgctcctgtcatctctcaagtaacaacacctctcattttcattttgcaatgattttctaataggttttttattttttcccttctcagcttatgttcttttctcataagtagccagagtaatcctctcaaatgctgtgtcacacgatgtcgtttttcttctcgtatccccccattgtgctcccacactgctcagtatagaggttaaagtccaaaggctgatctacagggcccactcctatcctctgggatcctccgggacctttcccctctcctatcctctgactgtctctcctacaaccctccaattatcccatctgctcaggccacactgccgttgctctattcttcgttcactcaccgtacgctgttgtctcaaggccaaacacctggttgatccctctgtcagaaccacatttctgatattctcgcagggctcactctgtcccgttcattagaggtccaaatattccggttttctactatcaggggggtttccaggacatgggatcttaggtgataagaccaggagagtcctgtccaggcagtgaccaggcagatggtcaccatagctcttaattacatgtcagcttctcagtgagaacacttacaaacacttatttcaacaggacagcaaagtttatctgttgcttctcatttgcttatttatgttatctatctccacccattaaaatgatatttctgcaaagattggaattctttcttgttttgttcatattgtagccccagcagctacaacaaatgttggcgaactatagcttgtgggttacattcagtccagtatctggttttatacattaggctttactgaaacacagccagtctatctgtttaggtggtgtctatggggtcttttgatctacagtgacagacaagggtagctaaaacagagatcatatgacatgaaaacaaaatatttgctatctggcctttgacaaaaaatgtttaccagccctgattgataagtgtatgtaatactttgcaggtcctcaataaacgttccttggaagaaagaattaacacacgtaaatactgaaaggacatacggagaaatattgatgtgtattggaaatcaaaggcaataaaaacaacttttgagcatcatttcaatgccctcaaactcagcaaattaaaaagaaatgcaagtatcaaaagttatattaattgtggtgaactgtcataacattagaaatgcattcattaagtttgcaaagcataaacaacattcctagaaatctttccttaggaaaaaaatctaacagaagcaacaaacacagtgctatatgtacagagacactaattatggcattgcgtgtcgaagtgaacatgggaaacattcatcacattcaattatagagagaaaataatctgtaaaatattgagaatcaaattatgtcaatgcacatagaagtgtgtatgatttaacactaatcttctccaggagaatataaatgttctctgttctgtgacttcagcctctaagaagctttttagacattgagttggcttcttttgatgtctgttcccccttactcttcaaggactactatgcgatcctaatagccgttattggtattaagcacctggatcatctcatctaatctttatcactcctgtgagattaaaagtaatattagcccaacttaacaaattcagagcctgggtcttagcaagaaaagagctcgtctgagctgtgccaacttgtgatgaggctggagctagaatgacaaagtccttgctggtaaacacttcgcatgactgcccatcacaaagaagggcatttacctgggcatggattcattctggcactagacacattcatctttacagctctataacctaacatggtatctgcatggaataaaataattttagaaatactacaaagtaacccacaaagctgaaaataatgggcagagccacttctgattattttttaagcctgttacaagattgtatgggatgagataacgtgaatgacgtgcttggcagaaaatgtagcacagcaaatatgcaaaccacgtagaccaggtttactagaatctaagactgatttttttgaacagttttaattttgatacgatttacactggaattgtttattgcaaagtatgcaagaaaggtgcttaaaaccaaattgtctaaaactactcaaaaaattgaaagctaggtttcttatataaaaactgtcccattcagtcttactttgtatttcttgtcctgacgtgacagatcatttaagattcattttacaatgttaccgctgaaacataattgataaaaacacagctgtgttttaaatatcgcagaatttataggcacccataaaaagcatgacttctcttccttctcccctctggctatgtcgttcctagttttcctgccttttcatctctagtagcagaatgcctatgattaaaaaacctcgactgacagttcatatagaattggcaagtgacatattgccatttccagtcacattacgtaaggcttaacaattaaagaaaaccacagcttcagataggtctaaaagcaacaatgggcctacactatttagcatgttttattaaaggtatcagtgctactgctatgttatttagtggcatcttggcccaatgactatcattcagtctccaagaaatacaacagtctcaaaatagataaaaatcagtttgaatcttaaaaaaaaaaaaaaaaaaaaaactcaagacagctgctacatcccattttatctaaaactgttgaaaaatactgacaatgtgttttgacatgtttaggtgaatacttatcttaaatgtatgtgttcagacaaaaacaagggtgaaacttcattcactaagcaagcggcgtaacttcccaataatggttcgtatgctgccgttttctatggtttacatctcatgcttccaagcaaaacagaaacaaacaaatggcaacaaacaacaaaatgtctcttcaactgcccccaagaaggttgccgttggagggaaatgtagaaaagcaccaagtcagagctggccttatcagccactgtctttcagccttggacatgacatctaagctctcagagaatgtgattccatatctggaaaatctacccattaatatttaccaggaaattttgggatgggatcatataaaagttcatataaaacattttagataggattgcataaaagcattgaacgttcataacgtaacacttgccagagaggtttagtctaagtaaaatatttagtcatgtgatctctccattccctttgctttcctgcttgagtaattcataggtacctaaaaagattccagtagatggaaatagaaaataaatggggaataattaactactgaccaactgactctcagacattttgcaatctcctcttgcctgaattggcttcccgagatgatcgagccagtggcagagaagatgcatgaccctgcagctgcactgagcctgtctcttagacgtctccaggtctcaggcctctgcccaagaatgcaagcttcctggaggacaaggaggtccaaggttttagtgaaggatctggggctatgagaaggaaagaggagaaaagatgaagattcacttagtcctcaatcctaaaaagcctttccccagatgaggaaaattatttgggtgaagagatgactctttgctttgtcttctacaggtttgtcttactctgtaaagcaagagcttcagcaaaatagatttagcctttaagtaacatgttaggaagaccctatagccaaaccaccctcttgggttaagggctctgttgacctaagtttatgtgtatagttgggtttttttggtcgttgttttatttgacatccatgaggttgttggaagtcatgtctatcaaagaccaagaacagcagttttagttgggtatggttcacaatcctgaaaaacacaatcccaaatgccataatcccaattgttgaaatctcaaaagatgaaactccttaaagtcaaaatccctaatgtctaaaaccctgaaatcacaataacagaaatcatagaagactttcagaaggaagagccacatcataaaggaacaaaagcagatattcatccggaggcaagacttcagaatgtactcagtgaccgcggtgttcagccagccttgctggacgctctccatgcaattgtacatatctacccctgcaatacacttttgtgtatgttgaagcttccttctagatatctttttttaaagttttttctactattttaaattgtcagcactatttttttcacaattcaaggctatgcaattcatcttctcatcatttctaatatcaaatgccacataatttctttctttttaggggagggaggacaaagtttcgctcttgttgcccaggctggagtgcaatggtgcgatcttggctcactacaacctccgcctcccgggttcaatcgattctcctgcctcactcttcctgagtagctaggattacaggcatgcaccagcattcccagctaattttgtttttttagtagagacggggtttctccatgttggtcaggctggtctcgaactcccgatctcagatgatccacccaccttggtctcccaaagtgctggaattacaggcgtgagccaccgtgcccagctgccacctcgtttataactctaaattgtgtagaaaatattagagagttctaattaagaattttttttttcaaattcgacttcaaaaactgcatggtcacaggattgactttgtgcctcggcattgtgtgtgcatggtacaaatgctgaaacttcctaaataaatgaagagatgtcctctttgtaatctgcatttggaaaagataacatttctggagatctcagctgtttgggtgactgtatatctggtggtgatccatcatggttttcaactgaccaaaggacttaggctaatcatcacggtatttctgatgactccaatcataaagctggttgcacacaatgggcaactatagcggcatgcatttatacatgttgcattttgattaattgcttcatgagtatggtttgtccactcgtaactgtcatacccatgaaactgtcactagtgtgggtatgtatgcttgcaaaaataagctggttattatagcctattgtatggcataaagtatcctacaaagtgttttgtgtgtttttatgtcttttttcaaagaaaccctttataaaaaataaatacacatcttttacataatttaaaaatattttccagaattatattttcaggattctgactttttatgatttaaacatttggtattatggtgtttgagagtctatcttttgggattacagtctgtggccatttttatcaaggcctggcttaaatgtgtattcattttcatccacaaataatgccgaggagctgccatcatctttctctcttggcaacttcctgcctcgattcctgttctctcccagtttgcaatctctgagtagctgcaggtctgtcaacacagctgtacctactttgcacaaggagcaggtggaggaaggggaggcagccaaagcccagcagcttccctctctctgggaccagccagttacctgctttgatgagaaaagcagagcctctccaggcaaccagcaccccctgccccactcagactattcaggattcaagcacatgtttctcaaggagaaaacacttgtttaattcaagttgtaatatttgtttctcaattttaagttaggttcttttagaaatatttatttttctcttgagttagaagagaacggacagcatgtgacaagggccgtggcacagactctgtagccaaagtgtccagggtcaaattctgccttccccacatacagcgtgggaccttggtgaagtcactgaattcctctgtgatggagtctcatctaaaccagagggatgatgataatatataacttctagacttgtcatgaaagttaataacaagaacatacgtaaggcatgtaaacattgtctgacattttgtgattgctttgtgtttaactctgattaccacactttcttaaaatctacaattacagtgactaagatgaaatctttatcgctttgagacagatgctactccatttgctagaaattgtctatatctggactactgctagatacatatttttgtactaggccatggtatcgtaagacttaaagaaaaaggaaagaaacacaaaaagcagctcaacagtccaagacaggtttattatggacaataaacctgagagaggctcctggctgagttaggtcagaggcactctctcttacagactaagagtttttaaagattcagggcgagagagcttatcacaggcttggaatgtttctgtgtctctctcttgcttatctgggagggagagttttgtgtctgttcccatacatctccgtgaagctgcaagcatactaccaagtctgcttttagcttccctatcttcatgtacctaaaaggaagggaacattcccttattagggcccttattagggcccactgttttactggggcccattgcatgaatgtgaagtttggtggttacccaagagacattccccattccctctgtgcctgagctgtcgtatctgtgttttacggtctgctcttgctggctgcttgttgtcagaagacaagtgatttccttgaaatgcatgaggttagaaagggagctggaacttaaagtggcagttgtctgagataatgctgctcctgctttgtcagttatttacatgcacgtgggtatgaatgtgcctgttgtagaagtagttttcccaatatttctgtccaagtggtggtgtgtaaaataaagtgacccactgccacacaggcctttctttcactaggcactcttgtcctttttcctgagccccaaaccatttctctcctcaagtcagtctgctagtttcttattctaaagaatagcagtaattcattaaaaaaaaaaaaaaaaacccttttttttaagagctaccaatattgagatcctgtagcttacatgaatttcttttcaaactgtttgccattccgctctgggcacttagttctgaaatctaaaatcgtgcttaagagtggaagggagaggagatagagacagtaattatagcagctgatatttttagagtttctctatgtgtcaggctctttgctaaccattttacctgggttatgccatttaatctttacaacagatttctcaagtaggcacttttatacacataaaaatcttgaggccagacagattaaataaattgaccaaagacacacagtgtccaattgacagcactgggatttgccccaggtgaccagtgcagagctgctgaacaagctgtttcaccacgacaagcactttaatccccttctttctgtgctcaagactgcaagatgttgtatttcatttaatccttaaactgacactgagcatgacatctgttcaaaatatttactttttctatgctctattgatattataggatagggcttggttatgtgaccgctagggtcaggctgcctgggtccagatctcacctctactgctttctggatgggtgaacatctcagataagaagaatacataaccaagatggagaagtctgagaaaggcctccaattctcttatggtaagagatcaaaactgctaggtccctagaatcactcttctttattttttcttacttattccaggacagataacaaagctgttttcattttactccctcagcgaatccgcgtgttcctcaaagtcttctgtaatcttcattcattagacccaacgtcattacttccaaccttgagataaggtctgaaatgagatttcttttgagaaaactttttagattaatcaagagttagctcactcttatcttttgcctaaactaattttaaaagggaccctatttttggtcctactcagctcaaatatgcttcagcaattgctgaaacttaaagggaagaatttccaacacattgtgacgtggactttgatatctcagacccattgccttatcagtctttatgattaaactgcatctatttattaaaccctacaacgtaagtgagaataaaacccagtgacagcatcagagctctacaagcattagcaataatgaggatagaggatacaacaagtttaaagttgaggctcaatacagtagcctgaagtgtatgcagctcatgagcacgtgaaatgtggctagtcagcattgcaaaatggcataactgaaatacacatcagattttgaaactagcatcttttgaaaatcaaaatacttcacttacagtttacattaattctgcattaaaattataatcctttggaagtatgaggttgacaaaatccattattaaagtttatttcacttgtttcatgtcacattttccgtgtcgcatctggggatttttaacttcatctgtggctcacattatggattgtgttatatgttgagtggacagcactgctctaattactaaggacctggcttttgttggttaagcgtgtggcagttgaatccgctacatccccagcatcgtcctcagtagagtgtggatgctccagcaaggatcagctccttctgagcaggtgcacctgggatcatcctcatgctaagtcttatcctgatgccctcaaatgacttatcacatgtagctgctctttttaaactctctctccccatcccttttctcttttggcgcatacctgcgaaacttgttcggagtgactatttttttctctatgtattgttgcaatatccctttacctatccccgtcccctccccaataatctttatcttgagtgacaaatgaagaagccatttagtgataaaactaaattaaagaaactaaagacccggggctctagttggctcagagataacaatgaaatagtgccatccccctctctagcttgtaaggaaaacaaactaccccagatcatcaacaaagctgactagctcttttgatctttatttttttcaactagcttcagtcaagtgctgcctaggaaaggatagttaggtctgtctaattctggagtccaacactggaaagtccaggtgcctatatttttcattctttaatatacagatgaatacatatgggagcatgtatccacacacacacatatatatatgaatggatatagaatatatatatatacataaatatgtatatatttgtatatatattaatatatatgtatatttatgtgtatatatatatatataacaatagcattgttattggtaataaaggtgctgactattttggtctatgcctcactattcatttgcttatctcttatgtatttcagatttcagacaaggaagagaagtattatttagtgaacacccctccaattcagcagaagtgaatagcatacttaaaatcatgaagcaacactgtaaaaattatgggaggacatattttctatgtacagtttgtacttagccaatacatccatgggcgtggatgcagataaggacatttgcagccttgctcaggtttaaagacttccctccgaagcaacatttggtagaaagcatttgaggtgaaactgaggcacaagaaggtgtcatgaaacagggtgtgcattgagggcacgagtaaagagaagcctccaagttactgctttgcgacagtcctagaaaccattctggaaccctctgggtgagcgctcagggagagaaatgtggtagatttgggggaaatgaaggcaagtgggatattgaaaagctgtggtgaagtgacaactcactggatgaacagacaactagaaactttgggaatcagagaaaacaattgtattccacatattaagcaatcgtgtaagttagagaaacaattcagtggtcttcagaaagaagaagagagttcattcggagcaagaattcacatagttaagaagcagaaaatacatggattattgtgatgaaagcaagtgtgcaactaagtaatgagagaaaaataaggataattcaaaatttgagggcaaataaatagcagtatggcaaagatgggacagtcttttaccaaatccgtgtttttcttcttcctgagctcacagatgcttccatttcctggctctctttgcagtgaaatatggcctcatggttgagcttcagctaatgcagtggatgtacaggagatgcactctaatgtgtggaggaactgcccatcacaactcaagttcttccttttcacccagtgcaatgttgcaggctacagaccttcagggaagccagatgtgaaaggtggccatctccaaatcaccgctgcgcataaaaacatctgaaccaactacccatcattgagactcattttgaatttaacttgagcaaagagtatttctgtttgagcccattaatactgtattaatgaaacaagcagaacaacaatgccctggtccaaatgtgaaacaaaagtaattccaatttcattatgaataattgaggcaaagccagcactcatctagactctgggttgagtagcattagggattgcaatgttggaatcacagaagaggaagtctaattacaggcatacgcttggctctgtgctgagcaatattcacgcacttaccaaaatatgaatgcttactgcttttcaacttttttttttttttttttcctgacacggagtctcgctctgtcgcccaggctagagtgcagtggcgcgatctcggctcactgcaagctccgcctccagggttcacgccattctcctgcctcagcctcccgagtagctgggactacaagcgcccaccgctacgctcggctaatttttttttttttttttttttttttttttttgtgtgtgtatttttagtagagacggggtttcagcatgttagccaggatggcctcgatctcctgacctcgggatctgcccgccttggcctcccaaagtgctgggattacaggcgtgagccacagcacccgaccactgcttttcaacttttacaagcagactttagatacattaagagcgacttcattattattatttaattaaatataaaggctgacatatttgacactgcaaaggttctattgcaattgagagaacatagaggccaaaacaggagagaaaatatactagaaagagtagaagcaagaatattcacatcttactaaatggaaagacaagagatgttaccaaaaattaaagaaatacagcataaagaatcagttgtattattccagttcataaatataacagatagtaagaagacatgggaaacagaagtgatgtaacatattaatactcatatcaaggtgtcaattgagaaagttcacaacggataaagcatgaagaataatgtaaacaaattacataaaagacaataatgacagaaaaccagaaatggttaaatcttatggattctgtggcataagagtatggatacgctgatggaagttttactttcatgggaaaactttattattaaactcttcaaccatgttcatatgttactgatcttcaatgttagtaaagttgggatgagaccacccaaactatagctgacttgttacaatgtccaagtcagaaatttaaatcagaggtcaagtcaatttgagactttagtttttcacccttattacagaaataatcatattttccctgcccatttcttaaggttctttgaggtacaagcaggatcttgcatttatgggcctcagcatattgccaaggagacactgcataaatgtgacttgtggataccttcctatggtggttcattggagttgcacataggagctactgcaggccgctctgtgaagtacggcatacataaacatacgtagtttatgacagcttgtgactgggaacttcctgagtatgacttcagggatctaagctctgcaatgctgctgagaattgttttcttaagtaaggtttgctaaaacaaagtgttccatcatagaataaatgaaagcatgtaaaaaggtggtgttcaggtgagggagcatgaatctttgtctgaagtacgattggcctgggctaggcctgggtgggtttaaacggcctgatgccttggtgattacataggtagaattaggcagccgggacaacatcagactaatactcacaaaaataagattcagaattggagcaatggaataaaaggggacaccgaaggggctgcaagagatgttgagactgtaattttccatggatgtgagctcctgtgaagaaatgcaccccctcctgggggagtgttctggatcagatgttagctttctcatggaggaggattttctaaatacaaatatttacctgcttcctttctaccttcttgtatgcccctatccaaaatccacacagtggaccatctttcatgttttccagtcaggaagaataccttgttttgcatttgatcctctatttccctgtaggaccctagatctcaaagtaatttataatctatcctaggctgtaccattattatttaataatttatgaatcaataataaagtatgggaaacataaagcaaattaagaaggcatttaaatcaagaggcaaaagcatttttcattgaaactatctagctgcttcttctcttttttcatatttctcccctagacagacatcatgcctgtaagaagtgaaacagtaaatcctttttaagactggcagaacatgccaataatatacaatgaataaggtgaattaagaaagacacagatcttaagttgaaagactcaagaataacgaatagttgaaagattacctctcaagaaaaatgaattttgaggtctcatttttaatgtcaatgtgatgtttgttccctgtttaagggacacagttttaagcaaaggtgactggcctctgatttagttctgttaattattttctattaattaaatatacagttatacctttttctttaaagaacatcacggctacatatataatacatttaggtgtcattattcagggaaaatattgctagtttgaataaattataaacttttataaccctggcaaaagatcattgtagaaggagacagtcatgctactgttaggaactctataaaaaaaaaaaaaactcttcaaccagttcctgcaaataaataagtattaatagaactttggggaagcagaatatatactcatttcattcgtgtgaattatctcagtccatatggttgaaatttacatctctcataaatatgtcacatttacacatttacaagaattagatcattttttctttataatctagttatccaaatccatgagaaactgtgctgcatcattcaaatatgttttataaaataacatgtaatggaacgcaatttgaagtcatactacaccagacactgagaaaagcaaaatttaaatgtaaatgtaataatctataatacagaagaacaaagtttcctgtgataaaagcacactgatctcattgggatttaccacatgggtggcagcataggaaagacacttagctgactgttatgtcaactttgactacagatacgattatggaaattttaaagatcctccaattaagaagaaaaccactggaggatatgtaagcaaaaaagcaataaacaatgaaggaaaatactcttggcttaggccaagttttaatgtcacaaggaactaaggacactgccactcacagttttaatggtggtatcttatctcctgggaagctacaagctaacaccattaagatattatgtcaaaatataaaatagcaatcagacaaatgctatctgagagatcaagggacttcttttttccttaaagaaactgtaataaggggttgtaatgataactaaaatttagatttaagtttgaagttgacaaatgattaagatttatggctgtagggagatgacagggagactctgtggcagtgtaaaaacctgagcaaaagtttggaatttggcaaggtgtagtatgctgctgagcgaattctttaaaaaccaaccaaacaacaaacaaacaaacaaacaaactgaaaacctactttgcagtgtttgccaattcttatgctgtagtcccactatgacagataataagctaaccacatgatgtcaaggaacacagaacttggaaaagaagcagatagttctcaggccagccaggataggtcggccacagaaaaacacagctttgtggagcaaaaagctttacactcatgttgggtacactaccaggtggaattgcaccatttagttacgacgaggtaagaagcatataggaagccctgttgaaggtttgtactttattctcattgagtcaccaaagtagtttggctgataaaagaaatgttaggatgaagatggatgttaggagagagtgagtcaggagtagaaagtaggatgatggtatgctttggctgtgtcctcaccgaaaatttcaccttgaattgtaacctaaattctaatcccctaatccccatgagttggggaggcacattgtgggaggtgattagatcatgggggtgggtcctccatgctgttcttgtgacagtgggtgagttctcatgagatatgatggctttataagggtctttcacccttcactctgtacttctcgctcctgctgtcctgtgaaaacgtgccttccatcataactgcatggttcctgaggcctccgcagccatgcagaactgtgagtgaattaacctcttttctttataaattacccagtctcaggtatttcttcatagtagcatgataacggactaatacagatgacaactgacattttagacatgggggcccattgaacaaacttgaagccagtctgtttgagaagggaaataaataactaaaataacatagtaaaggcagaaatggaagtaaggccaagacacttgaaatgaagagtatgacttgagatctacatgatctattaaaaattaaataaataaagagaacaaagacacagtaactttgattttttttctgagagtgagaatgtaatggaaataatggtagaaataaggaagaagaaagaatatatttaggatgcccaatggcactctcttaagtgagatcaattaattgagaacagtctgtggaaagcagatgggatacaggtttaggttttgaggccaccactgttttgacaacataaagatgaaaagtaattaataagaaaaaaatgaaaatggacataataaacttcaggaacatgaagagaaaatgagcattttagaaaaaataatgggcatctagagtaggaactagtcatcatatgaatttctctaggacagaggaataattcaaatacgattaatcccaaatctaacatctattagcacaaataccttgagcaagtcacttttcctacctgaagtccagattccccacctataatatgaatctttaataaaatgcctacttatgaagattaaatttgctaaagtagtgcctggcttacagtaagtggacaatacatactagcttgtggggtggtggtagtagtagcagtcatcgccgtcatatgccattatgaatacaataaacaccaagcagatctcataagactctaacattttacaaaaaaaggaaaaaaaaataggcaaatatgcaataactagcgaaggataaaataaaagcatactgaaggaaataatataatgttacatgatgacttgcagtggagcctgtaaattggcatgcttacaatcctagattaaaagccagacttgtgtttgggtcataacatttactatctctggaaccttttgcaaattaaaactctatttctttaccttttaaatgagtgttaataattattacattagtgcttgttgtgagagttaaatggtataatccaagtgaagtttttagcaaattttctggcatctcattaagacctcaataaatgttaggtatgcttttaattttgtactcaaaagataaatttttcttaggaaagtcaaaacctaagagttgaagtatgctcttttctaaagtcattggaacagtaaaatagtatttttggaaaatgtaaaaatagcagtgttgcaggtaaaggaattctcatcttgctctgaaatatgacaacggcacttgggagagggcactaacttacaatcaccttatctgagaagactgacagtgttgaaagagttcttaaaatatacacattaaatggtcaaggagtgtttgtaatttttaataaaaaagataaaaaggaggcaacagggctagaaggacataaacattggcatcaaatctttgaatcctacaacgagaggtgatgaaaataggcagaaatccatgaagactgaaaaacaggatgaaaacaattttggatatttgggggatataataacaagttgcattagtctgttttcacgctggtgataatgcatacccaagaatgggcaatttacaaaagagaggtttgatggacatacagttctatatggctggggaagcctcacaatcatggtggaaggcaaggaggacctagccacgtcttatatggatagcagcaggcaaagtcagcctgtgcagagaaacacccatttttaaaaccatcagatcttgagagacttattcactatcacaagaacagcgcaggaaagaactgcctccatggttcaattacctcccactggcttcctcccacatgtgagaattgtgggagctgcaattcaagatgaggttttggtagggacacagccaaaccatatcatttcgctcctggacccacccaaatctcatgtcctcacatttcaaaaccaaccatgccttcccaacagtcccccaaagtcttaacttatttcagcattaactcgaaattccaccttccgaactcttatctgagacaaaacaagtatcttcctcttatgaacctgtataataaaatacaagctagttacttcctagacaaatgcaggcacaagaattgggtaaatacagccattcaaaaatgggagaaattggtcaaaacaaagggtctactggccctatgtaagtatagaatccagtggggcagtcaaatcttaaagctccaaaatcatttcctttgactttgtgtctcacatccaggtcatgctgatgcaagaggtgagctccaacagtcttgggcaggtgtacccctgtgactttgaagaatacagcttccctcctggatgctttcatgggctgctgttaactgtctgcagcttttccaggtgcatgatgcaaggtgtcagtggatctaccattctggagtctgaaggatggtagccttcttctcacagctcaactagggcggtgccccagtagggactctgtgggggagctctgaccccacatttccctcctgcactgccctagcaaaggttctccatgaggaccgccacccatagcaaacttctatctggacatctaggaatttctatacttcctctgaaatctaggcaaaggttcccaaacccaaattattgacttctacacattcgcaggctcaacaccacatggaagctgccaaggcttgaggcttacatcctctgatgacacagcctgagctttatgttgcccctttcagccacagttggagcagctgggatgcagggcaccaagtctctaggctgtacacagcatggggacccttggcccggccctcaaaactacttttattctcctagacctccaggcctgtgatgggaggggttgctgtgaagacctctgacatgccctggaggcattttccccatggtcttggggattaacttttggcttcttgttacttatacaaatttctgcagttggcttgattttctccttggaaaatgggattttcttttctatcacattgtcagactgcaaagttcatgaacttttatgctttgcttgccttataaaactgaaagctttacagcacccaagacacctcttgaatgctttgctgcttagaaatttattcctccagataccccaaatcatctctctcaagttcaaagttccacaactctctagggcaggggcaaaatgccatcagtctttttgctaaaacgtaacaagaatcacctttggtccagttatgaacaagtttctcatctccatccgagaccacctcagccaggatttcattgtccatatcatcagcactttggtcaaagctattcaacaagtctctagagaattccaaaacttcccacattttcctgtctccttctgagtcctccaaactgttctaaactctgcctgttatccagttccaaagtcgcttccacatcttttggtatcttttcaggagtaccccactcctggtaccaatctattgtattagttcattttcacactgctgataaagacatacctgagcctgggcaatttacaaaagaaagaagtttaatagacttaccgtcccaagtggctggggaagcctcacaatcatagcagaaggcaaggaggagcacatcacgtcttacatgcatggcagcaggcaaagagagagcttgtgcaggggaactcctctttttaaaaccatcagatctcataagacttatgtgctatgatgagaacggcacaggaaacacttacccccatgattcaattaccttctaccaggttcctcccacaacatgtgggaattgtgggaactaccgttcaacatgaggtttgggtgaggacagagctaaatcatatcagaagtcataaacttgctattgactttatgtggtccaagcatgacttttctcgtataacatgtaatattatatattattacttatcacatgttattacttacatactaacatgcaatattaaatgttattacacattacatgttatttcttacatagtaataacatgtaatattgctttcaggagcagaatgagctgacattgtaagagtcagctcaacatgtattattttcatttaagtggaaactttcataaaagcatctccaaaaccattgccctgccctggagtctgctcaccagcccccttgtagcactgtacctctgcaaaagggagctgggaagtcccacgatgcaccatttcctgggctgacgatgcaggtcaggatggcgtggccttccaagatgtagccagggaggcagctgtaccggattttgtctcctatgttgaatctcgttccatgcagaactcctttcaggatttctccaggatttccacaagtgtggctaggtaaaactattggaaaaagaaaagaaaggagaaaaaacaagttaaattttccatggagagccacttataagataaaacagacaccatttttgaattattaaaatgagaaaacctctagcatcagaaaaatattaattgttgctaaaaaataaactgagaaaatgtcttcaggttttagaatatctgcagtataacacttttataaacatcataaagtgtaaataaatgcattttgttaagagagaaaaatatagtcctgcttttattcagtgttccagataatgtctggattatatttttctagtcacaaaattctacttactcctatagtgagcaaccagatgtcagtgtcagcaaccagacacagtagactatagaaatctaaaacagtggcataagaaatactgcaagagtgaatactcataccctatttatttttatgcttccacgactggtacagtgtctgttacacatcattacccaacgctcaatcaacatttgatggataagcaattgaattaaataataaattagaaatctcatgcattgatccatcaatgtataaaaaaatgttccactactgtattccaggccagcagccaggctctgtccatttatagtgtctgattcaaaagcaagtttcagtgctaagttttgacaacagaaatactgaattcactttcattttgtaaaaaaataataaaattcaaaggccgtcaaccatctgaatggacacatcctctcagccagggtgattccaaagttaatctgaaaaactaggtcaggccgtggtgggatggggcagtcagacatgcctcattatactctcttccctgttggaattactgatagaacaggctcctcaattccgatacgaaacactgacaatctgtttgcggaagcctgctacctggaggctttgtatgcatgataaaaacattggtctcttcaatactttcttctaacccagacattcctctctattgattccatgtctttagacaataacttaactcttgcaattaatttccaatatgaaaaaaaaaaaaaaaaaaaaaaaaacctggccaggcacggtagctcacgcctgtagtcccagcactttgggaggccgaggcaggaggatcgtgaggtcaagagatcgagaccatcctggctaacacggtgaaaccctgtctctactaaaaatacaaaaaaaattagccgggcgtggtggcgggcacctgtagtcccagctacttgggaggctgaggcaggagaatggcgtgaacccgggaggcggagcttgcggtgagccgagatcgcaccactgcactccagcgtgggtgacagagcgagactccgcctcaaaaaaacaaaacaacaacaataaaaaaacctttgattctacctatgacctggaagctcccacttccagttgtcccgcctttccagaccaaaccaatgtatatctgaagtgtattgattgatgtcttatgtctccctacaatgtgtaaaactaagttgtggctcaatcctcttgggcacttgttctcaggacctcctgagggctgcgtcatgggccactgatgactcgtatttggctcagaataaatctcttcaaatattttacacagtttgactcttttcattgacaatttcaataatggggtattgattctgttctttttggtcctctcactttttccttgatatgattctctatctaaatcaattgacttgaaactccattccacacttatagaacatgattttgaactgaaacggtacatcattcagttgaatggatgaaattcatcattgttggctattgtatccatatctaaggtttaaatttagtatgtcatcagtaaattagctgctatttagtattcaagtaagctatgaaacttactagtagagaaatacaaacacttccaaataaaaatgtatttccaattgaacagaaactatttcatgtctgtatccattgtctttgcatcggcatgggggtgtattttaatgtattgatataatgtagaataatattttctgttttattagtttttaaactgagtaacatagagaacatttttagaatacggaataggaatcatctatttctaaaagtatttttatttatcatgatattacttaagtacaaacagaactatatagaaatatttaggaaataaatactagtgtttagatattgaatattattgacatgtttatgagatctctatttacatagtcaaagtgtattcagttctagtttttaagaagtaatttctgagagcagtctacagaaatctgtttgaaaacacaacagaaaatagttcactattgtctgcaatcatttttgtcttttttaataagaaaattctgtatttaattccacattcactatccttaaagcaaacatgtgtgctgtttatagtacattaaaagtgacatttataaggaagaaaaactttccattttatcagggcagcccttcaacttttgactcagaatgccttgtccatcagctgagccgagagctcttacagtcaaagacacacgttgtatagccaccgtaaatgtgaagagtgagaaagggagtgattaaaaaaagtaaacatgtggacaaaagctttttgatgtttttctttaatgtccaggaatatttaaaataaatcaacatgtcttcttagggtcattattattaactgctactgctaattcttcttagaaggcacacattttccaacagaaggtgtccagataattgttccccaaagacacggttatcaatggaaatctatcaaataaatctgctaaagataaccacaatgaccagtcattgtcacacacggaaaatgcaaatgaaacactctggaaatggaacttagtctgcgcgactcttctatacgttttttctgttaaaagggcctgaaattatttttttcaattaactttggtatgaataatgcaaatgattatcgtgcagaaagatcaacgaaacattctacagtaatatatagttgtgagctgcctaacaacagctcaatgatacgactcatatacaacatcggtcccaggagatgatggcgtactgatgttgtagccgtcatgaggtcgtagtgccagctatgatgcacgtgtctgtggtgacgccggtgtgaacaaaccacctgtgcagccagtcatacaaatcttcagcacatacaattaggttcactgcatatgcttgatgataatagtgaacaactgtcactggtttttctacttactatactatactttttatcattatttcagagtgtgcttcttctactaaaaaaaaattacgattttactgtaaaacaaccttagtcaggtccttcaggaaggattccaaaaggaggcattattatcctaggagatgaaagctccatacctgtccttgccccgaagaccttctggtgggacaagacgtcaaggtggaagagatgaccccgtgcaggcctaggctagggtgtgtgtttgagtcttaatttttaatgaatacagtttaaaaagtaagaacatataaagaaattttaaatagacaaactcttatgaataacaatataaatgttttgcacaactgtgcaaggtttatgttttcagttaaatattattacggaagagtcaaatgcttaaaaatgaaaaagaagtttatgaagtaacgttatactaagcttaatttatgattaaaaaagaaaaatgtgtttttatacatttagtgtactctaagtgtacagtgtttatgaagtctacagtcgtacatagtcccgtccgaagccttcacagtcacccctcactcacacacagactcacccagagcaacttccagccccacaaactctattcacggtaagtgtcctatgagagtgtaacacttttttttatttttaatgctgttttattactgtaccttttctatgtttagagacacatatactgaccattatgttatagttgcctacagtattcagttcagccacatgctgtacaggtttgcactctaggagtactaggctacaccacacatcctaggtgcgtagtaggccgcaaaacttgggtttgtgtaagtgtgctctgtgatgtttgcacagggacaaaatcacctaaggatgcatttctcagaatgcatcccagttgttaagtcatgcatgactgcatgtaacatatctcaagatgctgttgttatggtcaagcctcccactttatcatctacagtatatttagtaaatttaaagagggacccctccaaaattgttaccatggtactgcgcaatggtattttccagcagtgtagaaatgtattgacttacatatttctgaaggaaaaatatcattaatgaatatgagtctccccaagaaggtgtctgaaaagaaatatttgtaaacacccatctcttcaaacttccaagagacagctactaccataaaattgaatatgaaaaatatttattctgttcaatttcatcaatttaggaaaggtatttttaatagggaaaaattaaggcagatgttagaagcagcggatgtcaaagaaaaaactagacatcaatggagagcatgcctgttcttttcatgaaattgcatttctcattgtatctgacgtaaaggatccttttgcagatgcagttgcaggcttttattttacaccaggtcctcaaatagcactgttggcagcaccactatttcattataacatggatgagaaaaataaatagattcctgaccagggccaccacctgttcttaccatctctgcatgaggtatgtccagtttcctccatatcccaaagatgaccatgtttgcatgttaggctcattggcatgtgccctggatcctagtatgggtgagtgtggggtgtgtgtgtgtgtgtgtgtgtgtgtgtgtgtgtgtgtgtgatcctgccatggtagtgtgtcctgtccagggctggtgaccacctggcacccggagctgctgagacagctctggccacccacaacccaaaactggaataattggataaattattttacttgtttttattaatctttcttaagtgaatgtagagctcacatgtgtgtcagtgttcaatattagaagtgttttgatctttaatatttagaattttgtagatgttttctatgacaagtaatatgacataggaactttacttttgtttatatcaattaacctgtgggaaaattggtcttgtcttacattgttttgcttagagccacattttcccagaacctaccaagcacttgaagtgagcacttgctgtaacagcaatggccatcagctccacgcaacagcccagtggcattatagagaataaagaggatgtctatttctggggcatcttagaccatttcaatggtttgcttttttgtcttctctacagatttttttctttaccttaacatcttgacacttaattttagaagaatttgaaaaacacaaatcagacatagcctttgcaaggtgccgtttttcaactgacagggattgcaatggaaaggagaatggactttaggtctcttatatttatcaggtgtgcttatctactgaaaatgttttcccatcagtattgattttaaaggggaaggtgtgaagattgaatgagataacaggtctccaaatatctgttctttatgactctatcagattttactgcaaacagccgttaatagttctgagggccttgaaccattccaggttggaattgaatctttttatgtttgtatataaatattaatatattataaagtagatcatatattctcgtatacatacgtacaataactgaaattcacgtagctcataagcttagtgggaataggaaaaaaagtttttcaaaattcagttggacaaaatgttattttagaaacaatgaatcaaaaaataatgtataattttagtcactttattcccacacttggtaaaaagtgtaaataagtatcagaggcttaaaattaattcaaaaagtttggaagtaaaataactcagcaaatgggaaaaaatgattagatctaccatttaaggtttaaagtcactgattggtgacacaaagttataaatttatgatttagggattggggatttttatcttcaacaaattttctttttaaaaagtttttgtaaaaattttaatgggaacaatgtgaataaatagaaataattaagaataaattagaatattttcttctagtttcaaacaccaaaaaacgcaaaacagacatagtattataaatccattagcaattttactaaaaaatcaaaaaaacttgtaaattgtaaaatattgatggaattgttgctaggtctatgcaaagattcaagacacacacagacacaaatattaccaaaatatggtaatttagtgttcgagaaaaactaatttgaaagcaaattatttcaacccaatgtcatttctgccaatttcattttaactgaattttaaccagtttgcctgaagattatgcatgtctctttgtgactcccagaagtaatgaatacacatgaagaatttagtaaatacctactgagttgacataaactctacttttaattctctttatttatttcctgagccatttacactccttcccatagatgcttcaagaaagcaatacttatttaggtgatgggaattctgcgcccaatgcagacatttggtaacgtgaaaggatttcttgaaagagctctgggcacagttgttttctctcatggcaggtttccactggaccccatgaagccaaatttgtacatcagggcttgaaacttgaaacataggctgccattctaaatatgcacacgaaaattccctccgtaacacttaatttggcaagtacatatggtcacaattcagtgacttaattgggctatcacatcaaacctttaacccagctgtttcaatggttaagtggatgtcatattaagtatctttccaaaagaaaagtgaaagcatgatactacaatacaatattaatattcattactacatgggacaaggctatcgaaaggaagtttaaaattcatcaaagcaacggcagcattttcaacagcatgtgtacaatcagtggaatttcatgaggtggattcatctggaatctaggtcccttagggtttctctccatttctctacactttgcctctgtagtagtctcctggtagcttaagaaaatataactccaaattccttcatgatgtgtactttctatgtaaaccaacgatatcaaatgtgtttgttttggactatttgctgctgaaagctcttcaccccactctctctcctggctttgggaaggattagaaaaatctggttatataattttcaggatcacattaaaaaatcggatttcctagtcttgaaaccttacatttcttctctttactggctctctgaatgcgagccaatctgtaaaaggagaaggtgctgacaaagcatttatgacaaaagcaatgaggacctcccaggaggtggcagtcattgaatgccttctactttcaaaaagtctcattctccaggatgaggaatgacagtgaaagagaaggacctcatgggacgtaatcagaactggctgagaataactcaatgaggaagtgagctgtaaatatacttgaaggtggaaaagggcaagatttggccaaataagaaagataaattgatgtgggggaagtcgttgtggcaagcatttatagaaaagtatatggcacagggagttacagtcatcagatctggcatcaaatagatttgggtttctgctccagaaagtgattttgtaatgttggacaaattacttagatcttagtttctacatcttagaaaggggaatgaaaagtaaagcttactcttgggtttattatagagaattgtaaaaagatatcacaaatcagggcactcggtacaggttaagtgccccatacatgtcaggactgttaaaattattttcccaattctaaagcaccatgcaaatgttagggaaataatacaattttcaaagtatacagagattttaacatatcgcaatttcagaaacaatatttttaaagggtatgagagtcaaggctattaatgaaatgctagcatagttgtaatggaagtgaaggagaaggacatcgtagtttttcatttagcaatagtaattccacttcattatttctgccttatcataataaccggaaatacttgcacaacacacactatgtgctagacactgttccaagtcgtttatatatattgagtatgtatcagtaagtactattattatgcccattttaaacaaacaaacacacaaacaaaaacatgctgcagggagatcaagtaatttccaggacaggtaactgttaagaactggtagtagagcttgcatatgatgatggattcagaatctctacttgcaagcatgacaaaaactctttcatatgaaaatgtggctaacatcagaagaggtgatgataaagtgtgattagatctacggtgttcacaatggaggttagttataataacatgcatatatggattggggagacttacgatgttttcttaggtagaatggagggcacaaccataacatagttttaaaaaacatgtttcaagctctcgaggcaaattcatataatagcaaaaacactgcaggagagactgcagcaaagtcaaaaacaaggtaagcgaccagttggcaaatggatttgaaacctagagactagattttcaaaagatttttaatagcacgtgaaagactttagcagctccggacaatcgaaaaaataaaaatgctgttgcaagataatgttcactatgtaaatggctcttgagaagcatcatgaatatttgctagtgtgaattattaaataatcttatggtcttacattttgacttcactagtgaatcctcacgtggtcctatattttcttttctttctttttttttttcctttttttttttttttttgagacggagtctcgctctgtcgcccaggctggagtgcagtggcgcgatctcggctcactgcaagctccgcctcccgggttcccgccattctcctgcctcagcctcccgagtagctgggactacaggcgcccgccaccacgcccggctaatttttttgtatttttggtagagacggggtttcaccgtgttagccaggatggtcacgatctcctgacctcgtgatccgcccgcctcggcctcccaaagtacggggattacatgcgtgagccaccgcgcctggccgggcctttgccattttaaacactagaagaattaatccatatataaattttcgcaaaactatgacaagaattgttaaatgcaaatcaagcttactactacgaaaaaagcaacttctttcgtgcctcaacctacatccagccttaaaaagtagtgtaaggatcaaactgttccacaaatagtcaaccaaaccccagtgaaagaatgttcaagaatatttatgggaatacaaaaatattcagcacctgtcaaagtgagattcacagtctctggcatccaatcaaaaagtaataagcacgcaaaaaagtaagaagatatccataagaagaagaaaactcaatcaatgaaaagtgagccagaaataaaacagaattttcaatcagtgaacaccaacattaaaactgttattagaactgtatgccctgttctcagtcaggtgatgatggaacatgttgtcttgagacatgggaaatattaaaaaacaaacaaacatacccacaaaaaaacaaaacaaacccagattgaacatctagagttaaaaccatctgagattcaaaaatcaatggatgttataaggtagaatagatatagcagaaggtaacattaatgaacatgtagagatagcaagataaagtatttaaaatgaaacataaaagaaaaaagaaagatttccaagcaaaaacaaagcaaaactaagagcacagagaatcaatgaactttgggacatctccaagcagacacaagtatgtaattaaactcactgaaggcagggaacacaaagagggacagaaaaaaagaagaaaaggaaacaaattacctaaaaacttcaaaatttactaaaacagtgaactcataaatacaaaaagttcagtaagtgtaaaatgcaaagaacatgaagagcaccatatcacacatgtcaaaatcaaggtgcctaaatacagcaatgaagaaaaaatctttaaagcatccctactagtgggggtaggagtaatgttctgtgtagagagacaaagataaaggggccaggtgatgcctcttcagaaagaatgaaaccaaggagagattcagcaacttataggaagtactgaaataacgaataagcaaaacaaccatcaatctaaataaatttatatgacaaaaatattttgcaatatcacagggtagagaaacaagttcagacatgtgaaaactgaaagcccgtcactagcaggcccataccacaaggaatattaaaatgagtcattccagcggaaggtaatagcatagtaaggaattccaagcaccaggaatgatacccgtatggggaattataaaatatattttattttaaaaatctgtttaaaacactattagctgtttaaagccaaataatatatattttaggtttctaacatatgtagaagtgacagaaatgacagcaataccacagaggctgggtaagaagaaaggagagcacattgctgtatcttcgctatacaataggtgaagtggtacaacatattaaaaaaaaaaaaaaaaaaaaaaaaaaagcaggctgggcacggtggctcatgcctataatcccagtactttgggaggctgaggtgggaagattatgagttcaggagttcaagaccagtctggccaagagagcaaaaacccacctctactaaatatgggaaaaaaaaaattagctgggtgtggtgacttgcacctgtagtcccagctacttgggaggttgaagcaggagaatcacttgaaccttggaggcacagggtgcagtgagcggaaattgcaccactgcacttccagcctgggtgagacagtgagactctgtctacaaaacaaaacaaaacaataaaaaaagcagcagtataacatcacagtagattatggtagactgctataaagtctaaagtcaccactaaaatagcaaagacaaatgttacagctattaggctagcataggagataaaacgaatcacagaaagtacccaatccaacaaaaggaaaacataaaaagaagaggaaaaaagaaaatgaatgagaaatacaaagcaaactgcaaggtggtaaaattaaatacagccacaccaataaacataggaagcgtaaatgacatgaacctcacacctgcaaggtgcacatcatgataatggatgaaaaatacacccagtgttatgttgtcttcaaaaaaaagtattttaaatacaaacagacaaatagataacagtaaaataatgagaaaagacaaatagctttatgtgtgctgctgtctggccgccttgagggggaaatcaatgtagaatagccaaactggaatttcaaaagacgaaatgcattttttaattctaggagtggtggttcctgggtgaaaccatacatttatttcagtgttctgaattacacattcaattaccttaaaataagatttattactaatagatactattgatatcttgctgagctctttcaaatgctggaacgctttatatatggtatttcaaaccttacacgtctccaaatgaggcatcattattccaatttcacatacaaaaatgatgagacacagagaggctaaggaactcagttaagataacacagataaacctgaatctgtatagacctatgatatttccaccacaccatattgtcccaattgtgttgatataattgaaatgcttttaaatgcaactgtaatgtcagaaagaaataattttggcaaagcttaattaaaaaaaaacgctgaataattaggagactggggttcctgtcttttcttgcccattgcttgtctctgtgatattatttgatatgatattttctggctcacatgttctcatcttaacagtaagaaagaagatgagagttggggtggactcattcattctaaaagttgagggatctgcacaataactgctgtttcaaatacaaataacttattttctcatacttccttattgcaaattaaaaaatataaaaatggcaaaggaaaaacagagaaatcatctctgaaaattgatgcaacacttaaaaataacacaatgcaattctgtttagtatttactgataagaaccttgtcttaataagctaaaggcaatctcagtctactttgtgtcattccaagctctaaaattctttaccataaaagctgcttaactcgatttaactggagggtcacatctcaggggaccagcgacccctccagagggaggaaggacagtcaggaggagcaggacacttcattccatctgtgattctaccacggcagagctcggtcaccggaaggataattaaatccgggtctcattttcttctctcgtgcaataagaagagacatagcgcaccctgtacgtgtaccaccctgggcgtgtaccaccctggccacctacaatcctggctgcgtacaaccctggatgcatagcaccctggacacgtaccaccctgggcatgtaccaccctggccacatagcaccctagccgtgtagcaccctgagggtgtaccaccctggatgtgaaccatcctcgatgagtagcaccccaggcttgtaccatgctggggactgcaccatcctgaactttgcagccctcaggcccagactgacttctcccacaaaaagttaaatttaaaaaaatgtccccatggcatctgagagtaattatattcaacatcttgttcacggaggagtttctacttcctgttttataattacaatgttatgcctgaatcttccagttttacaaagctgatttacaggaaagccttgtgcctgaggtatggtgtggaggccacagacggggcacagggagacactgaacatggcagtcaccacctgtgccctcccacctgcagcggccacgcagtcgtgggctggggtaccgggtgctgaggtactcatctctgaggaacccacaatgtgggcgacagttgtcccattaatgagcttaggagcagaagtgagacaaagcctctcatttctccccacatatactacaggaattctgtccttatagggttaggcaggtaaaaggaccatcaattgtgtatgatatgagcagacgaacggtttcaaggacactgtcatttaaaacagtgctacattaccgatcatcaatgacaagtggccacagcagtagaaatgactgctgagaacgtcggaagggccactggtgctggggtcagaacactgtccccagttgggggaagaccagatccagggacatcatggggccctgtgggcagcagatgctgttacagctcagaaagaggatgtgcaatgctttagaatgaaagaaactcaagaatgttcctgctattagctgcaacatagaaaaggggaaattagcttgacaagatggattgtagtagaaataattttaagtagagaacctaagagtcaaagcagtaaccataagattcaaagactaaaataaaacgtgtgaacaccagtgaactgtgaaacacaaagactaaattacacactttaaagctatttccagacattgtgagacatggcttctcagcatcttcatcatcccctttttctttcagactctggcactgcattattttttttttaattagagtttttatgtctatgctggtgaacacacacaggtattacatattttctggaaaaatacatctaagtcattcaaatcaaagtatattagattcctgtgaagtggatataattcaaaataatggttctacaattgtattcaaatataaaatttaggactcatgcagattagattttaaaatcagttctcccaatttatatacacacattatataacatataataatgtattctatagctcatatatatctgatatatatgtattatgtatcataaatttatatacacacacaatttatatgtgtatgtgtgcgtgtgtgtgtagaaaataataaaagcattttaacaatataaaggtcatgtggcattatcttttatttctaattattgaattcttggctgtttctcagtctaacttcagttatttctcttctttgtcctggaagttagcttctaaaaatagactcaatgttatcattataaacactttaatttacttggcattagtatattacaaatccatgattttcatattcattcaaacctaaatgtgctttctgttactgaattcacataaacagctcaagcttcatgaaaagagtctttcggaaaggataaagcatgttttgtggttgctgttgccttacacgtcatgtattcaactctgtacatagtataactgtgggcttccaggtatttttctttaatttctgaagacctactgttgattgttgagtcttgataattccatcataacaaacaacaagtgtgcagataggatatacactgggaatgtttatttccatttgattttaaaaggatgtagatattatttaaatgacctaatgatttaaactttttttctgtttcccccataacacacacacatattgtaattaatgcacagcctggggagcaagtgaactaacaattattgaactctaagcgccaggcacttcatgtattatttccctgaattcttccaggagccccacagagaatgtgacaatgaggccatctaaaaatgggcagagagaggcttatggccaagagggaacttgagtcctaactccacctttgtctcagatctcatgctcttttctttccagaaccctccctgatgcatgacttagccctatagggttgtgacatagagggaacacctggagtccaaatgaatacagaattaaatgtggtctttaaaaatggtctctatggcattgaagctgtggcttcaatggaagctgtggaagaagcagagcagcctgcaacggttccgtgagcctgacctatctgacctgtgctgggccagatgctctgtagtaactcatgtgtatttcagtctgactctagtgttcatcaaagtcatctaagtggtaggcacatgtattctggagtgggaggaagggaggaaggagagagacataaagtggaatattctgaaaacaaaatgatcttctacccaaagcccttgggaacggtcctgctcatggaataggaacaatcttggaaactcaggaaatattgcggaaaaaataaattgaaattaaaatggcatttttcccagggaattcttaagaatcattatagctaactcagattagtggtagcgtaaatgcagggaaggcaacattgtgatatgtcattcattcattcattcattcattccacaaatatttatagaatgcaaattatgttgaatatttactgaatgcgtattatgtgtggaatatttttccaggcactaggaatgcaatatcgccctcagtgagtatatttggggcatgcagagagaagaaacaccattaaaaaaataaaatttgtaatagctcagtggattttaaatgctatggagaaaaataaatcaagagaaaatggtatttttttgataggaataggtagagaatgcaattttacattaggtagtcaggaaacacctcaataagaaagtggcattgaaaaaaaatatgaagtagaggatcagatctaataataatatttacatcactgagcctttagtttgattttatgtagtattataaaaattaggattgttttcccaaaaatataatgtcatgttgagtccttaggccttgtttcttttcatcctgagagctttaagtctttgtatgagagatcaaaccgttttgcccactaaaatgacatgtagaattcattcttttccaaatattttgtgcattcctaattgataagtatctcagggtagaccccgactgatttctaaacatacttgcctaaggtgaaaagaatgaatgtacgcagtcagactttgttttggttgttggtgctgtatggatgttttcatattgaataacataccgttctttgttattagtcactgagattagaatgaaaagtgatacctacacatttttacactaattatgagcataagattgagctggttacacaaagaggggagtctttcatttattcaataacttattttaaccatattcttaataacaacagctaacacagacaatgcttcctagacaaaccactgtgtacatatttcaatttatgaacatgaactctcctattttcccaacaagattctgcagtagctactattatccccattttaaagatgaacaaactgaggcagaaaagttaaggaacatccctcaggtttataaaccaagtaaaagggagagccaggatttgacctgaggtggtgtggctccagagtttgtatacaaacagcacacaccaaacaggtaattcttaaataatttttgggtgtcaatctgacttccaaccacagaggaaagtgtgattggatcaatgtgcttcctgacacatttgggtgcatttattaatacatacatgtatatctatagaactatataaaatgcaaagctgtgtatatctgtgttacatgaatgttattatacagtatatgtagtcacaagctttattcactcaatagtacaccttagaagcctgtgttcaatacagatagatcaagctcatttttacagctgctacatacaaaaatagtctatttgctaatttttccaatttcaaatgctgcaaatatttctactataaatctatcgtataaatgtgtgtgaatttctctaaggttgatacaaagaggtgatgttaatgatcaccttttcaagactcaccacccatctcaacaactctcaaaacagtcctttcatggttaggaattgcctccatttttttctatcctgctctctccacattcttttatttttacagctattctttcttattcttctgttgaactttaattgtaacatcaaagagtctatcttaggtgttgcgtctttctctatctattctgataccatatgtagacttctcaaccttgacatcactggcattttgtatgaaataattatttgctgtggagattgtctggctgtaggacattttgcaacatctctggcctctatctactagatgccatagcactccaagctcctagagttctaacaatcaaaaatctctgcagacattgccaaacgtcatctgcggagaaaaattacccccagctcaaaaaactactgcctacgagatgtcacccagtccctggcattcaaataccatgcatatttgaatcccctttttgaataagattggaatctacactttggtctctagggccaacctcttacctgacttctagatttttatacccaactactacctgctctgtcttttttatttagggtttaatatttcattgctctgtaagttgcataaaataacattatatttactaatcgacaagcataggtatagatatttttatgaattcttaataaattttcaaatttagactactttaaaaatttgttttaaagtttaaaaatagtagagaatctccataaatggccacagcccgttttccttactgttagcatcttagctttgtatggacatttcttacaatcagtgaccaatattggcatattcttcttcactaaagtcttattgaattatcttagcttttaagtaacgttcgctttctgtttcaggaatccattcggataccacactgcgtttacgtgccgttcctctttaggtgtctcctggctggggcagcttctcggacctcccttgttttaagggccttgatggttttcagaagttgcggccagatattctgtggaatgtccctcctgtggaacttgtctggtgttttctcacagtgcaccaggttgtgggttgttgggaagatcacagaggtaaagaacacttctcgtcgcagcatgccagggacacgcatcatcagtgggacttccactctggatgttgacttgatcacttggctagggtcgtgtttgtcagtttctccactataaacttctgtatttttacttccttgcagcctatactctttggaagggaggaactatgagcagcagaacttaaggaatacgaaaggaggctagttatacacagagcacccactaaagtaattaatcaagagcagagaatctacaaacttttttaatttttaatttttaaaattttatttaatttttgttttttgcatatatacatacttatggggtacatattttgatacaggcatacgatgaattttaattgcatcagggtaaatgggggtatgtatcatcctggaggggtaaatctttaagcatttattcttcatgttacaaacaatctaatcatactactttatttcaaaatatacaattaaattattgcttacaagagtcatcctgcggtgctatcaaatactagatcttattcgttctctttttttggacccattacacatccccacttccatccaagccccaacctcaaaaactatttagtgagtaaatgaattaagtcactaaactataaatgccctaattgaccaagtgtataaaattcagagtccctgaaacggtgaatttaccatctttatctcaagtgccaatttttaaaattttagagaagattctggatctgaaagggcacttctaatactcccagattaaaaataagcctacctttacgtgagtcttgaagtgacctatattcccatccatgataaggtctcacttggttggagaaaggctgcagatggaggaggagtgacatgccctacttttaaggaggaaggagccagaaaacccaccccaacatgatgcctgaaatcctctctggctttgttttgaagcgcactgccctgagttacagcatctttattgaaagggagaaccaggaaaaagaaaagaaaagaaaagaaaaaagaccaggagtagaaagcagaaatggcagcacaatccctgctgagaatctctgctgagagcacagcctcccagggaccaggcctgtgggaacaatgccaagcttcctggatttcttcaacagttttacaaagcctgcacaaaagctcatctaagttttgaagactcaaaaaaaaaaaaaagatatgtacaagtaaagccagactcggcagcttctttcactgttggcatgatcccggagggctgatccaacccagtagcataatgtagttaaatcagaccgcaaggttgaaaacgctttggcagaattcaaagcgccctacacgtataaattgaatgcaccattgttgttattctgtatttccatgacctagcacaaaatgcaacttcgaatcagcagagaaaagcaactccaacaatcaagcaaacctctgtcaacgtcctcagaagtgctaagtgcacagcggggcttgtaggtttctgtggggccctagaaaactatgataaaatggtgagcaggataaattttctgtactgatcaaggccaatttattttccaaaaatcaacagagaaggcaagcagggattaaagaaaggcaaagaaacaccactgctggttttggtagggctcccagtgtcccaggtgtgatggacaccatacaatactgacagttttcttctctttcttctctttcttttctttcttttcttttctctttctttctttccttcctcctttcttccttccttccttccttccttccttccttcctttctttctttttctttctttctttctttcttgacagagtttcactcttgttgcccaggctggagtgcaacagtgttatctcggctcactgcaacctctgtctccctgtcatatacaggttcaagggattatcctgcctcagcctcccaagtagccgggactaaatacccagctaatttctgtatttttaaaaatagagacagggtttcaccatgttggtcagggtggtctcgaactcctgacctgaagtgatccacccaccttggcctccgaaagtgctggggttacaggcatgagccaccgtgcccacccagtactgcaggatttctgagagggtgggagtccagacagggcacagcctgccatttggcaaaagattagagaagaacgctgacatttaatgcgtaattatcatatgcacaaggagtataatgataacactcacgtgtatgctattttcatataatataattggcaaagacctatttctccaagttccatattggagatcccaaatatcttgtagtgaggggtgattttgcccactgcaagatggataatctttacccagggtcagagtgcagtgggagatcagcatctccaaatttagtttgctagaacgtcaatgcaccaaatttgaggaagcaagctgagaaaatcacgaaattcttgcctttccctccatataatttaagtatttagaccagtatttcaacctaggcatctcctttggaaaagaattctgatagaaggaatcatcccataataagtaaggtgtatatatttgctattaatgttataaatatttagctcatcaccacatgataaaagaacaagttttaaaaaaaaatgggatatctgaggacacatcctggaacccacttccagatactctaactgtgcagatttggggcagggcctaggtaaacccctctccatctctcataccacaatgattccaatgcagtagtccatagaccacaatgccagacgtactgaactaggcgcagagagaagtggctaatgagggtctgagaggtataaatggacccagaacctgagggcccccttactctcagctaaagaagtggccttatactttagcaaagggtaacaattggtacctctaaccagaggagtccttgggaggctgtgtgctgaaaggatgattggaataagaaggggctgatacgaggaccccttgcccaggaagcttctccatgggtgcagtgtacagttagtgaaatctgaactacaggtgcaaatttgaagcctgaaaatataacacgttattaaaaagtcactaacaacagcaccgtgtgtttagaacttagactaccaagatttattcaaagaaaagtattttatcactgacagtgcttagcattgcgaatgcatgagaataataaaaatcagactgacctttagttagttttactattattctaaattctctacagacagtgtgtgcgctgactgcctctaccttggtgtgaatagctcccaccacctgctttttatcatggtctcggtggggaaccctactgaagttcaaggttttggccaacgcaatatattcttaaaacaccatcgcaatcaaaatatgaaacacttttgttatctcaagtggttttctctgaccttgcaagctggtcctcaatttccactcctgctcttagcaacctctgatctcctttctattactacagatttcatttgtcttgcatagagtgtcatatacatagaaacataccccaaaaatagcaggttaaaatcaaacagctcatcatggcagtaggaggaaaatgctccagaactggcttcttgaatttcctctggatatgatggcatttgggggcttagattagagaataaaccagtatgtttaaatgcctaaagctttacaaaaatgttcagtagcttttactagtaggttggtttatatattgactatacatgaaattagttgctataattatcataaataataattaagggaaaataaaaatgtatttacttaacacatatctgtgcattctttattaccgtgcattcaaaagtatataaggaagttaagaacctgagatgtaattgttttccccaacatggccacagctttgcttaggaagttcactgagagccaaatgctactcctatctctctctgtcgcagttcactacaccagctgctaatggtctctaagcagccattctccacttttttctatgtaagtacagaactcctcattaccaccatcaagatttcacagaacgcacggccatgagaagaaatgatttggcgccacctctcttgtagctgaacatggacaaatgacgactttgagagttaagaggtgacggggaagtgaagatgtggcttccacttcacattctctcctctcctctggggagctggggtaggaatgtgtggtttgatctatctctgttgccttcatcccatataggggatggccgcccgagccatctaccctagctaggcacccatcatacccctaaactcttgtatgggagagaagcaaacttcttcttagcaagaacgactgcattttggaagcttttgtcatgtcggtttcgtctacaccctacctcatccaattatcaaacatgcctgagatgtccctcttgcggagttcaaccctcttggtggtgtagtctaattgtggaggtgtatttagcttatttccccatcggactgtaaaacacataggtaatgaacaggtccttgcacagtgtctcataggacattagctgaatacatgtgaattcctgagggtgcccagaggaaaataaacatttggacattttgtgatgtgtcattctctgggggttgatgatgacatctaccttcaagtggacgaacaacaatggaaacagaagctccttccccatctatctagccacagcagcccactgtttggagagaatgtattgaaatgttctgtgacatacaaaggctacgtctgcctgtgccctgagctctggggtttctcttttaaatcaataaagtacaaagagacatcaaaagttttcacttacactgcttttaacagcatacaaagaatgtcatataaatgtgtgtgaagaaggcgcctatttcacaaacttacatgaatatactatattcaaacaatcagagagaatactcatgagattattagtaacacattttctttgagctttgtgtagtagatgatagaaatatggcctacttcagaaactgtttgaaatatgaatttctcatacgcagtcaagttaaaacttcaattttcttattcaatttttaaaaaccattttgagacaataggattacttgcctcaaatgaattcaggttaaacaatttttgtattattgtttttctctagaaagattccaatgtctccttctctaataaatttttatagattacaaaaatatcctttttataattattgtaaatttcacaaacttactaagtgattaatccaatacatattttaaactcactaaacattccaaaatcagatcagcattttgaagagaaaaatttaataaattatatgaaatacatatgtaaagcatttcatataaataagagtcaaaatcagctcaaatttaataatgtcaagaattttaatgaatatcatataaagaagaagagtcaaaatcagctaagatttaataacgttaagaattttaatgaatataaaatattaatggaaaatattaaaacagaaactgtttaatgtaattataaatgccaccaaagtaacaatatactttgaaaaatcaccatgtattaattacaaataaaaacttgctgtcatccacaacagaatgacttgactagatactgtataaacaaacaagactcttcagcacttcaaatgactaacactgaagcagaagtgttgattttacagttgattttcttttttactatgccagcttatttaaacataccaaaatagcacttacatacaaatgatgagtcattagtatttaagcttttaaacaaaaatatgtaaattacacttaaaatgaaacacaccctacctgagttttcccctactagaaggctctgttatggaaaattgtagtctacacagatttcctcctgggaaaattgaactcaaccctgaatctctgtttggatattggtggcttcctttttttttttttttttttttgagacagagtctcactttgtcacccaagctgcaatacagtggcaccatcttggcttactccaacctctgcctcttgggttcgagcaattctcttgcctcagcctcccgagtagctgggattacaggtgtgtactcccactcctggctaatttttgtattttttagtagagatggagtttcaccatgttggcctggctcgtctcaaactcctgaccttaggtgatccacccgcgtcagcctcccaaagtgctgggattataggcatgagccaccatgcccagccatattggtgaatttcttttttttttcttttttttttgtttgtgccaaactaacattaaaatttatttatgatattaaaatacacaaatagtttccggggctgagagtcctgaaaaatattgggctactaaggaaagcatttaatttcaattttattattattattattatagtttaagttttagggtacatgtgcacaatgtgcaggtaagttacctatgtatacatgtgccatgctggggtcctgcacccattaactcatcatttagcattaggtatatctcctcatgctatccctccccactccccccaccccacaacaggccctggtgtgtgatgtaccccttcctgtgtccatgcgttctcattgttcaattcccacctatgagtgagaacatgcggtgtttcgttttttgtccttgtgatagtttactgagaatgatgatttccaatttcatccatgtccctacaaaggacatgaagtcatcattttttatggctgcatagtattccatagagtatatgtgccacactttcttaatccagtttatcactgttggacatttgggttggttccaagtctttgctattgtgaatactgctgcaataaacatacgtgtgcatgtgtctttatagcagcatgatttatagtcctttgggtatgtacccagtaatgggatgcctgggtcaaatggtatttgtagttctagatccctgaggaatcgccacactgacttccacaagggttgaactagtttacagtcccaccaacagtgtagtgttcctatttctccacatcctctccagcacctgttgtttcctgactttttaatgattgccattctaactggtgtgagatggtatctcattgtggttttgatttgcatttctctgatggccagtgatggtgagcattttttcatgtgctttttggctgcataaatgtcttcttttgagaagtgtctgttcatgtccttcgcctactttttgatggggttatttgtttttttcttgtaaatttgtttgagttcattgtagattctggatgttagccctttgtcagatgagtaggttgtgaaaattttcacccattttgtaggttgcctgttcattctgacggtagtttgttttgctgtgcagaagctctttagtttaattagatcccatttgtcaattttggcttttgttgccattgcttttggtgttatagacatgaagtccttgcccatgcctatgtcctgaatggtaatgcctaggttttcttctagggtttttatagttttaggtgtaacgtttaagtctttaatctatcttgaattgatttctgtacaaggtgtaaggaagggatccagtttcagctttctacatatggctagccagttttcccagcaccatttaataaatagggactcctttccccattgcttgtttttgtcaggtttgtcaaagatcagatagttgtagatatgcagcattatttctgcaggctgtgttctgttccattgatctatatctctgttttggtaccagtaccatgctgttttggttcctgtagccttgtagcatagtttgaagtcaggtagggtgatgcctccagctttgttcttttgccttaggattgacttggcaatgtgggctcttttttggttccatatgaattttaaagtagttttttccaattctgtgaaggaactcattggtagcttgatggggatggcattgaatctataaattaccttgggcagcatggccattttcacgatattgactcttcctacccatgagcatggaatgttcttccatttctttgtatcctcttttatttcattgagcagtggtttgtagttctccttgaagaggtccttcacatcccttgtaagttggattcctaggtattttattctctttgaagcaactgtgaatgggagttcactcacgatttggctctctgtttgcctgttattggtatataagaatgcttgtgatttttgtccattgattttgtatcctcagactttgctgaagatgcttatcagcttaaggagattttcggctgggacaatggggttttccagatacacaatcacgtcatctgcaaacagggacaatttgccttcctcttttcctaactgaataccctttatttccttctcctgcctaattgccctggccagaacttccaacatataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatagtaaagggatcaattcaacaagaagagctaactatcctaaatatatatgcacccaatacaggagcacccagattcataaagcaagtcctgagtgacctacaaagagacttagactcccacacaataataatgggagactttaacacaccactgtcaacattagacagatcaacgagagagaaagttaacaaggatacccaggaattgaactcagctctgcaccaagcgggcctaacagacatctacagaactctccaccccaaatcaacacaacacaaattcttttcagaaccacaccacacctattccaaaattgaccatacagttggaagtaaagctctcctcagcaaatgtaaaagaacagaaattataacaaactgtctctcagaccacagtgcaatcaaactagaactcaggattaagaaactcactcagaaccgcttaactacacagaaactgaacaacctgctgctgaatgactactgggtacataacgaaatgaaggcagaaataaagatgttctttgaaaccaaagagaagaaagacacaacataccagaatctctgggacacattcaaaacactgtgtagagtgaaatttatagcactaaatgtccacaagagaaagtaggaaagatccaaaatggacaccctaacatcacaattaaaagaactagaaaagcaagagcaaacacattcaaaagctagcagaaggcaagaaataactaaaatcagagcagaactgaaggaaatagagatgcaaataacccttcaaaaaattaatgaatccaggagctggttttttgaaaggatcaacaaaattgatagactgctagcaagactaataaagaaaaaaagagagaagaatcaaatagatgcaataaaaaatgataaaggggatatcaccaccgatcccacagaaatacaaactgccatcagagaatactacaaacacctctacgcaaataaactagaaaatctagaagaaatggataatttcctcgacacctacactctcccaagactaaaccaggaagaagttgaatctctgaatagaccaataacaggagctgcaattgtggcaataatcaatagcttaccaaccaaaaagagtccaggaccagatggattcacagccgaatattaccagaggtacaaggaggaactggtaccattccttctgaaactattccaatcaatagaaaaagagggaatcctccctaactcatttcatgaggccagcatcatcctgataccaaagccgggcagagacacagccaaaaaagagaattttagaccaatatccttgatgaagtttgatgcaaaaatcctcaataaaatactggcaaaccgaatccagcagcacaccaaaaagcctatccaccatgatcaagtgggcttcatccctgggatgcaaggctggttcaacatatacaaatcaataaatgtaatccagcatataaacagaaccaaagacaaaaaccacatgattatttcaatagatgcagaaaaggcctttgacaaaattcaacaacccttcatgctaaaaactctcaataaattaggtattgatgggacgtatctcagaataataagagttatctatgacaaacccacagccgatatcatactgaatgggccaaaactggaagcattccctttgcaaactggcacaagacagggatgccctctctcaccactcctattcaacatagtgttggaagttctggccatattggtgaatttctaatgatgcttgttattatttgagaaggaaggagctgaggttttagaatagaaaaacaaaggggatgtcggagaaggagtgtggcctctgcaatggttaacagtgcgaatgagttccaggggaaggtcattctgggtttcggaactgtcccagccaccttagcgatggggctactggaggaggatctgcaaaggagaagcggcacctggcatgaacatagataaggcctgagaaatgcctgctcctccacatgggaattttaataagatgtgctcaaagcatcacagctattcatgttattctacctatgtgggaccacacaggaccctgagattaaaaaaaggtaggaatggggcaaggactaaaatcagaaatgcattaatcatgtaaggttagatgaccagacaggaagaaaacaaaggcaaaaaataaaactcccactaagcctgtttcccatttgcagtagaagaaaccaacatagaagcttctcattgaaagtgtggaggaaagagataagacaagctgcttgtgagcaagcaaagcaaaaaagagaattaatttcacaatacccattgtgattaatttatgatgtacaaaatgccatctacatttaatttgtttgttgtattatttttgttgatatcttatggagaatataaagatgggctccagcaggctcatctcatccccatccttgccccttacgatggaaaatccctcagctgcagttctaacatgagcccttttaggaacccagccctgctgattagagaggaaagaggagctgttctaagttagacacaggcatggaatattgacttcacagagaggtacatcttatcatacaagaatttctttaacaaggaaccactaaaaattcagagacaaagaaaagtagaagtaaaaattaaaaaatgaaatgaagtaagtgcacaacagattaaatcagcttcctagcactcttccaacctgtgaaacttttatagctccctgaaaatggataagaaaccaaagaggtggcaaaaggagtttaaataaaaactgtaaagtaagtagggaatgtgggagaagctgcagtgaagaaagcctacagaataataaccctcatgctcttgactatggtaaggaagttgtctggttccagacactaggacctgtttaccagacagattctgcaagggaggatggactgtgtggaaagactgtttcgtgatggtgtgaaatatcttttatgatttttcaagtatcttacatttattccttaccaaattaattattctaatgagtgagtcacctctctgcatgttcagtacctaaaaaggagttctccatttgcagttgattatttattttaaatgatgcttcactttagaagaaatatacactgtatagatgtaggtcagtctttccatgacttgacaacttctgagcatactggtaaagtgaataaataaatcaattatgcattactgactaacgaaagattcttcatcagcattatcttagtcaggggatgccaaaccccctgctgccctgtctgagaggtcaaggtgtagtggggaggagagcacgcaggtggtgaaaatgcagagtgccagctgccgtggtggagccaggtgccaggagaatggcaaagcatcacagagaatgcatggagggtcagcagagggtcagtggaggctcatgatatgcactgataccagaaacacgcaagacttgccaagtgacgggagtgaggaaaggcattccaagctacgggccaggttcacacaagtctaatttcctcagagtcatcatgtcataaatgctgcaataaaaccaaagttggcagaatagagcatgtcaactggggacttctaaataatatggtccagggtggagagtggcagaagaattttcatttgacaatggctttttctcaagcaataagagggcaatgagaccaatcggttgtacatacgtattctagaaattttctaagaatctcagatatctgacacaatgtcagaatcaaatgcactacaaataaataaacaataaccattctaagtggggaaatgtattttaaatcacctgtggcattgacatgaacaacatttcgtgaaacatatcctataaaagttttcagtgatacgtcccagatctgatcttaaagctggaaaaacagcacttattagatttcaattcagtagtcacgtgcagaaacacagattccttgtgcaagacccatgatggcaaagccacactgtcattattcctgatcagcattatcaaattcaaaaaaaaaaaaaggcaggttctgcatgctcagtaaaatctgattgttcaaacccagtatctgtcagcatcacggatgtctgactttaggtctttgtgtgtcaaaaccctaccagccaagagaaatgaaagcctgtacgtaatactgaagagtaaactgcagcaatattactgatcattgcaaaaaaaaaaaattcttctatataaaaagctgttaacaacatcatccagataaaggaataaggaaataggtaatccagacacttattaagagatactgttagttacataatttaggaagaaacgttggctaatagggataaatatatgagagagaagaaaaacgttctaatgtttgatagcactgtaagttgactatagctaataatttattgtgtatttcaaaatgcctagaagatttggaaatgataaatgttgacagtaatggatatcataattatcctgatttgatcatgagactttgtgtgcatatttcaaaatatcacatgtatcccataaatatgtacagttattacatagaacaaaaaaaccaaaaaagaaaaattagttacaatgtaaaaaataatttaaagataaaataaaaattatgtttaaagaaaatgtgtatgaaaaatttaaatatcagacaagtaaactatatagattatagtatatatttaaattatgattattaaatgaatacaatgtccttagaacaatgcctggcatataccatgtcttatatgcgtctattaaataaaacaaaacagaactattctgtgtgccacagttttaataccaagaaaaatactccttaagaaccagccattaatttaagcaatattccttggcactgacaaggtgccacgtacgtttccagttcagcggcttccagcagtggacacatcaggtgctgcctccctgaggggcattctaccaggaaggataagcatggaccaggcatgctacctaagtaaggagtccactgccttagaaatgggaagtgccttttattttgaatctaaatttcatatctacttcttcattcagttccacttaaacctgcatctatctgagagcactttgaatgtggtaagaaggaaccaggagtagactatgactttgtcacatcagcattttacacgtagctgaaatatcaaatcgtgcacaatgatgtaggtgataaatcatctttcatccagatttcattaaatcataaaatattaaacaaaaagagagtgtgtgttgggaaaatggggaaatgagtgtacctaaagaagcctcagatgctcaactgacaccagctgagagtgagggctcctgagaagtgcgcagtgtgaagcccatgtgaaatgcgaatctactctcctgcagcaaagggtcctagaaaattgtttctgcctctgatgtaaagttcaaaagtttgactatgaaaagtgcaaactaaagacattaggagctttcaccatggctcagatttgtttctgcatcccagtggtcattcgctgatggaaatacttgacgtcagtcttcccttttttatcgtaccatattttatatcctgcaatgttcctgggctccatatggtgtttcatagtcacctgctctctttcacaaattgtatctctgtttagggttttctgcagttgttttctccctcaatgttgagaaggtagagaataagtaagcttctgcgggctttgcccaagttttaaattttcatatatcaaaactgtagctgtctagagctgcatgtgcctgcaaatgtgaggcagggataacatccaagtgaagccacccatgaggggtgcatcgatgtcaacacacagctcctacttccaccctgtcatacaactgccgtttccgaacgtggcaaggctcccaacacctgtgccttcacatacatggtttctatggcaggtacactctgtattctcccctccaacactgctgctgccctggcgtgttggtcacccccagtatccgtactcaaccttcacaaccgagatctctcagtactgctgtggaaacaatccagtccatttagaaacagccttcctgtactcccggtgatcttgttatttatatctatatcatgtcaataatgtgatgtaagtgtactgtgtttgtaatgtgtgtatctacatgggtttcctcacaaagtggtcaattccattgagaataggacctaggcttaaaaaaaaaaaccttacctctagatttaacgctgtgcattcactaacttttgtgtcagttttcatcaaatccacttaagttgttcatttttaaaaaaaatctgaaatgattaaaatgtgctaaaaattactgattataattttaccgaatataaaaattgtgaagatttaaaaatgtcattttctagtttatgtttttagagttttttaaaaattacattttactgacactatttacacaaaacacttctgatacaaaccattcataacttcttatgaaagaaaatagtcctaaacacataaacaattacagtgcagttaacatttcaagaaccactgactctgttgggcagtgcttccccatccccctcagtagcacactgaacttttacatttaaccagaataaggctggtgttcaccaaagtcatggatagttagtaaaagtttatggtcctacagtcttaaaaatttttcattttgtaaaacttctagagaataattgaatcaatataataggaaatttggcttttcttttactgaatgtacattagctaatacaaaggtcatgacactgattcaaagtgaagttacggtatcaagaaactgtatgtttcttgatagtagctaatcttttttcactgctaaaagatgtattcttgctcaaatgctatgtaaaggagactcatgaatgaagctcatgcaccaaggccaggcaatgccttttagccatgacactaccaacttctggaagatcaaaagtaggaacaccacatgtatctgtgctaggttatgtaaacataggctctatcaccaaacacataaatgctaaatatttggggaactacagcaaataagaattccagaaaataactgtactgcttgaggagttttctttttttggaatatattttaaaacacacacacccaaagttttccttcactgtcttccataagaaagactgctcaaagaagaacaaagtggcccagggaaaaatgagagttagagaaaactgacaaatcattgatgttcgtccaatttgggtgaaaaataaaataggggaaggagacccttctccacgaatatccttggaggaagtcagaaggagccctaagaaaggaatgggaaagcctggaataggtggctcatttacaaaacaatgaaaacagttctgagcttcccctcctgagcctttgttcaagctcttttctctgtttggaagactcacccattatttctaaagattcacattcacctctccttagggactgtttcaactgccagtcatgggcaacgcctccttccttctttgtctcctgttcccactgcacctctgaggtatcccttctttctctgtacgaccttaaccgtttatgtctggctcttaaaggtgttctgctgcctagcccgttctgtcattgtatgtgtgtatttctaagtcccactcagcgcagggatgtttggcatgtcctcttaattttacagaacaccacagagtgccttgcacatgctagctacccgataatattttccaaataaatgatgtaagcattaattaatctattgacttgatagaaaacaatttgtattatttctaaatgtatctacctgaaattttaccattaaagacttgttacatgatgtggtaattgtagttcacgtgattatacccagaagggaaatgtaccacattactaaccactaacagctctttgtggatgtttttgctcatcaaaccaagaacatttctattctatccaacctgaaattagatgatagtatattttgtttgggacgagagtgaagactgagatgcaatccaaaccacaagcaaatacggaaaggggcgagaaacgaatgcaagctctgcctgtgctccaaaagcgaaagcgacaacacccactcacaaacacacacagtagccttgatcactgctgatttaacacagcctcacagaacaaacgtaactataacattatgctttaagtaaagtgacaaatgctatttgtattgtgtaaataccctcagggtggaacctaatgagtatattctaaagcaactccacaactgagaaacaagacaacatgagctcttagttttgtgtatgatgaaaatcaagtgttgccacatggcgaagactgaaattcagacacagagaagggtacaaggctctttttcctcaaatgtgtttccacagagtcacttcatgcaaaaccaaagggaaagcaaggatgaaagatactgggtgaaaggctatcctccgtctttgcatctattttatcatcttttttctacatgaagtcagatgttcaagacagataattatgaaaactaagaatcatagccgagatagaattttttcaaatctccgccatactaaattttcgttaagtaacgttttcaagtaaggtataattcagggaattttaaagtgattcgggagttaaactggattttggtagaaaaacagtatttcctagactaatgaatatttcccagagaatttattattgttatacagtggtatatcagttcttttcacatgaaataaattacttttttttttaatttcaaaatttttaaatgcatttaacttaattttgttgtatagctttacatgtacctaaagccagaataagtttcaacaacagcatttttgtttattaattatcaattcttttattcatccaaaatgaccctacataaactgatttcattcaaaaagaataaaatgcagtctcaccacctaacttgtcctgtggaatattaaactttccatgttagatagtgtaatttgataaaggaacgtgttattctttggacaactaattgtatgaacgttttcctgtaaacagaattactaaaatggggccagatacagtggctcatgtctgtgatcccaacactttgggaggccgaggtgggcggatcatgaggtcaagagatggagaccatcctggccaacatgatgaaaccccaactctactaaaaatgcaaaaattaactgggcatggtggtgcgctcctgtaatcccagctacttgggaggctgagaaaggagaatcacctgaaccctgagtgggggcgaaggttgcagtgagccgagatcatgccactgcactccagcctggcgacagagggagacaacgtctcaaaaaagaaaaaaagaaaaaaagggacacaacagtgagtgtcttcttgcagagccacacagaagggtctatagagagtcatttagggttttcttaggaaaggggtggcagaagggcagaaaaatcttccgtgcagtgttaaaagcagaagaaaatgaggagaacccctcaaaggttgccctcctcggagagttgagaagtctactttgtagctggaggacagtgtattgcgggagagctgtgaggccagcatgagagtggggctcaaagcagagaggggatcttatttgtcagccatgggagtgtgacttttatttcacactggggagagacatgaaaagcacggttacagaaaattaaatgtatatttttagaaagaagtctttcatgacaccataacacatagcatcattacagaaacaaaacaggtttagtttttacgacacaaaatgcagaaacataaaatgtatcctctggaggccactggaccttctcaaatgaggtgtttgtaatgattgcagaaaacatatctagttcatataatgttaccatatcagtggaactgtgagtttaagataaaaaaaatggaaaagataaaactattattctcatttcaagatatctagtggggaaaaaagaaataactatgcctgcgctgtgtatttctgtaccataaaataatgattttctgaacagattagaatattacataataaaactactgacatgaattcatggtatcagtgacattcatgtactgtatcaaaatgcagctccaccatctagttaggcactgcattatgtatgtaaaaatatggttataataaccaaataataattataattttgtggagaaattcttagcaaaatttacaatttaagttttctcctttgttcaaacgttgaatggcttggaaagataacccagtagttgatttttactttgcttatgttttattctttccttctatagactatttactccttcttaaaacaattttattagactttgtcatggactccattttgatttcctgaagggaaatactacaatattgttcataggagactggttgcaaatatatactatgatgggtaggcataaaaccacatactctgattgaggcgtgaatgtaaaattgtcatacagatgagaaaatcaaaaattttggtaaagattactgtgaattctttgtctagtaggaggtcattattttttgaccatttttaaaaactgaaagtcaacaaaattccaactcttatctacaggtagttgaaccactggtgatttttactttatgctttcgtctgttttctgagttttccgagttttccatgagcatctatgatattcaccgtaaaggaaatacagttttgtctttcgcaggatattatctctaggtaagtaaatgtgcagacagcctgacatttgctaatgatcgatgatttgttcttaccaccctccctctccgcctcccattcacaggcatccatgcagatgtatcttgggccagtggccacagcgtaataccatctggcctgtattcccctcaagcctctgcagcttcctgggccatggctcctgtttctccgactggattgcattctcatgttatacttccctttctttctcccactaaactctaggcaccttgagtttaggaatgctgtctacttcacctttatcttccaaactcctgttttggtgttaaacacgtaattactcgacaactcactactgaaagaatatcgaaatgaagacttctacaaaagtcttctatccggtactgcaacagtaaggtgttttgttttgttttgttttgtttttgttttttaccactttgtataaaattgcagtattattttttctgtttgtcttctctacttttgtttttctgttctttcctgccttcctttagaatgttcaatgttcttaagaattttttttaattaacttattggtgttttaactatacttttcgcagtgttttagtgtttgctcttggaattaaagaaacacccaagatttttcagtcttcttgtaaatattacaccaattttattttttttaaaatgtataaagaatgcaattttagaggtgcatttaccaaacctctttttttctgtgtttcttgtcttttctttttggtatgcttatcatatatattacaaacatgcaattcaaactctaaaacataatgttgttatttttacttaaaaagtctcatgcactttaaagaaactcagagaaaatgtcttcttatattaaccaaaatatttaccacctataatgttttgagacagagtctcgctgtgtcgcccaggctggagtgcagtggtgggatctcggctcactgcaagctccgcctcccgggttcacaccattctcccacctcagcctcccgagtagctgggactacaggcgcccgccaccacggccggctatttttttgtatttttagtagagacggggtttcaccgtgttagccaggatggtctcgttctcctgacctcgtgatccacccacctcggcctcccaaagtgctgggattacaggcgtgagccaccgtgcccggccaccacctataacactctctattcgtcactgaagatccaagttttcaccacaggttgtttccatgaagcccgagcaaccatctcagcatttcctccaccacgagcctgtcactgacaccctctcataagctgtcatagcttcctctgattttctgactcaccctcattcttgaaggttgttttcacgtgatataaatgtctaggttgacagttcctttttgctttgtttactttctttttgcttttagcactttaatgatgttgttttctatggatggcctccatggtgtttgatgtaaaatcagcaataatttaaattgttgtttcctgtatgtaatgcgtccattttctgtggctgctttcaagctttttctctgtctcttttgaagcagtttggctgtggtgtacatggttatggtttctttgcagttatctttcagtttacagagactcttgagtctttttttttcttttttttccaaatttggagaatgtcatccattagtacattaaagatagtttctcccttattctccctctctttctccttccggagtttcagctaaacgtctgttaggcctgatattgtcccaaagaagcctgacgccctgcttgttatattttttcagtcttattttctctatattctactgattagataatttccattggactaacatcatcaagctccctaactcttatgtcattttgtatctgttaagcctttccaagtaaacctactttaaaaaaaattgtagtttagatatttaattattcatttgattttcattttataacgcctatttttttcctgatatttctaactttttttcaccaagagcattgcttcctttacttatttaagcataattgtaataacagctgcattaaaatccttctccgctaattccaacatctgtgtcctatcaagcttggtctcagttttgggggccttttagtttttaattctttattttaaactagctgaaatatgtggagtgattagttgttgtttctggaattgtgaatttggtttatttttggagattttagactctgttatgctcctccaaaaagttgatgaatatatttatttcgtctttggggttttattttttattccttggcaggaaattaagttagttgcattcaaatgaaaacttcctgttgtgggggggtggtgtgcacatccactctcatggaactcctctgtcctcagctaccccatttggaatctgctccacttaggcatagctcaagagtcaaagtctgggcagaacctgcagccacagtgtggggctctccagtctagagctctcctttctgggattcctccctcattttctggtggatgtggttttgctggttcagaaagaaagtggatgttaggatagagttttggttttgccaccagcactgacatgcttgacctgaaaatcaaaaaatggatgattcgctataggctgttcaactccttcggaatctgcctgtttcttttcaactttctagtgctactagtttccaggtgtttttctgttttacgtatttatttttatatttcatccacagttgcaagtgaagaagggttgaatcccataggagtttatttggccatcctgaattgcacttttacaaaaaaataccttcctttgccttcaaaatgtatttacttctacttgacacaaacgtacaaatactagttttcaataatagctacctgcctttagtttactgcattctatgtaccaagcattttacaccattatattatttcaattcttatttctctgggagatagactttattatttcgcacttgtagtgaagggaattgtgactataatccatgcaattgctgaaagctctaaacaggaatcacatagttttaagtattgtgcatattttcatatatataagaaatatgaggttctgtggttgtatgtgtttgtgttttctgtgtttatgttttgaaaattaaacatccacatgattaaggaaggcttcccctttatttctgtggatctcctagaatgatttcaactctgtgaattgggaatacagaaatgaacaaagtgtttacaacttttgccttactctctgcaattccttcacatggagcctcacagtcatggaaattgagtatgaagctcataggtttcaaggcagcccaaaagccgtcttttccactacaacaatttagaagcttgaaaataaacccaacctctatgtacagtggaaaaagtcaaatcaacacaaccttggatattaccacttagaacattctttcaaaagtttttaaaattttgctcgtgacatcagattttgccttgaattacacaatatactctatatgtaaggaccaacccaattatcacctataagtgtagcgtagatgatagtcaatattcattctggttttctctttatgatccactatgtcttatttcctgttaccatcatgattctagaaattggcagaacatgaaaacttttgtgatttcacttttagaaaaaatcgagatgaagcacttcaaagaacgctcacaacaataacttgtttttaaaaataaaaagcaataggtgcattaaatgatgagaaggtaaaaataggccaaaattagagttgaaagaagagagtaaagaaatttagctgaagtactacaaaatgaagaattgtgaaagctgacagttcttagtcacataagagcaaggtcgtacttaatgaagctaaaaaaagtaaatttagaagaagctgagggaaattttgggagctatttgttattctgtgcgactgtcttacttagattctattttctcctcattttctggctgtcctcatccaatattctttcagaggacctgggatgtgtcttagtgccagatggcataaaaataaccatgctattaatcctacagtatgagggatatattcacttttcagtattgagataaataaagcaaaatgaattgaattttaatgaatttattctggggaataattctctgaagtatagttatatttagattatttctaagtaactcaccaacatgcaaatattgacttgtatagacaccagctgttttccatttcagcaatttatacacttgaaaatgaacccaaatacaaaattttgctaaattatttacctcattattaattggttgaaaattgctttgttaatagttgggtttaaaacagtttaaattcagtaatatagtcaataactagtctacagctatacaaatatttcaagtagtcttaatctatacagacggtttttgacggttgcttcttttgataaatcactataataaaatctttgtcattggctttgggaagctttaatgacttcaaagaaaaatgcatttattgcttctgcttttagacatttagttttgttataatattgatatggaatagacaaattttgtaatataatttattaagtgagcttaaatgggttttaagttgatcatgctctccacgtaaacatatacatataatgcataacttgtatggtccaaattagttaatgtcactatgctaaattgtacacaaattatacagctttttgtaaccccagagaaagcaaaaacaaattgtttcataaagaaagtcatgaaacggtgtcagctaaacaatgaaagaaaataaaaactatagattaacagtatttggcatctgaatgtaaaatgtagtatttagtccataaatgatagcagtattttcaatgtctatctcatcaagatagaatatatttaagttttttgtacatgattatttactttcagagaagcatttgtccataaacctgtttatagtcaattatgaaaatctaaagtttgatactttacaaaacatgatatttgagaacatgagctaccataaatattcccagtggaagttaaaggatccgacataaattattctaccacaaatcatttcaaactactgtcctacatttgggcagaactcacttttaatgtgaaatatccatccttttataattgacaatggtacgttaaaattttgtataaagatgacattgagattccagaccatttaatttcattgatttaggaaaaagaaacaaacaaaaaaaaaacattgcttgcaaagtagttctctttagttatgactgtggtacataatcatttccatgatgcctttttcttggtagaattttctgagttttttttctctcctccagaatgcacactcctcttaaacttccacgtggcagaagtagtttctctggataaggcaccacactttgaatttatttatatttttgtgtgacagtttgagtctgccttccctaatgggatatgaactctacaaatggggacatgcctgtctttactcactgtaataaccccagtatgaatgatgagtaaataatgctcatacagtgaataatatttcttcagtattattagacaaagaacaaagttgaatacagtaaatatcaaaatgatacgaaaaactaagcaggattaaattttgctaagctgaaaatccttccttgtagcacatttaaaatgtaaataatatttcattctagtatgtgcagcttaaggacttaggataatctaaaaaacaaagtattataaaataaagatgaattgttgatatatgtttatgtaaataaaaacataaataccttcacctaagagaatatagagctctctaagatgaagtgctgaatttttttttgatgctaaagaacagaaaaaactcaaatgttatttttaatatcaaaataaattttatatctgctaatactaatgtaaatgttttctgtccaaatctcttgttacaggtaaaataaagtggcaaatgaatttcgtgggaattgataactaaaaatgtcagatatccccttagagaatatatgtaactggtaaaatattaaacgatgattaatttattccttgttctgcatagcggagttaatctattattgtagtataactcacactgtgttggggaaattgtcttgatttgtgagacgttttggagcactggattcattttatagatataaaattgtcaatgtagaaacggtttgcatgttctcaggttgtgtgtccctttcagaatttttccaccctagccaggtttctcaagaggttgtgatgacagagcagtccttcatggttgtcagagtgaaaaaggaagcaggctattgtcctcagggagccagttcatatctgttctagcccagaaattataattggaatctttcccaatccactggtactttatatatactaagaaaataaatcagtactctttccctctaagttttaaaacatagaattgtttctttctctgggagggtggaggggggatattttaattcctataaatattatggaaagataagtgatatggtttggctgtgtccccacccaaatctcatcttgaattgcagttcccataatccccacgtgtcatgggagggaccctgtaggaggtaactgaatcatgcgtgtggttgctccatggtgttctcacgacagtgagtgagttctcacaagatctaatggttttagaaggggcttttcccccgtttcttggcacttctctctcctgccactatgtgaagaagaatatgtttgcttctccctctgccatgattttaagtttcctgaggcctcccagccttgcagaactgtgtgtcaatcaaacctctttcctttaaaagttaccctgtctgaggtagttctttatagcagcgtaagaatggactaatacaataagcatagactttctctggtttatggaatattttaactgtaatagtgacagcaggtgatgtttttgaattcattactagaaatgtaagtatatatgaacaaatagagccaaaaacgaatacctaaaacacaaatagctaaaagaaaatgaaataatatattaaggattcatgtcctaaacttaaaaacatttgatagttgcctgttacctttattataaggattattctctaacaaggccttatgcatcgtgctccaaacaaaacatttagccatatcttgtctttcactgctactcatctctggctctccaagccctgacccaccctggggaatgacctcacatttcaggctctgaacaacaaccatatcagagtatacaccatcacgcaaggccagccatgcctttgctttaactgctaacttaagataggctactcttttctcattttttccattatctttccagtctgaagaactactgaaattttgaactataacatggatatcagtaaaaaaatcttacacaaggataacactttcctctgaattatatcatcagaatgaagaataaattccagctaatagtaagaaaaattgcaactctaggtaattctgtactatgtggtatctaacccttattctcaatataattggtcataaatgatatatattttaagcccctacttcattttagtgatgagtatgatgaagtcaagaaagttaaatgacgcatccaactgcacccaatgggtaaaaactggtgtagagagaagtctctaaatccagatgagagctctgtgaatttcagctactccatttctctactgacacctcccactgtaaaagcccatttgtcacctatatatatatatatgtgtatatatatatatatatatatatatggtagacatatagattatatataatttatattttttatcagaggtatcttttaatggttcctcagtcttttattataataagctcttaataatttttatatgcaataattaatttgagtatcctatacatatcattactcttaaatgtctagttgaggcttcacctcagtttacttgcattgtttaacttttttaccatcacactgaagtcactctggtcaaaacaacacattccctgtaaaccactgctatgcctatcaaattcctcctgctgtcacttgaactgctggtcattcaaggtcagtagatccacccgggtgacaaaagggaggtatatttgatctttttcatgtatttgtttcctaagacagagtttaattcttgtttcttaccattctcaaatttgctctttattctcttgtcccaatgctattgccctatgataagcatttttcagctcattccaaaagttgttctcactctgttccatgggaattttcagatacataaaccaaattgagcctaaatatgcctccttcctttctctgacttgtaattgatgcccaatatagcaatgtccttcccgaagaccttgccatcatcacaaaatcctttacatacccatactcgccctgcatgtgtgtccccaggctctccgattcctctttcatctctcagttggaaaaaaatagcgctatttcaagaaatgcaatccaccagtagggagtaggaaaaaatatgtttgtaagaaatgcctacatgccaaagagagaaatcttcaaataatttacatggaaagtgctataatgaactttaaaatcagcttacaaatttccaatggcaattcagtttgctattttcaactctttgctgcatttctacatcatttttttcttttaattttcttacacatataaacgtattacgtaattgcactatgcattgataatgcagacctaactgtgccataatgatgagtttgatatccaactttttttttttttttttttgagagggagtcttgctctgtgtcgcaggctggagtgcagtggcgtgatctcgactcactgcaagctccacctcccgggttcacgccattctcctgcctcagcctcttgaatagctgggactacaggtgccaccatgttagccaggatggtctcgatctcctgaccttgtgatctgcccacctcggcctcccaaagtgctgggattacaggggtgagccactgcgcccggctgatatccaactttttaaacataaaatcttcgttatgaaatataattttttttttttttagtttttctgtatttcacatgtatttctaactatccttttgagaaaaaacttgctgtattcttgctaataaatgtttaaaattatttgttctccatagattgctttaaggcaacccttgtatttaaatttcaggcctggcacactggcttacacctgtaatcctagcactttgggaggccaaggcaggtagattacttgaggtcaggagttcaagattatgttggccaacgtagtgaaaacctgtctctactaaaattaataataataataataaatatatatatatatatatatatatatatatatatatatatatatatgtatgttgaaaagctatcttctcttcactttttcccacaatgttgcattaacagtatcatatgtcacccatctgatttgttgtgtccaggtatggacccgaccacaagagtggtcccgaatggaacttatacagctcattaccagggtcggttcaaatagggtggtgtttgagacaatttttattcaactactggatcatataaaagagaaaaagacacagtataaattgaatataagctaatgttttagtctatagagacatgcccactgtttggtgggaaacaactgaatgagtagatatagcccatggagaataaagtataggagtttatcaagtactgtaccatgagcagataaacaaattgtgactaggcaatgtctgcatcccttggaacgaaatatactttccataatttatgtaatctgtaatcaggcattctattcagttttgtcatgtctattttaactctggctaaaaacaggatatagaacaccatcaggcagctccattcttctgagttctatcatcataaagcatgcaaattattattgtgcctattgaaacaatgaagacagctgcacatctgatgccaaaacactgaagatatttattgatgtacttcactttaaagtaaaaacactttattagggaaagcattaaagatttcttcatggagaattagctaaattgatacacagacacattgtttcagcgttcttgtgggttcacattaatttattcctgtagtaaacttgctttctttccatagtatgaatagcccaatggatatttttgtagtgatgaaaaatagtttatgcaattaataacccatgttctcttttcatcaggttagtagcagggagtgacatcacgagagaaaacagtagccagggataatggaatgtttctaatgaccctttgaataccatcttcataggctggggcagaagggccatattcttgcctttccaccccttttctcagtgtcttctcatggagttgtaaaaataatataaaaaataatttaaagattaagaaaattatgttcgaatattggtgtttttttttttttctagatatcaaaagggtggtgagtggcccagctaggaatctacgactcatctgacaacagtctctgtctccatgtttgtgttcctcactcgttccatgtatacacccccataggtacacctgctcagtttgcaatttacaagccatgcatttctatgaatctttacttgggttcattctagctccccagtagtaatagttgtctcctccttaaaacccatcatcactgcctgcttttaaacaatgactcctacttgacaagtgcacaccacggttacagtgtacctaagagtaaggcacgatcttacccgtgagtacttcacaagtgaaaggtgaagcaaaatctacacaaacaggtatcagaattctacatattgaatttccaaaatgtactggtgagtaatcatgccattacatacattatccatgtgttacatatgatcaataaggttttattaagctctctgggttccaaatttcttacttgcaaaagaagatactgatcaagactgtcttgtccaacacataggtttctccagaagataaaactgtattgcatatttatgtatgatgtcatagtttttatattcctttctggagtttagaagctaaattttatcagttttattagcacgacaagacaaaagtaacagaatcactgaaaatgggtatttcttcagtgaagactattctttcatttctgccataggagagaaaaataatgtttcattttaatataaggtgaataagactgggctaaattaccacacccctctctaagtatttgatcagatagctagataaaaattcaataaaggtattgctatggatttcatgtttgtttacttccaaaactcttatttagacttagacccaaggtgatagtattaagaggcagggcctttgtgaggtgattaggctctggggactctaccctcctgaatcaaattaatgcccttatacaagaggcttcacacagtattcatccccttttcgcctttgcctcccttgtgccatggagggacacaaagttcatccccttgggtaattcagtaagaatgcaacactttggaagcagagagattggactgcttccagacaccaaatctgctgaactcttgatcttagacttcccagcctccagcattgtgataaataaacttctgttatttataaattatccagtctgtggcgttttgttatgcagcaggaacagtctcagacaagcattgtggtagctcattttgaaatacgcccagcgattctcgtctcctagcaggtaagctctatggtcccctcccacgttgaataggtttgatagggttaaacaacagggtattgtgtgaattacaaactgtgatttctgaatatagatgattataaaaggctttgcagcttcctcctttttgccttggatcacaccttctggggactccagccacggtgtcatgggaacactaaattagccctacagggaggctcacatgacaaggaactggggtccccctaccaaccaccggaaaggaaccgaagctgtgctcatgttgacctagttgacccagaacactatacccaaccactgcagaatacataaattttttgaaggacaaatggagatatggactaaaatagatactatgctacacaatgcaacaattctcaatgaagtccaaaacatttaaattctaaaaagtattttctctgaccaaattaggaaaaggtaacaagagtattttttaaagaccccaaatatctggaaaccaagcaaaacacttgaatacacaatggatcaaataaattgttacaaataaagttaaaaaaagttgaaaccaaataattagaaaaataagacatatcaaaatgtgttggatttagttacagtagtgctcatgggggagtgtgtagcttaaatacttatattacactcgaaaaaccatataaactcaattatttaagattctgcctcaggaagttaataggaaaaaaatatataaaattttaaaaggcaaatagagaaattaggaaagccaaaggcattttaggggaaagattaattgatgaagattactgagacttatcaagaaaaagaagagatatgtattaactacattaggaataaaagatgcaaaatctctatagatcctaaggacattaaagagcgtacaagatatactgtgaataaatttttccccaaaattatgaccacacaggtaaaatggacaaagtcctagaaaattacaacctattaaaactaacacaaggtagaatatctgagcagacgtataagaaaaatttaatatttgatattacaaacttttttaaagttaaaatgacaggcccagatggtttcactggtgagttctgccgagcatttaaaaacaactacaacaaaacccagtattttaagaaatcttttgaaaatagaggaagggcaaagattgcctaagtagttctaggagattaacgtaattttgataacaaagtctgtcaaagacctaaaaaataaaactaaaaggaaacacacaaaaacaaacaaaattacagaccccgcttcattatgagcctagaagaaaaaaacctttcttttttcgttttattttattttattattattacactttaacttttagggtacatgtgcacaatgtgcaggttagttacatatgcatacatgtgccatgctggtgtgctgcacccattaactcgtcatttagcattaggtatatctcctgatgctatccctcccccctccccccaccccacaacagtccccacaatgtgatgttccctttcctgtgtccatgcattctcattattcaatttccacctatgagtgggaacatgcggtgtttggttttttgtccttgtgatactttactgacaatgattatttccaatttcatccatgtccttacaaaggacatgaactcaccattttttatggctgaataggactccatggtgtatatgtgccacattttcttaatccagtctatcattgttggacatttgggtttgttccaagtctttgctattgtgaatagtgccacaataaacatacatgtgcatgtttctttatagcagcatgatttatagtccttttagtatatacccagtaacgggatggctgggtcaaatggtatttctggttctagatccctgaggaattgccacactgacttccacaatggttgaactagtttacaggcccaccaacagtgtaaaagtgttcttatttctccacaacctctccagcacctgtcgtttcctgactttttaatgatcgccattctaactggtgtgagatggtatctcattgaggttttgatttgcatttctctgatggccagtgatggtgagcattttttcatgtgttttttggctgcataaatgtcttccgcatcacgccacctgacttcaaactatactacaaggctacagtaaccaaaacagcatggtactggtaccaaaacagagatatagatcaatggaacagaacacagcctgcagaaataatgccgcatatttacaactgtctgatctttgacaaacctgacaaaaagaagaaatggggaaaggattccctatttaattaatggtgctgggaaaactggctagccatatgtagaaagctgaaactggatcccttccttacaccttatacaaaaatcaattcaagatggattaaagacttaaacgttagacctaaagccataaaaaccctagaagaaaacctaggcattaccattcaggacataggcatgggcaaggacttcatgtctataacaccaaaagcaatggcaacaaaagccaaaattgacaaatgggatctaattaaactaaagagcttctgcacagcaaaagaaactaccaccagagtgaacaggcgacttacaaaatgagagaaaactttcgcaacctactcacatctgacaaagggctaatatccagaatctacaatgaactcaaacaaatttacaagaaaaaaacaaacaaccccatcaagaagtgggcaaaaaaacccttttaaaattagtagatcaaatgcatcaatacatgaaaatggctagtaatatttgtcttcggaaaggtaaaaccacaatatgtctgctcttatgactaaattatttttataaaagcagaataattaaaagagaaagaattttaaaatgtattttttcctgatttttcagttagttttactctgtagagtagtaatcccttactacaaaataaataaaagtgaaaagacaaaaattggaaaaatctttcaacttttatgaaaaaagtgacaaaaaatattggtttgttaaaaaagaaaaaaaaaaacaaactacaaccataaatgcaatctagaattagaaacaatatgcgatttaaattttttaaattcctaattttaacctcgttttcatttccaccctttacatgattttgttgtaattgctaaatcatttaaaacatctttcattaagcctctaacattttaatcctgtttttatttttccttacttcctcaaggaaaaggacaattggtaggatgttaggaactcgattccttaatcaaccttgttgggagagagaaaatgaaagcgagccttccagagtttgccaagccctctttagtgatggcacaacattagcaagaccagtagggaaagcactagcaatagaggcatcaattagcaataacagaaaaagcagcccctctgctctcttgcccacccccacccccctacccaaagcatgtggcttttatgtagcatttccattcaagtcctgctgagcaaaaattccagtgcctcaagacagctctgttccatcttgaagaagaatgacaaaagcatggtctaatgcaaatacatacattcagtttaaaaaagaaaaaacaaaaacaaaaacaaaactacaaaaattggtaatttgggaaagcacctgcagaaagaaggagatggccatattaccacagcaggcgcgtgacagggaatttagatttttccttatgcaaactatccacaaattctaaagttcataagcaatatgttgccaaaggaagtgaatgtgtttataaatcagggaatattggtccaaccagttggacaaccctgaggctgagatgtcaccggccttgaaggcgtcaccattacagactctgctgaggatggcagcacagtgcctgcaacttcagcccagctagacatgaatcatctgattgatttagggaccctgacagagcttcttccccaaaaatctgtgcatagaataagaacatccttatctagttaggaagtttaatgaagcttcttggagtaagacaaaatgaatggcatctcacaactcaaagaaaaggaaaaagaagctatattggagaagctccaaaaaactgatattttacattgtggtgattttgattatttagaaaatgagttttaattgctcagatcatgtttgctgacagtttaaaaccccttggatactccaattctttcctaatataaattttatcctatccgttctttgtaaccctaataagctggacaagcctaggaagaagaatatgaaagaaactatcgacgcttgcaacaacttgtgggaacctcacgggaactgtgctaagtgaaaaaaaccagccctaggtttttgcatactgtgtgattccaggataatgctctaatatgatcccaaattgttaataaaacattctggaaatgacctaatagtaaaaatggagggaagatgtgtggcttccagaagttaaaggaagtaaatatgtttatcataaagacaccatgaagcttcctgatagccagataaaagttctgtgtccccagagtttccctgtcagtatccgggctgtattattattgtactctagttttgtgagatgttaccattgcgtaaggatggaagggggctctgtattatttcttacaagtgcaagtcaatctacaattaccttgaaataaaaactgtaattaaaagaaggagcaaggactaacaaaggtgtggtcctgttttcaacaaaaaatagatgcaatcaagtatcaacaaacgtattttttccatatttaatctcatttttcctactagttattctatgaggtagatgttattgctacatttaagttgcaatttttttcaaaaagtgcatataagtaatttactcaataataaaaccttacagctacaaagtatcacatcactcttctggtacatcttcatgaacaaagacaaataaggaagacctccaagagggagggacttactcgaggccacaaaaacagtcatcagacagaagttccaaagcctttttcattaagcactaattctttaatactgaaacttgaaatttgaaagcaaaacaaaattcagtacaggcagacagacttgtaaatcattttgaaaatcatattttcttaaaatactactattactacactctaattcattaattcgttctgactgtacattcatggaattctaactcattacaaaagtgactggtcaactcccaatttgtcaagctcttaaaatagggcccacagagttacatccaatctcctctactgatgcagcttaaccttgaataaagtacaatgcagacgcgagacttttcttaatgcaccaagcgatttcattctttctcattcattcatcaagtatttaagcaacctgaacttcttcaggtacccaggtagatagatgacattgacaagtattattgagtttctggtcaattaattcttacatctttttcaactgagtgaatgaacttgtgaaacaaatttcttagtctgagatgaaaactttgcatgcatccttgtcaaatttcatcacgtttctggtagcataagagagtaaactgcaagtaaatgttggcaacaatcaggcaagggttgaagcttgttaaactcactaaccagctgtgtggtttgggtaaattaccagattgctctgagcttctgtttcctcatttacaaaatggggataacgctatgtacatcatggaattaagttcctccccagtgactgccttgggctagcccaagagagatgcgtcatccaagcttagcctttcttcctggagcaactggcattcaatctctgggtgatgggaggttgcggaaatggaacaaagacccactcttctcacctcctttcagggcatctcagcacaacttagcagccaccctagctctgagctcccaaggaacggctaagtccaccatggccatggtttcacagttcaacttctcttgctcactctccttccttctccttcctgcaggtgattttccagggaccattcacactccccagggaaccacttgcaagtctgaatttgcttctcaaagaacatgacctaacacacatagctgttcttgcattttgagcagatgctcttaattctctcaatgttaaattaagtagaaaccacccaacttctgtcccttttctttccaaaccacctgtaatgaaacctattatttttatcctctctggtgtcaaaaagcaaggcgaggctttccctggctataatttctgtccttatacacttgatttcattatctgtctaactttctgtctctctctcattcccaaatctttcttcttcgatactctcacattcttactctttctcattttgtgtttgctcattcttcctctcgtgtctctgcctggcatcctgcctcccacactctcaaccgcaccctttcttctgtctctcccgttctcttaatcttctttctatattttctcttttatattgtctcacatttatttttattttagcattattttccctttgtcacctagcataataatgcctaccttacgtgacctaggtgaatttctaccctgcttaactctgctcatctttagaaaaaaggatgcctgaggtcaaaatttccccttgtgaccaaacaggctaagaacggtggtatccaagagaaaagctcacttgacctctgaagaacgtctaactttattagaatatcatttctgtgctaaatgacactcccccagcaccatgacctttgacaatcacagtaacaatgactagaggaaaccacaaaaggagaaagaggaaggatagctgcagtggggctgtgaggaggacactgcccattctcagtaaagacatgaatattcttcccgttgtttttaatgcccaatcccttcattaaagatgactgatctctgccttcctggctctcagaagctgagaagtagatttgcgagtcgtgttcccacttctcaattgcatggccattgaatacagcctgcaaagctagagttcacttttgatttaccatactggctttgcagcacagaagacggaaacgtcttacttttgcgggaaagagctttgtcggtaacaccttttctcaggtttcctctccaaactcactgaatttctcagcctctgtctctctctatccattccccaacatctctcttcactggttatccatcttcttctttgttttcaacccatgtcactggttaggatgcaaaactaaatctctcaaaccttaaaaagaaatatcatttcctgagactatacctcccacatgtattctctctctctccccttcccacccaaccaggttgagagtaaagcccaaagtcattgtcttcatgttttcaccttcagctcattcctcagttcattgcaatcagctccccgaccccaaagctctgcagggacttctctaaggtgagatcccaccaccatttattccaacagcctcagctcccaccctcccagaccaaacacattgatccctcagcatgtggactcatccctccctctggaatcactagtctcctggtttccatgacaccgctgtgttccacccgcaatcttccccctctactcatttttatattcagcgaaaaagcactcccctgccaaggtctttcctgaattccacgaagggtcacacacccctgttctgtgctcccttggtgcatacagatccccttgctgagggtctcaaaacttattcttgtagagaatgaagatattctggtcttgccgccagagcttctgacaaatagtaccatgtaggattcaggaaacttaacacaatcctctcagggattccagtgcttaacaaaacattgcttggcaagacattccccactctttatggtgacaatctgtttggctgcctgccttttgtattacctataagctccataaggacatgggtcatgtccatctggttcagcacattttctccaggaattagtggggtgcctgccaacttgtagatgtttgaaagaagaaagaaggaaagaagagagctcggtatgggggaaagcacaggctttcactgagaagacattttcagaggttctctgagaagaaaattagtaaatggtacatggttagcattctgtgtcattatttttcactcatttttgtgtccttcatagttttcaaaaaaggtaatgaaccatataaaaaagtgacacattccatatatccaagtcttatatagcattctgatttaacacaatttggattctgacttgcattacttagttattatacctcttctctcaaaggttaaatggggataataaaattatgtgcactattctaaggaataagtgaagaaatatgtgttaatgggcttagtaaagtgcttaacatatagaatgtgcccaacacagaaagctagctcaagattattttaattattattgacacaacatcattcattagtttgggggtatttttgttatgggcaataatgccactcagtctaccgagtgtgtttggtcttggagggtgagagctgaggcttctggaatgaatggtggtgggatctcaccacagagaagtacctgcagagctgtggggtcagggacctgattggaatgaaccgaggaaagaatattacatgtattattgttgaatacgttgctgactttcagatagaatgccgctataatggaaacctactttctctactagcctgttttgtaaaggaattatatttgatattgatttatcataggacatgtaaattttcgaatgagcaaaacttaacttacacttaaatacaccttttgctatgtttaactctggaagctcatcattaatagaatacagtcttaattggcttgatactgttttgagtgtaacctccacttttgactacagtacatgattgtcttaaaaagtatttttggcttgtttttgagaagttatcacgtaagccctgttgtcaaagagcttagattctaattaaggaaagttaaagccactaggtaatatcgtttataaagaaacattaaacatgagtcattatctatcatgccttaaaaataaattacaaagtgtcagattttccactcttactcctttttaattaacaccctagtcttgattggacgtgtttaatttttttaagaaaatacatgggaaggttttaaaataaaaaacaaacagctagaaataactcctactgcttcatggaaagctttgtacacctcttcatgtcttggattatcttgcttttacaacagaaactaaaatatttaggtgtgctcacctgaccttcaagtgtgatacacgaattctcagaattgtaaaagaacgtccctgaacttaagtaatttaagtgaaagaaagcacatcaatttcctaattttatctctagtaggttctagtggagttttaaatcaattttacttaaacattaaaccaacacatataaaaattgaagtagtgggttataattaataattcactggtgcgtggttaaagaacatatattctttaagtcgaatgaaaaaatagaaatatttggcgaagggatgccataactattttactaatggatgctgtctacattattagtaacataaggggcagtctttttttttttttcttttcttttttgagatggggtcttggtctgtcacccaggctggagtgcagcggtgcaatcctggctcactgcaacctccacctcctgggttcaagtgattctcctgtctcagcctcacaagtatctgggtctacaggcacccaccacaatgcccagctaatttttgtaattttagtagagatggggtttcaccattttggccaggctggtctcgaattcctgacctcaagtgatccacatggctcggcctcccaaagtgctgggattacgggcttgaaccaccacgccctgccaaaagcagtcttaaaggtgaataatgaggatgcaaattagaaaaaaataataatctaataaaatttccaattttattaaaattctgattcaataaatattttgttgtagttagaatgattccatcattgaatttgaaatgtccatggaagaaaataaatataaaacaaatgaattttaatgaagttatcaattttcttttactcaagttattatttgcacttttgctccacgtcagaaaaacagcaaacagagggatttttaaaagtatttacttatatgctgcattgctggaagataattatgttaaagctggcactcagcaatgcaaacgtggccaccgctcctttctatccctcagtattataattgtaggacatacacctcacatagagtagcaagaaaacaattccaataaagagccccacaacgagttcttcaaaatcaatgctcactccctaaaatctgtgaagacttaggaaagctgataaaggcacaagcctcgcttggtgtgctggtgtgtataaatgtatcctgtatttaacatattctactttaagttgtagtcacaaggttggtaaaatactggaagaggccttatccttaaaatggactatttagcaatggagaaacaacagaattttaacaaaattagactccgcattgtaagaaccgtacagagttttaaatagtcagtgctcccagttctctatttaaaaatgtcattgaggaaaagggactcacgtaactctgctaagacattttatgcgcctaaaaagtgaagctacttttacataatattacgtagcacatatcacagggaagggggcaattttatttcattgctagcactacttagaagcttaagagggacgtaattctgattattcttagagaaatactttctccttaagagaagaaaatttttccttaaattctactaaagaggacaatttcaaaatccattgaaattaatagacatgtattgataactatttaaggtcatcctagaaaaggaagacaaacaggcaaaacctccattaatttgttccaaccaactgagtatgggaaacccgagggcaacatttcctggcttcgtcctttcctgtgtctgatgctccaggagaatcatgacgtgacacttcagccaccagggctgctgtgctctccaccgtaaggcaatgaacttcatattggcttcagcatattatgagactatattatgaccatattatgacactcttatctttggtaaaatgataattaagcatattgtctttaagtttcagtaggcatatttaaaaaaagaatagaagtattttggaaaattattttaaagaaatgtgattctctttcttaacactaccaataattagcatatcatcttaagcaattatgagaagaatgacgtgaattaagaatgtattaaatcatttccaaacagaattcagtaggtcctttttcttgaatatttttccttaatgtgatttttgaaataattttgacaactttttaacttccacattttctttaaatataacttttattccttttactgtattatttcatgaaatctattttttaatagaccaatatttttaatttgttttgatcaaagcactttgctggttgaataatcattataagtagaatttaaataattacttctggacttgccaaaacacaagttttttttaatatttatttctctgaatcctttattactcttcctgtcactcctctctgtgtggggagtatcttatacatagtgggggtcaaagaaaagaccactgaggaatgctgtgaacatttttgtgacttgttggttattgcatagtttgaacaagttgtgttctgaatattttaaccacataattaactcaaaggcccttgtgcctaaaatctccagccataaattatacaagtcatattgactgtttgcaggtttacagtaacaagtaaacagaaaatttgaagtttcacattatgtaaataaagtataatttacctatgtttacataatactttgctaattaagctaaaaaatcacatttacataaaaaataatttatcctatacaatttaaataaaccaggttttaatttccatgaagtaaatacaaatgtagaagaataatgaaagttaaattttatatttaacgtgatatttagaaagccaaattgtttaaagccaacagaggtgtacaatttttaatgcactccccttgaatctgaatatctgaattaagatattaaatagaagttacatagatgttatgttagctcatgattcaaaggaatatagtgaaattttacatactacgagttttctcttttatatagaacaccacattgaaaaaaagtggcagaatatcggtatgctttttccctatttgaaagtcgaatttaagccaactatgattgagaggagaaagtgaattttaaaaaggaaagcaacagaacggccgggtgcagaggctcacaactgtaatttcggcactttgggaggctgaggtggaaagataaactgaggtcaggagttcaagaccagcttggccaacatggtgaaatcccatatctactaaaaatacaaaaagtagctgggtgtggtggtgcatgcctgtaatcccagcaatcgggaggctgaggcaggagaatcacttgaacgcaggaggcagaggtttcagtgagcccagattgcgccattacgctccaacctgagcaaaagagtgactgagactacatctcaaatagatagatagatagatagatagatagatagatagatagatagataaagaaaaaagacaaagaaaatcaatagaatgcaccagagagctggtgtgaaggacagtgtggaagtgacgctgtgtggatggaggaaaacggcttccccaacagatggtgcctccgtgtgtgggggggatgaggggacacagccgtgcacacgaatgtggtgagcactctttggagccaaacctgggtgtgagcttggctgcactagctgccctcgtaacctggacaagttgactgtttgtaaatcaggggtgatctactgggggaggcggtagggaacaaggagaagaatcagcaggcgactgtaggaacccaggccagaggtggctgtgagctggactcatgggtaacagaggaaagagtgggtcatatttagttttgagaactatgttggcaaggcagggcggtcaggtgtgtggatttgctgtgggaagtgaggtagagggaggaatcgaagatgatgcctggattaacgctggagcaaccacgcagggtggaggaatctaactttcagattaaatagcttcagtgggagattcttgtagacgcccacatgaaaatagtaatggagcaccgtgctgtgcttgtgtaggtcagaggagaggcgtgtgtcacacatgtggggacacacatgtggaagtagcgaccgcacttcagatgcatttacagacggagaggaaacgccggcttctagagagacagggcagtggggagcctccttctccattcagacaaatgatggaggtgagatgctgagctaacactgcgcatggagtactggataaacaggcctgccagggagcaaacgcttatcaaggaaataaaggtgaagcatagttggtgatgtgtttggggcatattgtgtatgttaaaagacagattgaagaggatactggagagacatggggaagtcattgaaggttttgaactgggaatggggagatagtgaataaagtattcaataatatagtattatacaggtggactagaaatggagagaccatggcaacaaagatcttgagaaagtcatgtaagtagttgagctttgggctaacaagagcttggattaatgtaactgcagaggaaacaaagtgacgtgacggatatggaaagaacttgggaggaagagaggtaggatgtgctgagaagttgttggggacggatagccacagcgaacacaaactggtttggttacaacgtactgcctctccttaactcaggctgatctttcatgttccctaagaggttcctccgaggagattaaaatgtgtaacctttaatatcaattctgttattacctgatataacatttgccacattagcagcttcctgcattgcctggttgtatgtggctgatgtagaaactaaaacaaacaaaaaagtaaaaaagaaaaaaaaatgacaatagtgcagctagtgattgtagttctttcttgcaatttgagcattttgtatttttgtgttgtttttcctattttccgaaatttgaagtggaaagaatgtccccactagtatcaatgtaaacatgcaacttttaaggaactgggaataaatgtatttgggagagtcaaagaaaaccaagaaacaaagtaatgtgcacctgcagagctgcgtgtgttatagaagagaaaacatccacattcaacaactgagggttcttgtaaaattaaaaggttatagaagctatgatgaggtgcatccgtacttcaatttgttcaagtcacgtagttttatttctctacatagtcctattacgtgaattcagttctaaggttttatatatgtatttgtatgcatgtttattcatttgtttttgcattggaatgtatttaaaactttttaaagtgttgaaagctaaactatcaatgttaagagtagaaactttatacacacatttttgtttcagttatttaaatgtatcattcctaaaaagattcatgcctaaaagaaggacaaaatatttcttaaccaaaaacccagagttgtcagaaacataggaaaggataataattcatgggtataatgtgtggtgtgttttgttcttgtaactacagtgttgttttatgttatatgttatcacaagactgttgttggatggttcctcaaaaacatccagggtcctagatgttctataataggtgagggctgactaagagatcagtttttctcttcaaaatggaaccactgagatgaaactcttaataattataataataataaaaagcaaccgactttccctgctagctcttgatagcaagcaggcccttgggatgccattgtgctaggatcaccacatttgtctgcagaggaaacaacccagaaataggacagcttggatttccatatggggctcccagacatggcctagtggatgcctatggctctaatccagacatagagtgaaaacaggaaggaaaaatgcaaaccagatgatccccatctaaaatgtaagaatctttgaggcaatccccataggctcaaattatgagacagccaatgactacttagaaaaaactgagaatgttaaatcctttcttaacgattgataatgcacgccactaaggataccttttcttaagtttgtattgtgtaatctgatcaattacaatgaaagatatcttaaaaatctttactaagatatttagataagaacataaggcaacaaattcagactttccaaaagcgtcactcactaatccataggtaatcatctgagaaaataaaaagaatattgtatgagttttttccctgcaatttagaagacacttgcggagttgcactccgacgctgtcttctgacccatcattcttgatatatttaatggaggtgtgtgtctcaggtaaaggattcctgcaaagccatcttgcaattttaaagctctcagttgcctcagttttatacataattgcagagcaaacaccccaaaaacaaacgccatttagatgtgtgagccagtgagtaaattcaaagggatgggcagagataaaatctttgaaaattatttttccacccccatctttttttaattaactgatgcctcattcataaatgtttactctttaattatgtactacaaaaagaagcacggctgtgccttcccctctctgcactctgagctgcaacgagctgttcatttctttctgtcatgcttaccattatatatgctcaataagcaattgctgattgaatgaatcaagtagcttggaaggagataagtcccttttgtagtacaaagaactggaaatcagaaaactagattacagtctaagctctgtcttataaaatgggtgatactgaaacacttattttaatttgcctcagttgacacctttataaaatgtgtaaaagaagaatgcttaccacacacgggtgttataagaattaaacagaccacacatgaacgttgtatacatatacgctaaataaagcatctttcattaaagggggttgtaataatttgtgccaattaagaaagatttagattccctttgaatgtcttgttgcccctggtgtgttcagattcacctcaagacagaaagtcagaggactactcagtgcagtatgattctagtaacacccagattgattagcttatgttggagataagctatctgcaacatagggattcaagtaaaaaactttaaaagatgttcttgtttaagacagtgaattttagcccttggaattcagaaagaacattcaacataaggttaatacttaaaaaacaaattcagtgtagttgtcaaattctgggtaagtacgaacattagttttagcatgattacaaatgctgtgggtgggttatgtttgccctgtctattgtttcagacaacgttctattacactactgtgtgactacgtctatccatggggcttcatcagctgaacatttggaagaaaaagagcatcatatgaaggtaaagttaatttctgtttgatcatggtatgttcttattttttagaatctgtggatcagatggaaatgaactctgtcaagagtgatttgcaggagttcatataatttttgttcaggcacagagaatgctcacttaaagttcttgttaaaataaaatatctcaacaacaaaggctgaattaagatgatctttcactcatcagatttcatataaaacccttgtaaattagaataacatgttttgcagctttagaataaagctaatttcaacacaattctatacacatactttgaatagaatctaattatattacaataaatacaatgtacttcagatgtaatggcatcagaacaaaaggcaagtaatttggaacaagaacttcataaagtatcacactgagaataaatgcgtatcataatagtgttgatcttcactattttttttctacaaaatttaattttccaaaatggatttgtcatttttttcagggtcatgttacataatatgtgcaacatgcatcagacacatattgttccatgttggaagttgtctagctcctgtgttttagttttaggccagttacccagctgcgaagtcaaccacagagagctgagaaagtggattcagtcagtggattcggcctgaaagattgggaactcaacaccctctctaaggttcaaataagtgaaggtagtgaaataccccatttctacgtattggtggtttttaattcttcactgtcttacggcaaataaaggttctcatctctgtagcacctactctaggtttatttccattcagcaatatttatcccttctgctctcctttgtcagacagggatagaattgcagtcattactaataagaagacaatgtcataaaaagttgtctcttctcatcactaaggctatgccataaatcttgctcactcattcatttattcccgtccagaaagcactgaggaccaactgtgggttagaaccagtattagagactggggtacaacacagaaaaaatgttaaaactgttttacaattttcaaagaggtaagaatacacatgaactctcttagactccaaacaactcttcagctgaattaataacaaatgtggatgcatgtgacacatctgtttttttcttcttcattctagacattattttcatctgtttttttctttttttgtccatctctgctaccagtggattccttctttcaggccccaaccatgcatatgtcttatttatctgaacacacacacatacacactcacacacacacgcacacacacacacacaccatttctaattccttccctcttcaagtgtctttctttgttctgttactttcatcgcctctatccttattatctctactgaattacatgaaggagctatactcactttctcccattttcaacatctgttcagtcataaaatctggtaatcacgcctcacctcctatcgcttacctgaagctgctttctaaagccttgcaatgccaccactcagttctaatacaccattcctaagcctccaacaatcatcttccacagtgctccttccagccttcaatgctgttcactacggattgtgccattatgagcacctttgtgaacaaactgaagtactgtttaaggcatggcatatatcaatcaatcaaactgttcttcaaaaccatcccccaattaaaaaaaaaaaacctcactttcttgggttcagaataaaccaatgcagtctgcttatttaaatacaaacaaacaaacaaaacctcttcttttcttttgggactttacttgctttctcccctccttaaaactagaacctcttcctgagttaatctcccagccacttcccttatgatagtactgggaaggctactttaaatccctgattgtatccacatcttgctcccttagaacatccttcttttccgtttatttaagttttagttgtactgggaaccagttcagacatggagacttttctaacaaaaaatcaacaacaacaacaatagtgaataaaaatactcatttattttacttcctaatacagttgtctaaactctcattcatttattttcatttttatgacttccagaagaagatataatgtaataacgtgagcatgcactttagaatccaagaaatttgggttaatccagactcctactcactggctttctgactccggggaaattacttacttttcccaataccttggtttttatgtgagtaaaatggggcatatactaccactaccttggggaagggtgaggattaaatgagattatatagtctctagcatacagatggaaaacagtaggcatgcagttaattgtcatagtattcatcctttttgtatcttattagtatcttttaccaaatgaaaccttcaccaaatgaatgcctcgtgacttctagattctggcagcattcctccaccacccatctccttccaccttccctgtgtctagtcagccaactactctgtagcccgttcaaagcagaatcaaattcactatccttttatctccaaatgttgcttaacttttctaagccttagtctcatcaactataaaatggattaaaaatgggtatcttatagaagtgttgaaggatcaaatcaaagaatgtataaagagaacagcatcacctgggaggtggtaagagctcaaaatatacagtttccaccgtgataatggggataagtatgtccatcatttcgatgatggaaaaagggtgctgaaattgccattcatactgggagactctttaatttttttcctcataaacttccacactgctgttctagggagctgcaggggactacataaatgaagtcatcgatcttacctttagagtatggtgccaaaaaataaaaagttaaaagttaaacatgtataaactgtaaaagcaagagcctcagagacttaaaaatatatgttagaaagcctccatttatacaagaaataaagaacagaaagtggtgtatatgaaggtggaaatgctaagaacccagagtattgtctgtaatcactccatcagcacaatactgaaatctgaactgcgtagtcctagaaattcccaatccacgcagcctgtgattgcagaatgatgcaaaggcagatgatgccagagacgagacggcgctgggttcagaactatgcatctaccggttaaccagcgaatagtcttttaagggcctcagcaggacacttaagaaccactctatactgtctatgagtccatctgaatacatctatatgcctacatacacgtatgaattcttggttttccttttgttttttgctgtttctcccctgaggttaactcattgcaacactttggtgttcttccaaactcccatgttaaagagtttcacttgaacagctgtggaaggaaagacagtgcaaatgggcagccctaaccaataccacattccatctggggccctgacaacgatcccactcaggttggttgggcaggtgaatattttcattggctgcacagttacccttgtgctctgacactgtcaaaacaaaaggtctccatggtgcagctgtcctcagtcaccctgcagtcaccaaatatgccgaccaggaaacatacctaaaaaattatggatgtgtaggaagtttcttaattttacagaagtacattttaaaatattccaacccaaatgtaggaggaccttctgaagtaccttggctcattttaaaagtctttccaaatagaatgttgaatttatgaaagtgatggtaaccaaatgattgagtaatcaaaccacattccagaggagaaaagcaaactgggccaatgataagtgaaagcttttgcttaggacagcaaatgctgggtacagaagtctgtgagttcaaagtgaacggagaattactcactccgcacatctctgaattgaatctgaaaattcaaattgcaattgcccatcatcttgttaacaactactatctctcctaataatgtacagcattttcccagtggacttgctgttagagcttctaatagagaaaggaggactcttgaatcccatggtgttggggactggggacccggcaatagctgagggattactgtcacagatatgcagaaatcccaagtcagtcttctgagatcagcaagttttacctgcgctgcactaatttctgaagtaatgctcattgaaacaaataagaaatatataaaaacaaaaacaacctcaaatcatgtaaatgacttactggttttgtttttctgtgttaaatgctttattgtctcttttgtaatttaggactcatgccccttgcccttctgtaatgttttgtttttagatatgctatactttacacattataaggaagatcagagaaatcatgatcttagctttttctattaattttaaacaaatatgtagaatttttgctttgtttttccttgcaagagaaactggacattggtaacttcgtaaggttaacccctctggagaatattctccctgattctgtcataatagatttaagaaagtccttggtcagtttcaggcagatatcaaatctgtcacttgaggggcagaattctttgaaaacttagcgacaatggggaggcttatggtcactgaaatgtcagcttatcacaggaggctgactcccaggctgaaataattcaatctaatgtaactcatgtctactcaaatgcctcctgttcttggccttttaaatgttttttgctgtaaaactttaaatactccaatattcaggacatttactgataatgttctcctaaaatgtatccaaaagattttagacaagatattggaagcagatatttttgaatttaattagtccaggacaacaaaaggaagatgatttttctccttcagcagttgtgtgcagcccgcattcatatcctgcttgatatcaggaaggaatctatcctgagaaccagcgcccttacctctgcagtctaaaggttatagcaaagtgctgagtgctggagtcacacatttactttaaaaataagtgacaaattccctgataactttaacacgtgcagagccagcaaataaaaatatttgtattctaaactttttactctttgacattgtgagttgactcagcgggtcagagaattatgttacatggttgtgcccttggttttgagctccagacagttctataaagtggattctatctctgaacacgagttaacagttattttgcaaagtagccacaactgtgagccagtcagcacaaaaccagtaacagcaacattttctaacaaaaaggtaaatatatataattatatacatataaatctatactgatgatcagtgtatacatacattatatatatcatactgaaagtatgacgtgtgtgtgcatatacacacagtgatcatcaatattctccagagtagaaaaaagttggttttgaattccagatctccaatgattttcagggaaccattggccaaattctctatcttttctaaaccttggcttttttgtctgttaaaaaagggtaccataacatccacatgattattttaaaaagggttttacatatatataaataaacatataaatatatataaatgtaaatatatatacacacatgtaaaactgactgcatcaaagtttgatacgatggatacaaaaaatgttggactcattcagatattttcatgtaaacacttgtgtagtcttaaggatctttaaatctcattaggtatctgatatgccacatttttacatgattataaactggagtgaatgcttaaaacccatgataagagttcctttatccaagacttgatagtaggaaaagctgaaacttcttatattacaaaagttacctgcttcaaaacagaatgacagaaagggtaaattccatgacagcctcttcataaaatgctctaactccctggcagcattgtctggtgctatatctcttgcagttaatatttgttctctccaggttcccaaggccaaacagctttgtgcctgtgttgcaacattcactcctcaaaccctgtgctgcagacgcgtgagctcctgatgttctaagagtgccccagctgcacacctgcacaggcctgtccctgccccagcctggcccttctgggcattactcaagtactacaataggttctccctcaagacacacaaatgatcaagattgacctgtcccacagaagcagagtgttgattcagtccctcgtctgcagcagttactgtccttgattttcactggaatttagttcattctctagggtcatagtgtgtgtgaatgtacgtgagtgcggatacacatagagacatagatacataatgatttatctcactccatcttttcttttgagttctaagcacccatgtgcaaggattggtgttctccacatgagtgcttagaacacaaaaggcattaagactgcacactgtgaaaaaatgcacagggcagtactacacacacacgtgtacacacatgcacacgcacacacacatgcgcacacgcatgcacacacacacacaggatatgtgcactgaatgtatttgactctattgaattttcttgctttcacggattgaggccccaccctcccacaccctaaatttgcaacttttcaaagccacttttctgttaaactgtaaataaatgaattaataattgcatgagaacggtctgaattagagtgtctggaatgaggctagtttgtcatacatgggaaagagctgtgccacagactagtaaaacagcacagttccaggcggtttcacacaatagctggcaacagtcccaagaggaactaggtcagagcccggggaaaagcacaatccggctttccgtttcccaggaactgctggctatttgctgacctttacgaagagtgtctttaaatgtttccttgagatcaaagcctctgagtgcttagccttacatttttaggtattactttttcttttgtatccattaagatcaatcccactgtgagtgagaattacacaacagtagtttaaacatgcttgctcacagccactgccaattcgatcataatagaacagtttcacattaaaaaaaaagcaattcaattaaaaactacattatagaaatgctaagggcctaattccaactaaaggcagcaatgaaatttaaagtaaagacagcaagggagggttttaatgtgtccttagctccctacatgtaatacacaatcactaataacgtacaactgaaaattagatatccattccatggatgccatacatcctaagattattccaagggcagaaaaagctcacataacgtcaaaggaaaccctaaatattgatcaacggccgtattcaactgtaaggtggaattttcattttaacttcatttcattgctttagtgatcttaatcttgtaacacttctgaattttttttttatgtttatatgtgctttagacatgtaactatgaataagaaggtgtttatagaaaagtatttttaggaaagagcatggacactggttaaactcattaatgatgtattcattcagtaaataattatatactgaggaaactatgttccagagatggttctaggcttcattaagcttattttctgctggatgcagacaattaaaaaatacgacaaataagcaaattcattgtctatgagtaggtgatgagggctacagcagaagaggaaacagggaaagcaaaggggattggagtagcaggtggaacgtggtttctgaccccattagcaggtttacctgtcatattagcctaggctggggtaccccatggcaagatcaacccacagctttctggatcgtagtaaacataagcttatttctcactgaagaggctcctctacagcgttgaaaagtgtcctttccactgagttacttgtcaccccttttgctgaggccatgaccctctgagcttcccgggacaacagagcagacaggacacagctcggctctgtgctggcccctgcaggcttcagcccaaggttcggtgcgtcctgaatacctgacctgaattagccacaagtcccaacttcaccacaggaaaatgtagagcaggagattgcatcttcgggtgtgccaccatctccactgcatcaaggtaggccagattttaggggtgccaggcaggagaaagagctatgtagagtctctgaggcaggacaacccttgtgggtggagggaaagtgaccatcgatttattacatgtttctctggtgagtacagaccagcgtctgtgcctgatggacacccggagatctatgagaggaatccagcattgggtcagggagtgatctataaacttccgagcaggataaacacaagtattaatgtatgtgtttctgtgggtgggaaaatacgttagagcttacctcaaattctaaaaggaagtatccacaatacctatattttttaagtcaaaataaagcattcaattacaatgctgcataattgatctggtaaatattatacaagtcatttccatatcaaactctatagaattttacacaccaaactctcagctttcattctctctgcattgctcttgagtaaccctgttcaatagaaacagaatgagagcctcctatgatattttaaatttaagagaagccacattaaaaaactaaaaatgtgagttaataattaaaggtgaattaattttacgaatatattttattcaccaaaatatatccaaaatgtgatgttgataggtattcactataaaaacagtaaaacattttctttatttcataccaagtctttaagatctgatgtgcgttttatacacacagctcttaagttcaacaacagaccccgcacagctagtgatcagcggccacagtggctgacggcgatggtctgggagagctcaggtctacaccagcacacactatccgaagtcagagagaaaagaaaaactgccccgcatttcttcaactcaagtcatcgttaatatttaaaaacaaatcaataggcttatttataaaccaaaacgcgttgtggttctcagtttcacagggagaagctctacgtcagagactcagcagatgggccttagacaacactaacaggagagaaaattgtatgagagctgccacatatcacgcggcacatctccaagcaggcatccatgtcaacgacaacatgaacaaggtgataatgacgacagaaatgaggactaacaaccaagcatagtactggttctactacacacaattccagtcaacttcagaaaacaaatgcaacaaaaaggctgaaaaacacttgcactactacagagctagaagtagctggcgccagaatggaaacccagttccagctgattcaaagtgcttgccatttcaacacgctgcactgcctcatttagaacttcctgaaatagagaggatttccattcaggaataaagctccttacaaagccacctgtagaggataaagtcctctctatacaaaaatcactcgctccacagcagaaaatgtcttgatacacatcacattggtacggatttgtttaaagcactggataatgattacaagtgaaacggatatttcaaacaccgaagaattccatgtctacagcactaattgatatctgggctaatttttaagctacaaagtagcacctgctggcttctaattataagcaagcgctttgtgaatagctgggagtatgagcgactcaaactgcatgtacaatgagcaccaccgaaagctcatttgaagtacaatccatcatctgtgtccaacatgacagggaaccgggcagcgcacacgctccatcagatgctgtgattaaagggagggacgctgcggtttgtcacatgactgcacgaggctgtcaccacctgctgttaataactgacaggcaatctgagcctgctttataagaacgaagagacaggctgcacattctctctgatggaaatagaaggaattactcactctttcatcttcctaaatacaaactgaaacaaataacattttcgtcaaagttttgccccctacggactgaaaactgcagtaaaagtagcattgaccggggagcttagagaagtagaaagtaagggaaagacagaaagactgcaggggagagagagagagagaaagagagacagagacagagacagagacagagacagagagagagacagagagagaacaagaaaaagacggaggaggaggaggaggagggtagggaaggggagaagacagaagagagacagttttatttttattaagttgtatcagactctatgggaaacaaatcaagcttatgtgaagtccttcgtaaacatttaatatttaatttctataggttgagttgtttcaaatgctgttgaatgatctctgggaagccagtaaactcatatgacaattgtaaaaattgggtgttgtatgatgattctcctggcatgcaagatctcaccccgggtatctgtatcaagaactactctcgaccatgttcatagcatacgacaaagtgactgccatgttgttcatcatttgctcatgaagggctctgctttaaaagcatcagatttagtggcaagtgattgctcttataaatgcagttttaatttgataatttatttgtaaccccaactgttttcccagaaatcaccatccactgatatgccatccctttagatttccacacggcaacagcacaggttcccggcccgagagtctcagaagagccttttgaaatgccacctgacactttcgacaaattattttcccccttttagaacagttaagcagacaatacttaaaataaacgaagtgtatgcataccgacttttgttacatttagtttctaggcagctcattaagatctgaaatatcttgattctaaagcacaagctcctaagtagcatggcaaagaccagcagagttctgcatatgcatgcacaacatcagcctatctgcaagaatttgtcactttagtggaaacagccagaaatcatttaaaaaactgtgacaaaaaattccatcgccttagaaattgtccatttatgtataatttagaaactacagtttttccgaattatctggaaaggattggtttcaggacctccatggatacaaatatctacagatgctcaagtccgtcatataaaatggcatagtatttgcatataaccgcatccattctccctatatacattaaatcatctctagattatttataatacctaatacaatgtaaatgctatgtaaatagtgttatgctgtattattcatggaataatagccagaaaaaaatcctgaatattttcggtatagacacaaccatccattttttttctgaatgtttttgacccttggttgtttgcagaacacacagatatgaaggagcagctgtattttttttctatattcctcaaagctgagctatcattttcacgaataaaatcttatttcatagatttactgggcatataatatagtgacctagcaaaaataaagaatcttaatcacggtgaaagtttcatctatttgggaattgagtaccacaccactaaatatgtaaccctactttacaatcccatacatgctgtgcatgaataagtagacttattgtcagtagtcactgaagttttcaggcaaaattgaccatcatttcccagtcaatgtctggaactacgcaggagcatttgcctttggatattgttggaatcaaaagctctagacaacatcattggcaaccttgtaagtttgttgtccattatcattaaataattttcaagatactccgaggcatatgatgctatgaaaaatcttaaaacaactatgtcttatttttaaagtgtcatgtaacataagacagtttgatttctgtggtcattgactgagagactaaacaaaaagggtgttaccataaatacttaaaacagagtaagataaaaataagggagaggtccaagacagtcattgtgctttttctcataataaagttcttttccaggcaatttgggcacagaaaatgaaataagatcatgacaatttggtgaataatactctatgaaaaagtccaaggactaactagaaccacagaatcatcctgtgttaactaaaatgattaagataaactgtgcccaggctagactgaaacttgaagtcacccaatgatcacgtggaataataagctttcctccagcatggaaataacggtggagttggaaaagtgtcttagaataataaggtttaaatatgcaaatctgccatttcatctggatcacatatctaaagaataaaatttaaaatctagagaatatagatatgaaataaaataaaacaagactgaaagcttggcaacgaaacaagtcatgatatactgtgagaagcaattttaatttatttatccaccatttcccaggaacttgtgaatttttggcctctaacttcagcctatggatatgtatgtttttaatctaagggaaaagtcagccagcagaaagagtcaaaaatatagtactctggaaatctacattttcattacttttcctttaagccagatccctctcataaatactccaagaaatgttaacttttcatatattattttcccctagcgtgtgcaagttaaggattttcatttgtatttaatttttaaacaattttctgactagtttaatttttaaacagatttctgaaaaccattttgtactttctccctaatatatacctgatatatacaggtgtgtgtgtgcatgtgtgtgtttctataaagttacctaagaaaatgttttgctgcttataatttcagggttttttttcccctttctcatgctctcaaccatccagaggttcatgaactcagattacagacattcaaacgagagatattttcaagaatatgtatgtttttaaatgttctgcttctatttctactttttttaaggaaatcagagacttttttccttgaagagtactgaaatattattttcttatgtcaaaagacataaagtgagacaatgacattctagaagtactcagctgatcaattaataagtattacagtttctttctaaaatgcaatctgagctggaacaagctcactaagagatgcctgcaatcagggactccctgcgaaaggaaataacttaataaaccttgcaccgcatggaaaaatctggtagaaatctagtatctttcaaggattccttctacaaagttttgttttgctctggtttggttcgtacactctaatgatttcggacagaaaagtttccctgttcccaatatttttgttgatatttgtgttatgtttgtcatcatcttttggttccacgtctttgctttctattatcatcagtcagtttgttttagatatagatcagtgaaatcttatgagcagaagaatctgatggctgaagaaagaatctgctgttacgaaaaaagaccttgggaaaagtttattgatgaaatacacatggaaataaacagtattaaaaaagtatgtatctttattatagaattatttatattccttaggatatatacccagtaatgggaaaagcacatgcacgagtatgttcattgcagcactatccacaatagcaaagacatggaatccacccaaacgcccatcactgatagactggataaagaaaatgcagttcacatacaccatggaatactatgcaaacataaaaagaaatgaaattatgtcctttgtagggacgtggatggagttagaagccattatcttcagcaaattcctgcaggaagcaaaagacaaacaccacatgttctcacttataagtgggagctgaacagtaggaacacatggaaacagagagggcaacaacacacactgggaactgttgtggggcatagggtgagggagagcatcaggataaatagctaatacatatggggcttgaatcctaggtgatgggttgataggtgccgcaaaccaacatggcacatgtttacctatgtaagaaacctgcacatccagcacatgtaccccagaacttaaaataaataaagtatggcaaaagcacagtctctgtaattttacatacatagttttttattgtattattttgtttataccaagtcttttaaatgacatgaaatgtataaaaatctactttatgttaacatttgcaattttgtctgaggctagtcttgaaataaaaggaaactgaaggaaccacattagcccacaagatcaggggccccttcaaagtgctgggcatccagagcttaaaagagctgggcagtctatagctgctgagccataattatcaagaaccagtaacacctctttcaggggtgtgaagctcacctcctgaggttcttagaaggcatcaatgaatgtctctgatacacctttctgtgcctgctcccgcacatttacacagactccaccctggcaacggacacaggcctgtgatgaggctagggctccatcgcagagaacccatccaggaagaaaatgccctgacaaggctgagcttgccagtaaatatttaataagtaaaagaggatgtgttccctccccattctcccctggttcttccaccctcctgccaatggagtgacccatcctgaatacaggaagtttggaaaagacatcccaaactggacacagcacgtcctgctttctctgttccctcttctggggaggctgacttcacagtctgtgcgtgtatgagggctggttctcagcaagcagggacctgtccaaaggggatcctgccccaaatcccacaaaccccagacaagcccctatatttatatatgagggtttgcaagtgatatggagatttaattacatgtttaaaaatattaaacaatatatccttaaatgctccagcttatggctccaaacgttagaattttatacacacagacataacttttgtttatggctcttcactgtattgcactttgctgatattgcgtttttaaaaattgaaggcttgtaccaacgtggcatcaagcaagtctattggagccatttctccaacagtaagtgctcacttcatccttttgcgttacattttggtaattctttcaatatttcaaaagttgttgttattatatctgttatggtaatcagtggtcaatgatccttgatggtaccatttaaggtgttttggggatgccacaaacacccccatgtaagacagtgaacttaaatgattaatgtggtgtgtgttcttactgttccactcatcagctgttctttatcttactctccctcctcgggccttcctagccccagagacacaacaatattgaaattcggacagttaaaaatcctacagtggctcctatgtgttcaattgaaagaaaggactgcacatctctcattttaaatcaaaagctagaaatgattaactaagtgagaaagacatgtcaaaaaaactaggcctgctgcacccaacagccaagctgtgagtgcaaataaaatgttcttcaaggaaaataaaagggcttttttttttttttttttttttttttttaaatgagacagtatctcgctctgtcacgcaggctggactgcaatggtgcaatcttggctcactgcaacctctgcctcccaggttcaagcaattctcctgcctctgcctcctgagtagctgggattacaggcacgtgccagcacacctggctaattttctgttattttagtagagacagagtttcactgtgttagccaggatggtcttgaactcctgacctcctgatccacccgcctccacctcccaaagtgctaggattacaggcatgagccaccgcgcccagccagtgctactcttataagtgcatgaatgagaagaaaatgaaacagccttattggtgagatggagaaagttttcaagttatctgcataaaacaccaaaccagctacaacattcccttaaaccaaggcctacttcagagcaagctcctcattttcttcaactctatgaaggctgagagaggtaaggaagttgcagaagaaaactccgaagccagcagagactggttcataagatttaagaaaagaagccatctccataatataaaagttccaggtgaagcagcaaatgtcaatgtagaagctgcagcacgttctccagaacatctaagatcattgatgaagacggctacaataaacaacagattttccatgtagacaaaacagccttatgtaggaagaagatgccatctaggactttcataggaggaaagagggtaagtcaatgcttggcttaaaaacttcaaaggacagcctgactcctctattaggagctcatgcagctggtaacttttagtggaaaccaatgtttgtttaacattttgaaaatcctagggctcttaagaatgatgctaaatgcactctgcctgtgctgtctaagtggaaaaataaagtctggatgagaccacatctgtttacagcacggttaatgcagtattttaagcctactgttgagacctactgctaggaaaaaaagattcctttcaaaatattactgctcattgacaacacaggtggttacggaagagcttggacagagatgcttaaagagattaatgttgtcttcatgccagctaataaaatatccattctgcagcccatggatcaaggaataactcaaactttcaactcttataacttaataaatgcataagtctatagctttcataggtagggattcttcgatggacttggtcaaaataaattgaaaaaccttctggaaaggattatctttgctagatgccattaagaaaaattgtgcttcatgggaggaggtcaaaatttcaaaatgaataggagtttagaagaagttgattccaacactttacagttgagtttcaagaatataataagacttcagcagaggtacctgcagatgtggtagaaatagcgagaggtaaaattagaaggggaggctgaagacgtgactgaattgctgcaatctcatgataaaacttaacagatgaggaattgcttcttccagataagataggaaaatagtatgctgagatacaatctactcctggtaaagatgccataaacattgttgaaatgacaacaaaatatctagattattatagaaacctagttgataatgcagaagcatggtttgaaagaattgattcaaattttgaaagaattgctactccgagcaaaatgctgtcaaacggaattgaaacctagagataaatctttcatgaaaaaaagtccatagatgaggcaaaatatcaatatctcattttaagaaattttcacagctaccccagccttcagcaactaccatcttggtaagtcagcagccaccaacattgaggcaagagcttccagtagcaaaaagattatgactcactgaacgcttagataatttttagcatttttggcaacaaaatattttaaaattaaggtatgtacacattttagacataatactgttgcataaaggttacactactgtgtacacataattttcatatgcactaagccaacatattcctatgattcattttatagtctaaaactgaatctctgaggtatgcctgtgtttttatatataatgctttagacgtatttttttacaactaaaaattatcttgaaaaaacgtaggattctttcacttttgtcagctaattcataatttattatttggctaataaggaacttaactgatcatacatttttaaataaatatatacgtgatcaaactccacacttacctgaatgtttatatgtgctttgcccataattgctaaaatttggaagcgaccaaggtgccctgtaagaggtgagtgaataaactgtgggacatcctgacaatggactgtcaatattcagtgctaaaaagaaataagctatcaagccatgaaaagtcatggtggaatgtaaatcatatttctcagtaaaaaaaaagccaatctgaaaaggtacatactgcatgatccccaatcatatgacattctgggaaaacaggaagacagaagaaagatcagtggttgccagtgactgggggcagggagaagtaaacaccaagaaaacagggttttcattattttatttatttatttatttatttatttatttatttatttatttatttatttatggagagggagtctcactctgtctcccaggctagattgtagtggcaatcttggctcactgcaacctccgcctcctgggttcaagcgattttcctacctcccaagtagctgggatttacaggcgcgtaccaccgcacccagctaatttttgtatttttagtacagacggggtttccccatgttggccaggctggtcctgaactcctgacctcaggtgatccacaagcctcagcctcccacagtgctgggattacaagtgtgagccaccgcacccaacataaaatagaatctttaggacggtgaaaccactctgtatgatactataagggtggatacatgtcattatacacttgtccaaacccatggaatataccacaccatgaatgaaccctaacgtaagctgtacacatcagatggcgacgtatgagtgcaggtgcctgaatggaacaaacgcgccatgaatgaaccctaacgtaagctgtacacatccgacggcgatgtatgagtgcaggtacctggatggaacaaacgcgccatgaatgaaccctaacgtaagctgtacacatccgacagtgatgtatgagtgcaggtgcctggatggaacaaacgcgccatgaatgaaccctaacgtaagctgtacacatccgacggcgatgtacgagtgcaggtgcctggatggaacaaacgcgccatgcagcagggcaggtgttgctaaaaggggcggctacgtggagaggcagggggtgcgggaaactctatagtctgttcggttttgctgtcaacctaaaactactctaaaaaatagggtctattaaaaaaaaacaaaaagcacctggcatttactgtacaatgtgccagaaaaagaataagctttctgaaatcagaaagtgaggtactcgaaatgtgtaccatcctttgtcttttccatgaagtctgagaatcaggctggtaagaggctacacctagtgactatcttcagtaagatggcctgacgcttaacctttttttttcttttcgcagtttggaaactgtcagtagttaaccagaatgaaatctggcctcctttctactcccttttcccccttgagctttgttttttcttgctgccacattctagccaaggagaaaagacagacacgtcctcgaattatctgagtattattcatctcgatggttgctggaatggcttccaaggaccccctccatctcatggtcgtttctgtctgctttcctctcatctataatcccaaggaactcactcgaagcagcatgcgtggctggctggtgggatcctccttatacatcaccgtctgcctgtaccaacactgtcatcgcctcatgcttcataacaccgggacaccaggcaaaggagctcccaagctgaacctctgcctgccgcaaggtaaatacaagcaggaccgcatgctgcaatttcagggttatgatcgtcttaataaatgatgcactcaatgtgctataaatcatctccctccgaccaactctctcggcagcctattataatactcactgattgtgacagctaatagcagctacaataaatgatggcaatgattattttttacaaaggacttccagttagagaaaaggtgtgttaaaacgctgaagcgcccgcacttctgggtgccaaatagacagactgtatacctgacactggccttctctagtcagtaacttcatcacatagcttttagagaagtaagtttagatgtcaaatagatattcagaaacacaccaggcccattcagagaatgtcaggctcagaacgtatcctagaggacacctagttagaacatctcactttccaaacaaaagacagagactcagggcatgtcaaaaaccacaaaacaaagtagaggaaagacatttaaaactagagaaagaaattttcctggaaaagtcagggcaagtcaataggaaaaaaaaaaaaagcagtgtacaaaggacaagagcaggcacatgagaaatgacataggtaaaaaaaagtttttctcaagcctcttagtcatcagggaacaatgaagggtgtaacatcggccatatgattagacaaattataaggcttgtgtgtttgcaggtgtacagaatagtgaggaaacggcccttggcagactctcagtgggagcagaggggtgtgttggtacatttatgctggcaaatagctattaatattaaaaactaaatttttagcacatgctttgttccagcaactaaacttctgaaacatgcccttaagaaatgctcacatgtgaagaagttcgacctgtatggatgtttactgcagcaaacttaaaaatagaagctttgcaatctacccatctgacaaatgtctaacatccagaatctacaaagaacttaaagaaatttacaaaaaaaaaaaatcaaaaagtatacaaaggatatggacagtcacttctcaaaagaagacatttatgcagccagcaaacatatagaaaaaagctcatcatcactggtcactagagaaatgcaaaccaaaccaaaatgggataccatctcacgccagtaaaaatggcgatcatgaaaaagtaaggaaacaatagatgctggcaaggctgtggagacttaggaacacattttacactgttgatgggtgtgtaaattagttcaaccattgtggaagacagtgtggtgattgctcaaggatctagaactagaaataccatttgacccagcaatcccattactgggtatatgcccaaaggaatatgaatcgttctactataaagacacatgcacatgtatgtttattacagcactattcacaatagcaaagacttggaaccaacccaaatgctcaacaatgttagactggataaagaaatgtggcacatatacaccatggaatactatgcagccattaaaaaggatgagttcatttcctttggggggacatgggtgaagctggaagccatcattctcagcaaactaacacaagaacggcaaaccaaacaccacatgttctcactcataagtgggagttgaataatgagaacacacggacacagggaggggaacatcacacacagggacctgtcagtgggtggggacaagagaagggagatcattagggaacgtacctaatgcatgtcgggcttaaaacctagatgatggtttgataggtgcagcaaaccatcgtggcacacatatacctatgtaacaagcctgcacattctgcacatgtgtcctagaacttaaagtaaaattaaaaaaaaaatagaaacaaatggaaacaacccaaatctaaatgtcaacaggcaaattactaatcaaagtttggtacatccacagcagggaatgctaagtgaacattttttaaagaggttgatctactactgattttactgttttcagttagaaatcaagtcacaggatgatattgatgtgtcatggactgaatatctgtgtcagcccgaaaacccattggttaaactcgtaatcctcaatgtcctggtatttgtaggtggggtgcttgggaaataaccaagtttagatgaggccttaagggtgtagaccagaggataatagtagtgttcttctatctagggaggagaccaggacttctgctctgtctgtgctctgtgaggaacaaggaagcacacaagcacacacttgcaagccaggaagagagtcctcccagaaccacagtgggctggcagtctgatcacaaacttccagcctccaaacagtgggaaatgaacatccatggcattttgctacagcagcctgagctgagtaacaaaacgttctacgatgcaatttatgattttaaaactcctacacgtttgtgtatgtttctggagacacatctgaaagggttcgacaaagtacaggacagttgccggagtctggtaagggtagtgggagggtgagaggagctggggatggttaataggtatcaaaaaaattagtttaaaagaatgaataagacctagtatttgatagcacaatagggtgacggcagttgatgataatttaattgcacatttaaaaataacagagtataattggattatttgtaatacaaaggataaatgcttgaggggatggacaccccattatccatgatgtgaatactacacatcgcatgcctgtatcaaaacatctcacgtaccccataaatatatacacctattgtgtatccacaaaatttaaaataaaaaaaattaattggctgacagccatgactcctggggcataaaaaggatttggggtaaagaagggttttcaccttttattatatatacttcagtgttatttcaattttattgattacttagctataagataagattattttataaaatcagattcttacttagactaatgccaacatgctgaccgtatgcccatccaattgtttgttgagttttctctccttcctcctcctctctgtctcatccctgccagtcacttctcacacaaatgctagaagaagaaccaggagatcaattatttccaaatttctatatttggcatcttctggcgataagggataccaaaactggcgaccgggaggctttcaaatggcctgtggcctcacacttttgggtgccaaatagacagtctgtgtacctgccactggccttctctagtcagtaacttcatcacgtgacttttaaagaagtaagtttagatgccaaatacatattcagaaacactccaggctcatgcagagaatgtcaggctcagaatgtgtcttagaggacacctagttaaaacatgtcactttccaaacaaaagacagaagctcatgacatgccagaaatcacaaaacaaaggagggagaagtcttttaaaattacagaaacaaattttttctgttttattgtttatacaccatggaatttatttaggaattctgttcctatgtgcctgaaaatgtgtataataagaatacttttcttacatggtcatggacaaactatacatgaaacatgaaccttttgatggcttggtttattaaacatactagtttagtagtccaggaacaaaggagtttcttttctgactgggtctgtttgtcaaggtatttttattttattttttatttatttttatttttatttattatttatttttgggcagagtctcactctgttgtccaggctggagtgcaatggcacgatcttagctcacagcaacctctgcctctcgggttcaagcaattctcctgcctcagcctcccagctatctgggattacaggcacctgacaccacacccagctcgtttttgtatttttagtagagacaccgttccaccatgttggccaggctggtctcaaactcctgacctcagatgatccacccaccttggcctcccaaagggctgggattacaggcatgagtgtcaatgtatttttcattacagaattcacacgcccaccacaccggtcaagggcttctttgctatacttgcttctagttactttcctatttctcactataataatattaattgtaaccctgacagatttgttaatagaagtgaagcaattgtctaaaatgtaatcaatcttttatttttttttcaaaagagaagtaaatcatgtgcataaacacctagtttaaaaaaaaaaaaaagaagtgggaattcttaggaaactaagccaagattttctaatttcaaagttgaagagggttttcatcattctgacatacttcattctagaattatggcagcaaggataaaacagcattaatttgcacaaaattacaaaggtaatattacagtacatcacttattttctaattgtaacttagttccaaggctttgggggggacaaaaaaagcattcttttttcaatactccaagaaatttaaactattagaatgactctcagataccaactcatgaatcacacatcacactccctgattttatattaaatgattagtgaatttaaattttaataatgcttatgtatagatttactaaaatatttttaatcattaagaataattttaaatctataaactttattgtataactacatgttccttttaaaataaatttataaaatatatatcaatatcatagaaatataatattgtatcgtataggatatcagagatacttactacataatgtcgctaagttattttcctgacagacttgataagaatgacagtgactccaacaccgtgttaatgatagtctatttgctgacttttgtgagggaagtgcagttggtttgacttcgtacatttcttaagacctggttatttatagatttgctggtcataagacagctttgatgaccaaatattaagggatatttaacccaagaagaaataggatttactatatactcagtgccaacaatttgccaggctgtacaccaacatgatcccattaaatatgaacaacaaacctctgacgcagttagcaatagatccagggtggaaatgaagaaactaagagacacgtagattaagtaaactgtctaaaagagaaccagaaagtaccagccgcattttaaatacctgccagtcaccccgtgctttcccaatgtttggaggacatcgcatgccctacaaaattagggctcttctgcagagatggaggtgataagcctccaatcgccaaaccaaaccatgtgaggccaggaagggcagaccctcaggggctgcagctgggcatggctaaatgctgtaacccaggattttttcctagaagtaacactttctgtgaaaggggaagatttctggctcttatcaatggaagtcactgtcttccatcaaaaaaacaaatgatttaatctccccctccctctgtaacagagttcacagagaacagaaacttggtccacataaagaaaggcaactcctgaagaaactaatagctacgagaccctttaaggacacaaatccacgttaaattctaggctactgcaaagcagcactgtggctagacctacggtgataattggcaaagacgtgccactgagcttccagctttgacaaattacaatcagagactggaatttttctgtgtttaattattaaaagctttgatgctttcataatgccagtgagattggaaaacagaaaaatgatccatcagtacacaaaataggaagatgaagaatatttaggcagtccatgctgagatgttttttataactcggctacatgatggaagggttaggaattccttagagccaagttcacagttaatgacagaaacatgtagtaaatgatacaggctttgtagcttttagaatatattaggtcaacaaacattttccaggtcactatctggagcagatgcatgccaattagtaggctcagtgggagcctcacccatcccataacgtcctttattaattcttatctgggtgtgccacatatttcatttgctttactgtttcttaaatatatttggcctttaatgtttaaatatcattattgtgggtaaatcagtgcagttgaattgcttttagaagattcgggactgtgttttctttgatgattaacattgaaaatgtgaacttgtaacacatttaaagtgaggaaattcaacgttaatttctatggtttttatcacttttgaaaaaaagtcatttttcctttgatgataacattggaaatgggaactggtaacactcttaaagtgggaaaacctgatgataacttctatggttttatcacatttggaagaagtcacattgtagatcattagaattcaatgtgtttatgctgtgataatttactgatgatgaagtcagaagaacccaaaataaaatataatagagaactaagttcaagtgaggacctatagagaatgagaacacggaactttcaacgagatacacattccagggttgtatgtgattcctgaaatcagatttcacaatctcttacaaagaagtttcttatttgtcaattacaactcaaaaaagctggaaaaaagtttctgatgtacaggaaacaaagaataattaaaatattaatggattatctaacttttttttttctacattgcattccggaacgacattcccaacacacagacttctacgcacagaacaacgaagaaaaaaaagagaaagaaaaactattttctgcaagaagtcaagtgatgaatgttgtcctaaaacagtctgcggaggcgcaggggaggaagtgggggtgggcagtacgaccaggaggaagcttcagggctcctgggcaggggagtgtgaggcctgaggtcattaacagtaagcactgactggcaaattaataacatcaatttaaacagttataattccacaggatcctctatcaagctgattctaaatgagaaacttttctttacggatatgaaatgttttcttctccatatcaaaaaggagacaggggatttgtatttaatttttttccctttagtgtagaagggaggaaacccacgaagctgcagatggccactgtggacttctctccacggggtgaaatcaccaactgccccttgagtgtgtcttcaagtatcaaagccctgagaacttacagaagctttgtggccacctgcgcccggtagtggggaccatctggggtttcctgtgcctggcaccagcacgcacagccagacctcactggcaaggcccagtgtgaaagtgagggactaagtggctaatctggctggacttcctaggtcaatagggacttccctaagggggcttttccctaagccagaatgagtcacagctgcaaactaagggactgaaacttcaaccaatcatataggaagtttaagctctagttgcagcctgatgtttttaaccaatcaggcccaccaacccacaagcagatacaaaataaactaactctataggacagaaaaaggaaaagcggaggggttataaggagatataagcataagacacccaagccagaaacagcaactcttccgggtccccttccacctcttggaagttttactgtcgcttttgctttcctttcactttcataaatcttgccgccgcacactcttggggtccgcacgtttctctaattcagctgtaacactcgccgctgcagtccacggcttcattccttgaagccggtgagaccaggaacacttccatcgagaaaaaaacctttgatcaggagaagacttcttgtctcaaaaggaagataactcttggggccccaaaattactaaactaaagggaaaggtcgagctgggaactgcttagggccaacctgcctcccattctattcgaagtcacccctctgctcactgagataaatgcgaatctgactggcttctttggaaaagctaattagaaactctaaagagcgcaactgtttgtctctcacctacttgtgacctgcaggtcccctccctgctccagttgtcccacctttctggacgaaaccaatgcacatctttcatctgttgcttgatgtcccatgtctccctaaaatgaataaaaccaagctgcgccccggccgcactgggtacacgtcggccggacctcctgagactgtcaggggcgcgcagcctcaactttgttaaaaataaacattctaaattaactgagactgaaactgcctttgcagaattataactgaggaaattatgtcagtgacagaaatcagacctaaccaactctatgttgcttctaacctttaagttgtccttgttcattcctgggcataggctgaactaaatttgcgaaggaattcagttcacagtttgactctgaaacaaaattgtttacagcccttatcaactgatagagcccttatcaattgatcaattgataacagcccaagaagacccccatcttacctggtgtccagtctgctttgcaggactaacaaattagctacaagtttaggacttacggtttaggagacacgcagcctctggctccaagagtatgaaccttcccaaattgcttctggggatcacattactattgtaaaacctaagatctaagatcggtggttgtgatatgttgcagaccctgcactccatggatcagctgataccaccaagacttttaatctggcccgaccagttttgccattgcacccagaaacagaagacagcaagaaaaactcactttgaccccctgtgatttcatcttcaacctgaccagtcagcactacccacttcccaagcccccacccaccaaattaccattaaaaaccctgatccccaaatgctctgggagactgatttgagtaataataaaactccagtctcccacacgaccggctctgcatgaatcactctttcttcatagcaatgtccctgttgataaattggctctgtctgggcagggggcaaggtgaacccactgcatggttacgagacctgtctcagctattcagcattcacaccagaatggtgccaaacacccatcacaggacagcaccctagcgaagacacaaaccaacatagtaacatagatttcacttgcttaacctgtgcaccccacctccatgggcacactggaagcaggaggtctcccactgatggtcagtgctgcagggaggccactgatccacaattgtgggatggagactggggacgggccaccttctgctgtctttcatcaatttatactgcacatgtccttgaggctttctgtatttggttttcttctatctccttattagattctgagggtttattaatcattggttggttacttcactctcctggaagctgctcctctccgtttgaaaagccaacaaaaaaataaacatacaactcttttctcatagaaacaggcaacacttcattctggagatgtgtcctaacctggggtaggagatgtccaggacaagtaaagtggatgttggcaaagatcagtcccaggaccacagcatctgtctcctgggaatgggttagaacacaggctctcacgcccacacagactctgctggaagagaccctgcaggtgaggacctacactgtcaagctgatgctggtgcacattcgagtttgagagccactggcctacaaaatatatataccctggcctccaaaatcatagttcaagttttagccaaaaatcagtcaatctcctgtgattttttttaacaatcctagttatctgattcacccagagaaatgcttctctgatccatctttgcatctgctgcagaaacaaaggatatttaaagttcctgctatccctggaggtggctgtccggccccctccaggatcaaacccatggccttacggaaagcttctaacactacaggccccgctccaggttattctcatgcggctccctctgcttttcagatttcttattctagacttctttctttctggcagtacaagcctctcccttccttctttatccttcagcttcagccacctgaaaaaaaatctccaatctggaaaatctaaaccaaccaccttttctgaaaggacacagttttccaagcattaatgaaaaaaaaaaaaaaaaaaaaaaaaaagaaaatcataaaaactaacttcaactgcagacttctccctccaccagaaaccctttggttttcctagtcagttttccttcctttccacagagggattttctaattgtttctactttcccacaccacatacaacacccaaagtacctgtatgcatattagaaccactcaccccctttacttagactacttataaggaagatattaaataataggcagtcatgatgaataaatttaagaaaggtatattcagcatttactatgtgccagctaccaagtcttgacatatattgtctcatttaatctttactctgaagtagatggtatttgtactatcattatttatcattcttattattattgttactgttttgcagatgaagaaacccagacactgccagcaaatggtgaaggcagaattaaattcaggtactctgactccagagcatgcacagttaaacactattctgtcttgcaaagccttgtgatattggtaaatgccactgctttgggaaagggatgctgtcacttgagcaagtaccacattttatattcttcaggtgatttataacatctcaagagcagtggacaagacctcaaaatggttcctcaacagtcttcacatgcatctggcaaacactgtcaggccagcactcccacccccacctctggagaaaagtttgcactcttggtcggggacccctgcggaaaaagtgccctgagaaaacagcagctcctccttgaaaggcatgtttctgcatggctgacaggtgcaatcccgtggaggaatgcatgagtaagaatgatctgagaagactcgtgaattactacaaattagggtcagtttttaatgaggagacaagaacgtgaaccaagtaaaaacttatgtggatggtaaacagtaccttcgatttggaactaaaacatctgtgatgactctattgggaaagttgcaagacaactatgaatgcacatatgccattccacatgctctccaaggtttaaaatttaaaacaaccaaacaaacaaacacattgcttactcaaaccccctcctatattctatttttacagataacacatctcatctcttttagcttatctccaaaccttcaaagaccattgttacaaagcccatgcttgctttttcctcttgaagctttagctctccacatggaaatatgtcttctttctttcatcccataccccacaacctcacgcccacacactgtccactcatccttgctggatacttatactttcatcccacacaccacagcctcacacccacacaccatcaactcatccttgctggatacttatatcctagtgcaagtagggtaagtttcgggattcatgtcattattggtaagtgttacaggctctgtgcatgcgctgtatcatgaatatttctgtctcgtacaactcatattgttttaagaattcctgttttagccgggcatggtggcatgtgcctgtagtcccagctacttgggaagctgaggcaggagagttgcttgaacccgggagtcagaggctgcagtaagccgagatcgcgccactgcactccagcgtggttacagagtgagagtccaactcaaaaaaaaaaaaaaaaaacaaaacaaaaaaaacagaatttttattgttgttgttgcttttgtttcatctgtacttatcaccaacacatccccaacctcttcttccactttcaacatctacacttaatatgttcaaattcagcagattcctatcaatttcctcttctgaggatgtctcctggggagccttcagatctgctgtcaacaaaactagcacagtcattatcttctccctcttttcatgtggagcctgggaattcattttttgaaccttcttgaatgcattcccagtttccttgaccacctccacccccaacacaccatgttctcctttcttggctaatttcctcttttaggtagatgtactgagacaggtgcatgggagataaaaattgtgaagttttgtattgtgaaaaagtctaggagtaaatgacattttgccagggcataggaatccgattttgagattggattccatcagaatattttaggttatttactttacgttttttattattattattattactgacctactctgacttgtttcctctctggaaatttggtaggatattctcttttgtcccaatgttctgaaatcacctaatgacattttgttatacaagtccattttcattcagtattcagttttcttgggccctttcaatctggaaataaccatcctggaaaatttcttcaacaatttaattttctccatttgttactccaactttattttctaagttgtctctgacaccttttctttcctagatggttcctgctttttcatagcattctgttcttgttttgtgaatataatatatccttttacttctcaggtaattttaacaattatatatttaagttcttatatcttgcaaattttcagtttcttcccagttgctttaccctatgtgtttattgggaattttgcctttcttgtcagaagatttttatggcagtctgcttatattagaagaaaatgatcgaacctcctgagtgtgtgtgtgagaggagggctagggctgctccatcaccatggagtcactgtcagtaaatcaagcttgcttattttactgaaaaagacccaacatcttttccttagttctttctttctcttgagtggctcagggtccctcactttcttcttgtcagtctagtatgtaagtttggagagccaaggatgtctatattcatgcaaacgattagtttaacatctttattctggtataatccccaaatatgcctaaggtcttctattccaaagacccccagtaatggaagtggaatttgatcctaattccttgtaaaatatacttttgatcaacttttttactctgcctcaccgtcatcctcagtttagtgcaaaaatttctggttctgccaattgctgaagcttttgagtgtaccctgaggcgagttgatttgattcttggctttctgaagttttgcattaggattcttctttcctggttcttttaaatcaattaccactgaccttatgttttctaacttgcaaaattgtattacgctcttgtcttctaccatttaatttgtccttgtgaacttgtgactttgaagtaatcattttgtgattataatgtaattttagtggaattttggaggggagtagataacacatgaaagtattttgtctatcaactcaaaggaagattttgaggtggttaacatttttctttgtaacaaaatctgtcaatgcttacaaattatatatttgtatatataatattgtactatgtgctatattatatatatattatttaacttagaaagagtgttcatatgctgagataggtagaacaatgcattggatggacggattaattattcaggctttctgaatatcatatctaatctataaaatagaaaacattatactttggtcttaaaagtctctccctgctgttggaatctagcattaatgactccactggctcaagcgtgattggatttgtcctaatcctttttagaaatgcctcagagaagtgtgatttctaactgctgttaaaaggagaaccactgcttattcatttacaagttataatcataatgtagattttagacaaaagactgagagtagtacatcaaaagacttcatagttaaatagagacgccatttctataagtatacggcatgtggtgtggctgagtacagaaaggtaggagatgaactgtaggaactgaagaggctgaatctacacagagcttcctgtaatgtgaggtctgactgtgctttcatcttccacttggtgacacctacacgctcctcaaaataatattctaatcacatcccttaagccttccttgagctatttgtaccacctctctctcaactacccctgaggtcaaatatacgattaaacttcttaaaaaataaaagtttgaaaccaaatattttccccttggatattcactaaacattatgtttaatatcaacgcattttgtctttaactgtagaaaatatttttctcatatattgataaactgcatagtccctaatgcttagttttacacttgagaataggtacagcttcttgactagttctcaagtaaataaaacttaaaatgttagatagacttcatttattgcatcccttgcaaaaaatatactatcagaacaatgcagttgttatcaagattaaattagtatacaaatgtgacttttttttttttttttttttttttgagacggagtctcgctctgtcacccaggctggactgcagtggtgcgatcccggctcactgcaagctccatctcccaggttcacgccattctcctgccttagtctcccatgtagctgggactacaggtgcccgcaaccacacctggctacttttttggtattttttagtagagaccggctttcaccatgttagccaggatggtctcgatctcctgacctcgtgatccctgtgactatttctatcagaatcccttcttgatggcataacaaaggtaaaagcaaagcattatagattcttcaaaaacaggtaaagaatcacatatggatccccaaagtctgtcttgacagtaagaacgacatttctacagatcagctgttgcctgtttgtttatgcgggtaaaatttgtcatggatttttttttttttttttttttttcacggggtagtaatacccctttctaacatctagcactgctggattatgaaaattttatccaaggtgatgtttattctctgaaggtaaactcagactgagcaagacacaaaggagaatataaatgtccttttctgtatttcttgtagaatacatcttgactttgtgcctattctctagtatggtgtctgaaaatgatgtttacccatagaaactatttttatttaaaggaacaaaattccatttaacttttactttaacaggaacatgggtagtataatacattttattaggcattcccctgtttctgggtataattttaaaatgcaaagggggcaataaataaggccctttgtgctatagcatacatcatcaatggctgataattcattccagcacagtgtttggcattcattctaagccaaataaatattctatcttcacaactcatgacaaacctgatgagcctcgcaactcaatgtggggcttccacgcacttccgctgtcatgtgtgaatcaaaatgttgcagagatagtgttgatgttctctacaatccgtttaaaaagacacaaactgtgtgtgaatgtaaagaagaattgatataaatgcagatgatagacagtttgtagctcaagacaactaggatatatgaaatttattctatttctagaaagattatcttttattaacaaatcctgaagactatggtaaaagtcatttatttatttatttatttttgagatggagtctcgctctgttatccaggctgcagtgcagtggcgcgatctcggctcactgcaacctccgactcccgggttaaagcgattcttttctgcctcagcctcttgagtagttgggactacaggtgtacgccaccatgcccggataatttttctgtatttttagtagagaaggggtttcaccatattggccaggctggtctcaaactcctggccttgtgatctgcccacctcatcctcccaaagtgctgggattacagacatgagtcaccatgcccagctggtaaacatctaataatattattaagcaaagacttcaataaaactgatttgcttaaaagtctaagtttatactggaatgaggacaaataatgatagacttctcagcatggtaagcacttcacaaagcttaataaagtgacactttataacatatataccttcacacctctgtgacgtgttcctaacataaatttaaataaatgttatcatttaccttatttttctttcagccccaaatcagctagtatagaagaaaagcctgccctgcaattattcctcatattctacttttccttctcctcctcatggtataagggttttgtaggaaagccgtgcattaacgccgatatgtgtaataaacacatctttcatgctaagcattgtactagcaatgcgaagaggaaaactctaaaatctccatgtaagtgtagggaaaatatgtacaaacatttttacaccataatacataaagtgtaatctcaagactgtttatggttatggttttttttattattttatatccctgataatctgatttaaatatatcccttatctatagccatgccactctgaccatgcctgatctcctctgaaacacacacctgctttgcaatcagggttacacatataaagacaggaaattttttataagaaatcttgtaaacatagttatccagggaaacagaataaaatcttgatgttttctttttcaggtcatgcaaacaaacatttttaaacttcggttttcttatccataaaagaagagaaataatacttcagtatacatttttttaaacatttaaatgagattagctattaataaagattaattgctattattataagattatcaactcaacatcaatattgctggtataagaatatcaaattttcttttatgatttaatgacattgaaactcatgtgtatgtttgactatttaaaattaaagttgaaggaaagtcactgtccttacacgctgaattgtgtctccccagagttcgtatgctgatatattaaatgccattgccacaaaatgtgactgtatttgaggataaagcctttaggttggtgattaagctataaagacatctttaaggtgggtcctcatccatgacgatttttattcttatatgaagaaatcgggacacagaaaggcacaaagggatgacctttgaagacagagggagaagacaggtgtctacaagccaaagagaaagacctgaggagataccaaacctgctatcactttgatctccgacttccagcctccagaactgtgagaagataactcttgttgtttaagccacctagtctgtggcacattgttatggcagccctaaggaatgcatacaacttccaacaaacacacctacacacgtgctacctgattctctgattctacctttaaaatatatctagaatcattcaaattttccatccctaccgcctttgatttctgtgaaccacaccacttacctcttactacaagagtctcctcctgacattcatgtctccaatataccccttctgagccattctcaacacggcatcatgagtgatttattttaacacaaattttgtccttggccttggctgttgaaaatcgtttgatagcttccaattgctcctagaataaagttacacaaattgctcggaaggctttcaattatctagtttttgctaaactcttcatctcattcctcaaccaacacatctgttgtatactaggcaggctcagcttagtgtctgggttctcttctgcctctagaatttttattgattattttgtgagaggatagacccctttcttaaactcttagcacagtgagttcacatagaatgaaaaaaaattcttccataataaataattgcataaatgttcttgacgcacacaaaatattgtcatattctggtacaatcactataaaattttcattagacaggcttccatttatcacttcaggaccaacaatgttgagaattaagctgtcccatgggaatatatttattcatgtctaatgccttccttaacaaccattagaaggagggaaggaagacagaagaaaggaagaaaggagggaggagcgaaggaaggggaaagaaggaaggaagggaaaggagggaaggaaggggaaagtgggaaagagggggaaggaaggggaaagagggaaagagggggaaggaaggggaaggagggaaggacggaaattatcagaagcaaaatgaatataacttacacactaaatatccccacatataaaaccaaagctttaggaaagcctgagaaaaaacagttatgtttcagattggaaacaaatattaaataagaagaaatgagttttgattcttaaaatatcaagaggaaaatttagtttgcactgttaatagttcaaagatgtttgggataatatatgaagaagaaaccaaaatatttggatattttgcttattagtcaggatattattattgtaataatataattcagtcaccaatttatcatttaaagaattgctgtgtaaactagaaagagaaactgattaatgataggaataaaaatctagttaatatccatttttaaacaatgggatagatgtaactacaaattggcatttttttaaatctaataagaaaaatgttctgataaattgcaatgatttgggatgttttatttagcatatgttagttttccctggattgggctttctaaactattggtgttaagtcaaatactgtggaagtcctagtcattttcatcacaaattgaattcaatttcaaaaaatattatgggtaaaaaccaaagaagaattttaaatggcacttggcaagagaaaaaaaatgaactgactcagcaaaaggacttcctttgaaggaaactttccaaaggacctctcaaaaagaactgctataactatactgttttcttagaaaagatacgatatacacaaaagaacagctatgtgaacacaaaaattgatcacatatatagaaatgaactattgaaccagacttgacagattgtaacttgaacacagtcaggaacacacagggaccatctttttttagcttccagattttatcactatcttgatctgttagtgataataaaatattcatcgctgagcacaaatgaagctgcctgcctgcaacttgactggagggtcccttgaaataaataacataaaactggttctcagcaagcatcccttttgaaaaatgcctctgtgtgttagcaaaccaaagaactggatgctattatattactgtccactacagcaatagcaaacatgctcttcaatgactctcagcaaaagatgcaaaatgcctctaatttacagtatttcagaagatgccaattccagccagcaagagaggttgaatatatttccataaaaatagtgagacagcattttccttttttcctcttattgtctcacaagtgtgctgtgagtcttcagagactacgtaacatcttatgtagccatcaagccaacggctcttgaaaggtgtgcatgtgaattatttgacttttataatgattagtttgttggactcaataatttgtaagattgtgaagggatcctgacatccaaatgtttgacaaactctaggtttgctttgtgattatttacgaatttcagagaacagaaacttaacaaagaaaacagtcacagccactctttctcccaagtactagattaaaatatcatcaaaaccaatattcagcctatatcaatgaaacaaataaatgtgggcacagtgagaaaccaagcagctgtgtatttttacaacatgatcacagttggttggcttttcgggctctaacttcctttgctacttcccttagttgtctgcttattttgggagaattttcaaaatgtggaacagagaataagccattcataacagatgctgtaaataggttatccatttcctcctacctaatagcattagcctcatcttgcctggaaacagttgcctttaattaattctccatgatgcctcttttctggtagctatgagaaattgataaagaaacatggtctaattttaatcaaaataggacgtgtcagtggcactcaggctaaccttgcaggctaactcagacatgttgaatagagaatgcaaacttcttatgctaaatagattaatgaagaacagaaaacaaaagttatcgcttgtgtttaataatgaaattaaatatattgtcaaaatagagagtattttaaaaggtaattttcactacagaatataacattgtttttccttttaaaaatattatggtagtgtttaatattccatttgtattatgttttctttgatggttacaagatttgatgttaatggaactggttggtttgtaagatacaaaaaagacaactgttaattgatcacatttttataagcagtttcaatataaattcatactgaaagtaacttcttatatagctgtaagacaagagatcacatcgataaagatactgtatttcacgatgttgtattttatataaaattacactttcctaaatttctcaaggaaaatctaagccttataatccaaattaattttccccttacattatgtcagaaactcagttagtgttattttaccttttggatgccttacattattttttttaattaatttatttatttacttgagatgaagtctcgctctgtcgcccaggttggagtgcagtggcgcaatctcggctcactgcaacctccatctcctcggttcacgccattctcccgcctcagcctccagagtagctgcgactagaggcgcccgccaccatgcccggctaatttttttttttttttttttttttttttttttttttttttttttgtattttttagtagagacgcggtttcaccgtgttacccaggatggtctcaatctcctgacctcatgatcctcccacctgggcctcccaaagtgctgggattacaggcgcagccttacattttttttttttttttttttcaggtctctaactgatgggttttccttttctcctggctatgccataaactaaatggcaagatgcaggtttcagaatcatacacttcagagttgagatttacacatttgagttgtggcaaagctggggcaaggagtcagtgttctgatacctgctctggcactttgcctccttacgtccagttctgagctctcagcctcaaaaacaccttctatcaaaaaaacacagaacgcaggaggaaatgcctacaagtgccttcattccatccactaaaaatgtacaaaatctcaggagacatattttgaggaaagtgatggctattttatctaagaaagaatcccctggatcagatcctagattcttagaaattcaagaaagcaaaacaaaaaaaattaaacaaaggaaaaaacatctcttaaggttgacttttcaaagtattatttctatttttcaaagttaaattgtaatgaattcaatatttcttcattttttaagtgccaatttaactagaggaaaaatactaaaccaactagttatctttaattatcagaatacactatgaacagtggctttcatttaatggtatttttttgcccctgaggcaaattctatagagaataaagttaatatattgtgaattatttaataggaaggttaatttatatttaatacaaataatttaatccagtcctgcaagcttctatttatttggaatattaacaaacattgtcgaacactcgccatgcatctttcctgagctgtgggttgactgtacggccacatgcagaaaggacatatgctgcatgtttcagcacctgagacagacttggggccaccaaaaacagagcaacaatgtcttttaccgaccacaacacagctacacatgaagacccctgtgattctaatcctggacccatttcctactggttttatcacatgaaaccctttacttaaactgtttcagtttcagtatcttcctggaaaataagagtgtcctagtggtgctttaaaggcgaatttagcttcattatgcatcagtgtaaagtgttgcataattggcaccctgtgtcttacagctgtcgttatacttatacgaaaatttattacaaacgtaatgaaaattttttgaccaggtagagggtatcacagtggtgtttgagctgcttttaagtgaacattgctgtgctaagcactggaggtaaagaacgaaggaagactctatgcctgccctggaggcgtggacagtccagtgaggaaggtggcgtggatgaatggtctgcattcagtgttgtggatctcaggggagtggcactcatcctgcacgacgatctgcatatagctccctgagctgcctatggaactgagtgggcatcaaggggacaaggagcagaggaagggcatttggaatagtgggaccagcagatgcaagggcaaagggatgccaaacagtgccatttgcaaatgttagaatgatgattttggtgggaagccccgagtgatgcttgagtagatgagtacaaagaacccagcagggcacaatcacttagatgtttgcacactgagctcagtgttctacaggcttactggacattccacagagggccttggagcagaagaacaaagtgatcagatggaaattttagatcagcatgttcatcagaagcaagggtggaagggaggacacctcatcttcagaggatggataaaaggaagtgtggatggcagcaagggcaggtgaaactatgtttatgtgggcaggggttgcaggtaggaggtaaatagttctccctgacctcaatttgcctggaaggatagaagacacatttgattattaaaaataagacaatagccaggtacagttactcatgcctatagtcctaacacttttggaggtgaaggcgggaggattccttgagcccaggggtttgcgaccagcctgagcaacatagcaaaaacccgtatctaaaaccacaaaacaaataaacaaaaattcatctggatatgaaggctcagcctgtcatctagcactttgggaagctaaggcgggtggatcacttgaggtcaggagtttgagaccagcctgacaaacatggtgaaatcccatctctactaaaacaatacaaaattagctgggaatggtggcacatgcctgtaatcccagctacttcggagcctgaagcaggagaattgcttgaacctgggaagtggaggttgccgtgagccaagatcaaacatttgcactccagtataagcaacaaaatccatctcaaaaacaaacaaacaaacaaacaaaaattagctgagtgtggtggtgtgcacctgtagtctcagctactagggaggctaaggtgggaagactgcttgaacccaagaggtcaaggctgcagtgagccatgattgcgccactgcactccaggctgggcaacagagcaagaccctgtctcaattaaaaataataataatagagtagaaaacccatggatggtgttctggacaatctgtaagtcttccccactctaagtatcttcatctcctcccctccagctttgctctcccctagggtggttttgattttctaagcgtgtaaatgggctcagcaccctcactccaggtttcaaatcaaatctctgcccaagagggcatttgggagattgctgatcgccaatgcacaggctcagtagggccgacttactgctaacaaaaacttcaacaccaacaacaaaaagtcctcgtatctcaataaatgggaagaaaacataaaagatttaggcagacagaaagacaggtaatattccttacaaacattgccgtttcatctatttagttctaacaaattataaaatatcccccaaatctacaaacttcccattttcagatctcataggtctcacttacctatgtttcctccaagagagctccaataagtaacagaacgtgtctctcacagtttcaaaaaattattcccagccttgtgatctatcagaaagactggaaaccttcacatttacaagatactgaagaataagcttgatgctgaaattccagcgaccttcaggtagtgaaaaatccgtaattcccaagatggaaattaaggggaaatgaagctactactgttcagagaagtatgctcatgaagcttgtatgctccaagaataccaagaagctaaagaaagatttggctaaacaaaggaaacacagtgatacctatcatttagatagcatttcacggtttaacactgcttttgtatacaatatgccatttggtcttcacaataatcctgagagttattcgctacattttcacacatgtacaaacaaaggggttaagaagctcttacaaacctgtacagaacgagtaactgtactaagaaatggagttgtaacgattcctccactatattttcaccctaattcacaagttttttaaatctccagatctctaaacttctccagaaattgcttaaattttggagagcaggcaattctgatctaataatcttgcaactaaaaacggatacagtgattcatcccatgccatcgacaatacacagaagtgaaacatattgtgaactctattttacaatgactaactgaacatataattcatcatttatcgtgactaacagtaccatttagatattgagagtaccaatcctacaaggaggaaagaaaacatgagaacttcttagagtgtgatatttgctatgctatccaaaataacatcatggtgttaatttgtttataaattatgacattaaatttctctcaacttatatattcaatgatgttccaaaacttctatattcaaagatgttttaaatgtttgaatatataagttgaaaaaaaaataactccatactggaacattccctaatgtttgaagcaacatttgttagcagatatccacatatgtaaaacatatgttaaaaatgatactggtgaataccatcatgactcaagataatcaccagattaaaacattttttatatttagccaaattatagtgatacttaatttactaatacaacagggttttccttctactcttggtataaggtaatgtttcatgctcccaaagatttgctatctttatccacctcattagcctactctacgaggttatgatatttggctgtaggcaaatattagaggcctcagggagaggacagttttctttgggtcaatatttctgcctgctaccataacagaactagtttccctctactcctctgagaataatctaccttgttatttgctaaattcacaagctcgtgaaaaaggagctgttctagatgaattctaagtttagcaacatgttcagacactaaaatgaccatttttattatatggtagaaaaacacgtttttttcaattgctagcttagcagcactggctctgtatttaattgcaaatgagagagaaaacagtaactgattctggccgtggcttctttgcagttattgggtggctgaggtttagggcattcctagaggccagacctgacacaacgtgagattacattgaacttgccaatcacttcattagtgcaaaacaggcttcaacaaagtctcgtatttatttttaaaagcctaacagaggaaaatgatttcttaaattgttgtgctgtttctaatatcatcatttgataatatgattagtagctgacaacacaataggagaaattatttttaggtcatatgttgaagtatttgcatcataaacagaaatacccagaaactatcagatgcttagttttcaaactgattgaaaaaaaaaaaatgctctccatttaggaactagtgtccaattccaacccaatcacacaaacaaaatgaacacaatgaagcaagtttagtgacatgatatcttcatctattaacttgggaaactatggaggattggaattagcatttctagagaaacaaatgcactagcaaatgtgagtgttcaaaacaggtaagtgctgagaatgtttccctgtccacagaacggtgtggtctaaaccctcttatagggttagcactatctttttccatttgtcctcaaagaaatttctccttcaggccacagctttgtagtattgctttttatttccagttcttcaaatctgattcatgggctgctgaaatataatgacgtcttatcccttttttttttttttttgctacagactaagttaattaggtggaacccaggctgaaagttcggatacctttggtaaatttgttttattacaggaggtgtttaatatatggctcatagttaaagctggttaaactaaagaagaagttgatattaagtttatatcaaatctatattgtatacttgtaaggcttagatatgacccacagttgtcaacccctttaactagttgtgatgcccatggcactctgagggtacacctgataccggaaggagagcattgactgtgagttctccaggttcttggcatttagaataattggataagatacacaaagtaacaaaggaaagaaacataggaaggaagctgtgaaaggggggatttattaaagccagaaagcacttcacagggtgggagggggcccaagcaagctgttccagggcctagttacacagttttctgggatttaagtacttattttgaggtccctctcagttaccccttatctggatgaagaatttggtccctggctaattaaaggctggggtgaattggcccgtgttgcagatgaagggatggccagtgcttggcccatagccaatccaaggcactctccctttccatctgagacacggtggaaggaggagggctatagagaaagcagcctttgatcctttgttgttaggaaatggggagacggaagtttttcctttccattaactttagaaagtttgagttaattgggcttaggttccctgcccccagacccagatgtttcccttctgatacagctttgggaagacagcacgaattggccttagacctcctgcccctagatcttgggcttcttccttgattcagcacaaactggccgtaagttccctgcctcaagaccttattctgcctcacactcaccccacttaaacaggataccccacttaaacatgtcctggccatattcattctacttctcttctttcttctgtaattttctgataagggtgtgtttttagaacttaatttatcttttctgttttgccaggaaaaatctgaagtgaagaatcacatttctctagtttcaactgctccatgagcatatcccattctgcaaatggatatccgcttgagggctccagtctaaatgcttcacctcattaccccttccctccagaatctggttagagtctcctaattgttatctggattgctcagctactgttaagtcataaaagaggtgaagacaagcttgttcttgtttgtctggagcttctttttatcaggagataatcagcaggacctctatgtcccgactgtgcggttttacatactcggcaaagagtggagatttcctcattgacctcttccaactttctagagacttctcagacataggagaacaggaatgatggatttaccaggttgtcagtaagagttgcatcaccaaaaagcaacattcgcaatcattcacaatgcagggaaccaggggaattgtgtccctgggagaagctgaaatagaactaaaaaataggctttcagactctatcagtgagtggagtgaagcagagaccccagaaatcatttctaacttgaaaacagaagggaggatagcatttgtttcataaaacgttctctactttatataaataataattatcttctacttttccgcttttaaaatatttttaaatgtttctaaaatacaaagatttaaggatgttaaaaatgtaacttggttaagaatataattacatggcgcagatataatagtttagacacatgtaataaaaggcacgaacccattcattcaattactaaaacactagtacgtgtttatattgagtacagatcctcttttccaaataggacattcatgacctggacaggtataactggaacttgtagagttagacttccaatgctttcttgttgagaactttatggtactcaccattttttgaggaaaaaaatgatccaatatgtcagaaagatctggaaaaatgtcccaaacattatatactatagtcttctttgggcaattgtgacttaatctgggaaaagtgacttaatctacaggttactatatattttttgtattgaaatatatacggtaaactagacggcatgtgagccctgtcaccctcaaacattgtcatcttgaatcccattcagaatttctttattattacattgttattattttttgtggagagacggtctcaccatgttgcatgggctagtgtcaaagtcctcggctcaagcgatcctgcccacttggcctctcaaagtgctgggattacagcctcacaacaccacacctggccacattccgcatttcttaatgaagaacatatatttgacttgtcccaaggaaccaaagtcaacactgattccctgcaggttctgcgtcagctcgcaccatgaagagtttttctgtatgaggaatgcaagggttggaatggcttccaggaagcagagccgttcacaccagctttgaatttgttgagttttcaaaatcatgtcttgctcaatgctcatcccttggcacatgattggccccattgtttgtaagactgaccacgctgtttcttgttaccgctgtcatttgtagacagggtgcaaattttgtaccctgcactaactaggtattcaaaaaaaatctgttggggagtgaacacttagcaacattgcagacacttgagggaggcaattgcatgtatctgcctcccacacaccaacataatggcagtcggtgaggaattcagagcctacatatgatgggtgacatataatccagcctcatactccgctggccaagtcgattctcaaaaaaagggtgatatcgtttggaaacatgaacttggagaaaacctctcccaggaccctcatccactcgaggcagtaattcgcgtagtgcagtcggcacagtgccatagcctctgcttggtgtctgacacatccaaagcaggtggattcattctgataagcttcagcccaacatcgacttgcagagctggcaattcggggttgataatgtggcacagcagactccaaagacgtgtacccaggatgtgtctcagcagtaagtgtagagttaacaatgttgaaaaggctgtttacccagttcctcagacgttgtgatgtgcacagtgtgtgttctctggttaaaacaccacaactccagggaaggaagctccattattatctgtctaaatgtttatatggacacatttttttttttttttttttttttttttttttttttgagacagagtctcgatccgtcccccaggctggagcgcagtggtgtgatctggactcactgcaagctccacctcccgagttcacgccattctcctgcctcagcctccagaggagctgggactacaggcgcccggcaccagactcgactaattttttgtatttttagtagagacgagtttcaccgtgttaggcaggatagtctcgatctcctgacctcgtgatccgcccgcctcagcctcccaaagtgccggcgtgattacatgtgtgagccaccgcaccggccagacacactgaactttaaggaagtcaactcacctcaccggcatcaggcatcttcatcaggtaagagctccgccagcacttcctgtccatccactcagaggccaggagagtcagagatcgggggttttctgggcttttccttcaccctcctgccctaactccagctgtcctcactccaatgactgtttagaaccatcccctcctgaccaatctcttcctcagttaccctcacatgattcttcttctactctccccccctgcccccaccaccaggcaacactccctcacacaactactgaaaaagaaagcacgcatgatttgactgctgcctacctcgaatccttcagcggctcctcctcacctgcgtaattccatacaaagttcccagcggggaaggggaagccttctgtatgctcacctgtctattgcgccccacccttcttccctcagtcctcagtggctgtgctctcctccacactgccttccccacatgctgccctgtctagaatggcttttccacctaccttctggaaagtcccacgcctcatttcaataccctacatgattgcctttgtgctcccaccacaatctgttcctgtctccattagagccctcctccttaggcattttaattagtcatgtataaacctgtttctggataatgataatgaccctaataaataatatcggttccctaatgcagctggacatgtggcatgtagtgcatgaaggttactctgagtgctggctcatgggaaccccattctttgaaatatctgacatcaccatggtcaggtttcagatgcagacactgaagctcacctaggttaacaacccccggcaagccatggacttgccatgtgagatcagagcctgacccaatgtgccgactccaaagccgggcaggaagacacatcatcagaaagacttctctggtctggaaatggtagctgagcttcatggaatcaggggctgcatgtgattcttctcaaagcctcggaggctcctgcagcacaaactctggggtgcaccaggtagaaacccacagaagatgcaccaaagccctgagtagaggttaggtcttaaaaccacgggttccatgattgtttcccatagtctgttctatgacctttacggtaaagaaatatacaagcaggaggaagacttttctcttgaaaaacataacacagatggcatctttgatgcgcgtgacatgctctgggtgaagctcaacttagagtcaataacagctcctgcctaagtcagctgggaccactataactaactgtaagttataagttgctatagactgggcaactttaaaacaaaatgaaaaactcagcaaactatcacaaggacaaaaaaccaaacaccacatgttctcactcataggtgggaattgaacaatgagaacacatagacagaggaagggaaacatcacacaccggtgcctgttgtggggtggggggagggcggaggaatagcattaggagatatacctaatgttaaatgatgagttaattcctgcagcacaccaacatggcacatgtatacatatgtaacgaacctgcacattgtgcacatgtaccctaaaacttaaagtataattaaaaaaaaaaacgcattggctacttggagttctggaggctgagacattcaagctctaggagaccagctgtctggtctggtgagagccttgtgtgtagacagtagctgctcctggaatcctcaccttgtggatggcagagagaggagcgtgccctcgtgtctcttctagtaagggcactcagcccacagcgagggctccactctcatcacctccttgcctcctaaaggctccacatcctaatgccatcaccctgagtttagaatttcaacaggtgcattgggaagggatgtcatgattcagtccctcatgctgcctttggcttgtgtcctgggaaagatggcacatggtcgagagacacagcctgcattccattcccaacatagttcaccatcatctgcacttttcagactacctaacttcacctgtaattaaacatttcatattaacttttttttttttttgagatggagtttcactcttgttgcccaggctggagtgcagtggcacaatctttgctcactgcaacctccacctcccaggttcaagcgattctcctgcctcagcctcccaagtagctgggattacaggcgtgtaccaccacacccagctaatttttctatttttagtagagacagggttttcccatgttggctaggctggtctcgaactcctgacctcaggtgatccgtccacctcggcctcccaaactgctgagataacaggcataagccactatgcccagcccgtaattttcatattcctaaaaaaagtaaagataagctttcacatattcactgagaatttttaaaacatcactccagtttgcatttctaaaaagatacactttggtataataaaaccaatatatcttaggtggtaactgccatagctctgagcaatatttgaacggtatttctacataagggccaataaaaggaaatcttccaatatatttgaaggattactctatctggaatcttgactgtaaatactcagggaactaccatttcaatactaaccaaaaatatttaattctaagtacagatcaaaatccgaaccagatttatgctaaaagggaaataaacaactggtccttctgtctgtagaatcatcctagctcaacacctacagaatggaggatgctaagtgctacactgaaggaataaacaatgctgagtgatgctgagctccaacagaaacattttccaaataacctcaactccaagcatccagccaggccttgctggatgtgtcgtagttgcttcagggaaggtcacttgagaatttcctattaaaataccactttaattggttcattctctttataaattaaatgcataatgattatttgtaagctgacccaggtccactctaatgttcagtaatctacctcttggtgttttgttaaattgtgaacaacaggaaattctgtgatgtggtacacaaagttcagcactgtcacagagaagtcagagagactgatggatgcctttaaaatatcctcaacgctgcacgtaaaaggcacgtgttgctgtgggtgaagaagttaatgtaagtaaaatgaactcgtttgttttttaagggagtgtattttccacattgtgtattttaaggaataaactgtgatatcttgaggatagacaaaatccaggtatgtcctgaggcatctgtcttgtagtcacaggatcggccccaggaaaacagggccatttttccatcatgcacctccctccagcctgcattccctttccccagatgtagaagtctccaagcttcctcagctccctgttaggaaggacatctctaaattctctaacccgtgccattctaactcagtgtctgcagctgtcttttgtgcctggctacctttggaagtaatgtggactctcttatctttggatggcaggcttttgacaacttcagtgccttttaccggggcttagaacttcagctaacagaatttttcacaacagagatatcttctagaaggcagaatttctctttctgttcttccaagtgtaatgaattaacatgaccctgctgaaggattcataactcaggtacaggtaaaacaagcaaacaaaccaaacaacaagcattaactgcaattccaatattcttccagttttccaaatggttagggtgcagataaggagtgtttagcatttggtttagaaccttagggtgtggaaagcagattcagaatgcagattaaaaaggaatttcaaaaaccaacctgctttatctaaaaagatcatttaaatgtgtagtttgcgcacttgcagaggtgttgggagaagacagggagggacagaataaccttaacaatatggattataaatataaaaaaatgtcctgctgagaaacgcctgagaaagagcaatgttttgttccctctcctgtgctttaattacagtctgcaacgtccaaactttcagtaaaagtcttccagatacaggactagacattattttggagaaatgatgcaagagaaattgtgtcccatatgcagacgtaataaaacggttgaggagcctacagctaagtttacgggtggtgccagggtgcaacttgcatccttctcccagcagaagatattaggatccctgttcaccaaatacattagaagagccaatctttgaaagcaaaggaattcaggcaaaatcctttctgttaccataacctcttcttgtaatatcaagtataaatacggtgaagtttacttggaaagctaaaatattcagactactttagaccatgcatgtgtaaatcatttgccttgttatagatcctaagatcaatgcttcaagagataaatcacttatttacagtgagacattaactacaattcagtttctagatcctgctgaccaagaaaaatactctttaaaaatataaataaattctgagacatttgtaattgcaataagatattgaatcacccatatctagtttaacaaacacattatacagaagtgaaccaaatggaagattttggtagtgaaactttatcatagacttataccataacattaaattaacatggggaattaaaatgttatccttgtcagatatgtttctcatggattgtgacatgtagtttcactttgttatcaagaatctgtggcatcattattattatgtcaacattataggtgaaaaaaatccaactgatttcctcaagctcacacagataaattaacagcgggtaaatactagaggaagactgtagctttttcctagtgccacatttcttctgcaaatgcttattttatatgaaaaataattgttcgaagtttttttatatatatagcatgaatcaattatatttccatgtaccttttctattgcaggcacacattaaatattagagggcagagaagtccatttgtctatcagcagagataagttttgcctgcataaaatcaatgggaggtgtaagcagttacaatccttcctgcttgtggtttgctagggggtcattttaacgtaatcaatgtgtttagctcgataccttcatttgactatgctttaatttttttccctttattaagaactttcccaaagtccagatttatatgggtaatatacaggaaattgtatagaaaaatatcaacgataattgtttgaaattggataatttataaaactgtagctaacatagttcttacatctttggagaagaaggaacaccatacactttcaacattattcccactttctcaagagaatgctctatgatggtaatatagaaatacgatggttaaaaatctacttccagttataaatcagctttttgaattgaatatttacagaaatcaggtagacacgtaagcaggaatgcttatgtactaatgtttttaaaatcccttacttaggccaggcacagtggctcacacctgtaatcccagcaatttggccaaggcaagtggcttgcttgagcccagcagtttgggccaaggagtatggaaaacactgcaaagccctgtctctacagagagtaccaaaaaaaaaaaaaaaattagctagtcatggtggtgcacacttgtgttcccaactccttgggaggcttaagtgggaagatcgtttgagcctaggaggtcaaggctgcaatgagtcacgattgtgccagcgcaccgcaacccaagcaacagagcgagaccttgtctcaaaaaagaaaaaaaaaatcctttacatatacacacacacaatagatatatacgtccatagtaatatatacatataatcaaatatatatgcatgcatttttatgggaatatacacacatacacgtatagtgagagagtagggaatgtatgtatgtgcatgtgtatttatggagaaatgagaaattaacatcaaattagacttaagatttttctcaaaaactttatgaaaggtgtatactctatcctcttctcaaaatcttagaaatggtatttgccttcatttttctgctatgacaaggtgaacaaatctcgtagcaagtgcataccatttattacaattgtaaaatgacttgtaacgtgttattaacagtttttgaagggggtatgattctttttcagatgtgtaattaatgtagccgtaaaggaaaatggcaatgttgtattgaatactgaatcttgactgtggtgaccatgccaggaataagataagcagagcccagttcctgctttgccgctaactcagcaactcacccaaggggagctggagagtatgccagaaatgatacatacggctataaagacagagtgtccaagtttgactcagttcatctccgggctcttctcacttccgacattgccccgttttgtgaacttgactgtgtctctttctacattctggaagcaacagtgtaatactctgcagttctaggttccctagcctcattcatgctgttgcctgtgccccgcacttagcagatgagccagtggataaggttctgcagctctgcttcccagtctttctgacatttctgctcacaattgttgaattacaaagcaccagctggtccctcgtcagcagcggcctccacgcaatcatgggaaatgctgcattccgtcacagggtgccctgagatgtccctgctctgtttcctctcttcaccttgcaaggcagctgacatcctttattttctcataacgtcactgcctggaatttccgcttccatcaatccggcagtcccacagatataagaacccatgcagtgggcacggtttcagtgtggtgaccctgtgctctaaaaccctttgtcaggggaaacacagtttttatgtatttgtgtctgaaacaaaaaatgacggaacgtcacatgcaagtggtgaccgtagctatgtggctttcctgactcatggcagcaaactaacatctcagattccatcatctaacccagccaacgaggcactgtggatcctgctttcaagtgttttctgcattactgacagcaaattactgagaaggcagaatccaatgatagctttccatcctcattttgcaccgtattttcagcttgctgccacatttgttttcctaaggaggtaataaataaattggaagaaacactgaaaatacagcaaagagtcaggagtctggcttcacaatctgcgacagctgagggtgagatatacaattttacacctatgataggagatctataaccttagatgccacatctattcaggaagaataatatcaaggttagtgtaagcatacaatgaaataaagtttctggcaaacagtaatgctaaaaaataaataaataaataagatgtttctgttctcagcttcctatttaagttgaaaggatgtagtccaggagtattcagtcaagcaaatgtccatgttttgtgacatatatctctaatctattgtataagtatagacaaaggcatttagcagatgccactttattgcctcaaagagctgaaaatcaatgggtatctgtggaaggagaatggtttaccccaagttcaaaactgtgtgcagacaagagccactgtggagaaagagcagaagccaggacactatgcttctaacgccgtgagctgggccaagaggtgaggtctttggcaataggaatgcatgagcctacaaaaggcctaagtaaaaagttttaaaaaaggaattgtattctagtcccttagttgataacctgagaattctcattaaaaacgtacaaggaaaaagagatcatgtttgtagacctaccttatgcaagtaaggctaatatccccgtaagatatgaatatcactgatcacagagaaaataagagaaagactgaatgttggaaagagaggcacgattataaattagtgaaagctttctgatttgttgataccaagtcagctgcatcacagtccacaaatatttgttgaagtgatacatttttctaaattccaagtctattgacaataatacaaaatgttatattgaaaattaagtgggctaccctaatgctactccagaaacacgactgcaagtttctgcagtgataaacctcatcacagaacctaacactgctgcagaatttgtcctgttccaggcccgatttgtgctttgaactcatgcaatgcctacagtggccacatgacgcgcatgcactattgttcccatgctacagatgagataaaagaggcactgactgtttacataatttgcccaggattgtccttttgcagtttgtaacagagccagatgactgggtcacgcaaatgttgaaaaggggcagcagagaggtgaataagtccgggtgtgaattagggggtggagcagcaagatcagcgtttgggtctcgcattagagtctcacctgcatgactcccgcagggtaaacagccacgctgcttctaatgctctgctgtagatcacattccttttactttataaatcagaacttgcctctgtttggcaggaaccttgtttgggaaatgaaaatatggtaagtatgtgtttccttctagttaaacaagggaaagtatcgttcttaaacgccaaacttaaatggttaaaaaagttaagtcttaggccatgtcttagaacgaacgttcttatctttaaattgtgagtcattttttcagatagagacaaggtttgattttttatcactcttggttagctgatgacataatacacattcaaagaaacgtgacagattttaagcaaatttctaatcaacagtgttctacttcgtcaaatcacaacagaaacattcctccgtgtcagcttttgtcattgatccccggatctttccagtaatttgtgtattaagagccacaaaggggaatacacaaagctgcaaagtcaattaaatcctcttaaataaggcaaaatgaaacaacaaaaaagtgccatcctatagccctctctgttcccagtaagtgcgggaatgagcttttgaggaatgcacagcccaggtgttctgcagctgcacattttaatcatcaagtcaccaaagtctgctgataaacatcaaaaaagcctaatggagtcacagacccagtggcctggttcctcagatgagctccatagattcctacagaaatggaattggaatagggctggctggagttatcagagcataataatcatccgatcctgacattaagagtccctctgcctcacaccacccagaggcaattcgttgtgtgaggggtgtgggaacaaggtttcatatctggactgggatcactgtgatatccttggggtggtagcaaaatctttctttttactaactttttaattatggctaaagagttgatggggttgaaaatgctttctccttttcaatgaaggctctgaacggccgtgcaaagtttatgttctctctggttttgataaaacttaaatgaatgcagaagccaatggcaagtccataaaatttctcaatgagtctctgtactgacttgagaaagaaaggataaatatgctattggtgctaactcttttattgagcatttttatgtccaattctttatcttccttatgtgtaataaagtaagttcctcttatttgacttactaaattcaaattctaaaagatcacttctatccacatacccaaaagcattcagttagtgacaatattaaaaacaatgggaaacagtagtttttgctatttggtgataccaggtacccatctgcttgtgatttaagataattttctgtactgtcaggggcccaagaagagactatgtgcagtttgcagtggggccagtgacagcttcaacctttgaacaggaaatccagacagtacagacttttgggaagggcccaaattacagatcccagcagcgagcagcaagtactatgaacacaatcacagggaggctttttaatttatctgagcttaagtctcctcatacataaaatggagtgcatttttcttacctctccggacatttgtgagggttacgaaactttatctatccaaccaactttgcaactgcttggcagatgatgcatacatcccagatgatattaagtaggggtggtggccaggcattgaggggcatgttatgcacacaaggagcctgtagaccagaacagggatggacccgccatggccagggtgacaaatctcactgcctatcttgtggaaaccctaagagtgtattttatatttttaagtggtagaagaaacatcagaagaagattttgggacaagtgacgatgtatgaaatttacatttcagtgtccacagaaggagtttataagaacacaacagggcccgtttgtctacatcctgtctgtgactagtttagtgatgcaattgcagagctgggtcactgcaccagcaactcagggtgggcagagcccaagatatttaccatcattttctttgaagaaaatgtttattcacgccagctcaaaggttgaattgaaaattttctattttcgtcctttttctttctctattttcccctacctccttccctccctccttcacttccttccttccttccttctgactagcggagaaagaggctcaaagaactggttaaagcagctctagctacctctagtcaatgactgtgttgtcattcccccgtattgctaagaccctctgccggtcatgtaacaaatgcaaatctttcacgcagagttgattttcagaacagctcagacctctgttatctgggcatggggtgagggcatcccctcacgcccaaccggccttgggtgggtctgcacagttgtccctctggccgtccttttcctaggagtcagggccagggctgacctgcctggtccagcgttcacagctgggtgaacttgcccagggccttggtccagctttagtcagtctcctatcctccccacaggaaaacaggatgctgaagttgggcttggtcctatcctccccacaggacaacaggatgctgaacttgggcttgtccctgaggttaagcaagctgtaaggttcagaacatcttttagcaacgtatgccgagattggccaactgttgctaggaccctttcctgctcaactgcccccatacacggaaccaatgcctgctcaaagctcctgctacccctacccctgcttccccattacaatacaagaaaacccttttttttttttttctgtttgagcttaagatccctgcagtccctgaggtcagaccattctccctacggccttcatcatttttagtgaagtctctcctttcctaagcccagacatacttattttggcaccattgatgctaggacggaggatcatgcccccatgccagctctgcagacatcgggaagactaaacaacagaagtacatgtcaagcccttggaggaaggatgcaatcatctctactgcaaaaatacattgcaaagaaaacccgaaagaaatagtaatatgaatacagccactagtgcggtcatcactattgcaaaaggatattgcaaacaaacaaacaaaaaaaaatcaaagaaacagtaatactaatacagccgctagtgcagtcatcagtatggcaaaaggatattggaaaaactcccaaagaaacagtaatattaacacagccgctaggttgtgtcctaggttcactatgacagaacagtcctcgttcccctccttcttatttttctggcccagaaatgataattttcacagtggcgttgctggtggtagtggaagatcaacgccgtaataatgagtattatgggccagcagctattcctaaaccaccccattcagtccttatcacaaccccatgagaaccaccatcatcgtcacttgatgggtgtgaacactgaagtgttgggattttagaactttcccaagtttatcatatgggatgatgtagaatccaataataggaagtcagttttcagaatctgaaatctcaagtcctcagtttactactgtttccagctgaaaagaaagattatctttctataattattatttgttttttgagacagtttcactcttgttgcccaggttggagtgcagtggcacaatctcagctcaccacaaccttcacctcccagattcaagcgattctcctgcctcagcctccatagtaactgggattacaggcttgcaccaccaggcccagctaatttttgtatttttagtagagacgaggcttctccatagttggcaggctggtcttgaactcccaacttcaggtaatccacctgtctcggcctcccaaagtgctgggattacaggcatgagccaccgtgcccagcccgtaattctttattgatagataaccgtgaaatgttttactcattggggtagcatttagtgtaagtttaatttatacctcaagtattttaaaagctaaattaatgtccattattagtactcaaatggaggaaatatttttatttgtgattcagtaatcccactatgtgatatctaccgaggggaaaagaagtcattatatgaaaaaggtatttgcacatgaatgtttatggcagcacaattcactactgtaaaaatgtatccatcaatcaacgagtggataaagaaactgtggtatatatatgatggaataccactcagccataaaaagcaatgaattaatggtattcacagcaacctggatgggattgcagaccattattattattattgtgagacagagtctcactctgtcgcccaggctggagcacagtggcgcgatctcggctcactgcaagctccccctcccgggttcacgccattctcctgcctcagcctcccgagcagctgggactacaggtgcccgccaccacgcccggctaattttttatatttttagtagagatggggtttcaccgtgttagccaggatagggagaccattattctaagtgaagtaactctggaatggaaaactaaagaccgtatgttctcacccataagtgcgagctagcctatgaggatgcaaaggcttaagaatgatataaaaaactttcgggccttgaggggaaagggtgggagggggtgagggataaaagactaccaattgggttcaatgtataatgctctggtgatgggtgcaccaaaatttcagaaatcaccaaagaactttcatgtaaccaaataccacctgttctccaaaagtatggaatttaaaaaaaaaaagaaaaagcactgaggacattaaaaaataacgtcttaattccaagtattaactttgaaaattatgatttactgactaagacttaaggggaagtatttgtcttttatatagcaaaaatctggctaattgttctttctaaagtctaactttatcataaagtaacacaaaacattctgattcttggaaagtactgaatttaggaaactctccagcaacaagcataaaaataaaataatgattgaaaaccattttttgtaaagtaatgaagccaactttggaaatttggtgttatgttgacatatatatacgcaactttaaattcaatgaaatagtccagaataaagaatatatttcaataaagtaagtgttggtcatgtgtcttcatgaggtccgaacatcggttgaaagtcagacaatcattatgcttaagcaaggaaaaggagattttcaggtgatttaaatatccacgtttctcatcttgcatgaggctgaagcctccatttacacactgtggatgtccccactttcttgcagacactctggaagtctttgtacttgtgtgtgcacagacacatgtccacgcaatgtcccacactccatgtcttcactcttgccttgtggcaagttgcaattattttctataaggtgatactacatttactcagtcacacttggatgaaagcatcattttacccgtgaaggtggtgtactgtaaatatcagaaaagaagaagaaaaggaacttgaagtttctaatatttccttaaggagaaattctaaaaaggacatactgctgttgttctctgctgaacaagtggtttaatattacttgaggccactgcatacctcatcagatgtatttatcagttgatataaaaattgttaattattctttggtgatcactttgtccttcttcttctggtttgcattaaatcacggcacttcttaaaaactgagcagtcccagatttgcaggaaatgtaaataatgtaagagatacatttccaggaaatataaacaaataatgtaaaaaaaaaaaagtcatgtcttaagacatgataaaagttcagaaggatgaagtacttgcaatgtgctacttcctatctcatttaattccatgaacaaccctctaaagcaagcactcttaccatctgcatttacatgtgagccttagaaacattacataactcaccagctacacataattgataagaaacagtaagtgacagaattagggctaaaatcccggtctctttgactgtaaaaatgcaggctttcagccacagaattaaaggaatcttagaggtaaacttgtcattcctccttaattttttagaagagaaaattgaaactggaataagttgaatggcttactcaaggtcatgctgctgttgagataaaagaaaaaggactgaacccaagctgaacacgcaaagtccactgtgcacctcctactacttgacattgttttggacagagttcatcaagcggtacattttgatctatacctgttaaaaatctaaatttaaaatgtcaaaagtttaatgtgttcttccaacgtcaacaacagccataaaaattattacaatttagcagaaaaatctgccacgaatcataagaaaaccattgctgccatcattttttactgattctggaaccagtttcaaggaatcagatattttgaattgtgcaaaagaaacaaaatttgttcattttttcataatctgctatatgatatgtcactgcatttttttctttgccatagaatttaattcttttagattttataatggttcagtaagtcaagacttcatcagttcatatccctttcgtttaaatattcagtaagtatagtacacaacatacctttaaaattaatttctttatggtggcattgtgcctttgactaaccattctgtatttgccttcgactttgctaaactaagcaatttcccttaatgtcaaccttgataagcaagtaagcattaaggcaacatttaaacactgaagcaatatatggttacatgattctaaataaactaaaccagtgcgacatcgtaattagtttccctgcctgctttgcgcaacttttctttccaaaattatatgcatgtcttttaattgttatgttaccagtattcatctaagaaacattctgcaataaaatgtagcagattttccaataataaagtttgctaaagaaaactcagcaaagtttaatggatttatgttactacaaaagaaaagtgcttgtttttaggtaattttgatgttcaaatgttttttggttttatcttgacagtaaatctttgaggatatagtgtaactgataaaataataaacagaatagaggtgaattcaagacttacacaaaatttaagccagtttgatgaacagttttgatcctcataaatctaacttgccagaatattaaattttgatatttttaatttattttacctaagttactttgattttttaaatatagattttatattttaagagcagtttttctaggttcacaaaaaacattgagtagaaggtacactgatatgtcatgtaacacctgctcccatacacagagcctccccaactatcaacatcccacgccagagtggtgcatttgttccaatcgatgaacttacattggtaagtcattatcatccaaacccccagtttacaatagggttcactcttggtattgtacatgctatgggtgtggataaatatataatgctatgtgttcaccattgcagtatcacactgagtagtttccccgccctaaaaatttccctgttgatttccccttcctccaaccctttgcaaccactggtctttttactgtctctacagttctgccttttccaaaatgccctagagtaggaatcacaaagtgggtaaccttttcagactgacttctttcacttagtaacgtgcacttcagttcactctatgtctttgcatggctttcggttaattttgttttagcaatgaataatattccattgtctgatacaccacaagtttatcatttcacctaccgaagtacactttggttgcttccagattttggcaaccaagaataaaccttctaaaaacatcccttggcaggtttttcagtacacgtaagtttttagctccttcagataaataacaaggagtgtgcttcctggactgcatgttgagagtatgtttagttttctaagaaaccacccaattgtcttccaaagtggctgttccatttcgcattcccatcagccataactcagagttattttactccatatccaagacagcaatctacattgttggtgttatggattttggccaatttcttttttcttgtttttacgtttgtattttaatgtgtgagttacttttatttagattttatccttcaactcacagtacagacattgttttgtgaaatatttaatattaggtaaagctacagcatcatttggtgtgaattaaatctagctagataaaacttcctgttttaaagtgagtgttttttcaaaactctgttgactatctacatatggtaagtggagtaaaattcaaggaaataattttaaaacaagaagtaacatataaataataaaatttttttatggtggatgtgatgatcttgattaatcagtagcactaatactgctaagcttacaattttggaaatgtaatgacttattcaacagtgtcattacattttaattttctacacctataccccttcatcattaattcaaaaattactactctaaataccatgccatgaaaagagaaacactgggtttgaatcaaggtttggttactcgttaggtgactttccatctgttatataagttttccaggcttctcaaattaattttagggtggtgatgtgggattgaggaataatcgtgaggagaaattaaataagcagagtaagctgttggtacatgtgtcattcccttctcttctttataaacattacattaagaaaactccaatacttatcatgtttttaaagaatacttttaaattttattatacctgatagtgttctcttaaaatgtaatcattagattatatgagtttaaggaattaatacaggatttttggaagaaaaaaaaatgacaaaaatatttgaaatatacaaaagttagaaaaaaacaaaatgatgttaaaaaagattaattttctttaatggatacaaatgataaatatagaatccatctacatttaaaaacatatctaaatagtattcataaaacaacagtcacacactgtacttgttggacagagaacacttacacattcaggtaagtgatgctaatatccttgagggttgcaggtgacctctgaaacagcctggcatgcttcccagaaatgaacccctaaactaatcaaacgcaatgccagctaatcctaccaatgtccccaggcgtaaatctagatataagctgttgtataagccaccaagccccgcccaaaatcttcttgaatgttttcatagtagtaatttatttaggtaccttattggtttacatacttctgtgattgagtccctcacacaagacacgattgaattttgagaatataagattttaaaatatgttgctgaggtggaggaaagattcaagtactaaaagtatttaaaaaatacagtttgtgcctgtagtcctagctacctgggaggcggaggcaggagaatggcgtgaaatccagaggtggagcttgcagtgagctgacattgtgccactgcactccaagcctgagcaacagagcaagactccatctcaaagaaaaaaaaaaatatatatatatgtatatatatagtttgatagtagtcctgaaaaagagacttcattatctgtttcaactgagcagtaggaatttttataattattgtagagtttcctatgttcttgtatgtttttgtccatgacacctgaggtttctgtattggtagaggctgtgtagacagtgaagtttaggtgggtacagatgtgtgtttagagaaactaagaattcatgtgctggtgcatgcatgacaggtatctatatttcagcctccactgcttaatatgatacctacgcctagccagtaactatcagcaacccaaagagctacacaccctccaggtgtcactgttcttttcaaaaggacatggaggtctgttgcagcgaaagttacagctgttgatccactcggttaagttctgtgtgccgggtatctcagctgtagaagcgcaaacacgtggtgtcccacaaattccttaggactctaaaacaactcttactaaaagatgtgccatttgtagaaaatataagcatcatgttttgtttgaggtggtgtcatgctatgtcgcccaggctgagtgcaatggcagtcattgctcactgtagcctcaagtgcccaagctcaagtcatcctcccacctcagcctgccaagtaggtgggacctccggtgcaccaccatgcccagctaatttttaaagttatttgtagagacatggtctcactatgttgcccaggcttggcttgaactccttgacacaagggatcattgaaccttggcctcccaaagtgccggaattacaggcgtgacccatcacacccggcccaagtatcatttttattacaagtttaatcactaagcatctcatcatttcttcctggtcatgccatgaggtgttagctcacgtgttgtcactccagccgcattatgtcactcttactaggttgttgcaaaactaattgcgttttttgccattgaaagtaaaagcaaattacttttgcaccaaccaacctgtgcctagcacagtatcagatatatatatactggataaactatcattactcttactcttcaaggtgtcactgtaagtaataacaattgaaacaaagtttgcaattatgggactgtacatctctttatatccttttcttgaccttatttacatgctcacactttaataagtgaattcccaatcttgcattaattacattcttaatgatgaggtcatagagcagcactgtctgatgcaaacataatgtgaaccccataacattattttaaatttgtagtagtctacttgaaaagcaaatgcaaaatagtcagttttatgacatatttcatttaacccaatatatccagattatcatatcaatatgcatttgatataaaatacataaacataaaagttcttaatggaatattttgtattatcttttttgtaacaggtctataaaagaccatacgtattatacacctacagcacatgttatttggatgctaaagttcccacaattaaagataaaatgtatatataccacacaataatagccataacatagaatgaaataacatttgcagcaacctggatgaagttggaggccattaccctaagttaagtaactcaggaatggaaaagcaaatactgtatattctcatttataagtgggagctaagcaatgaggatacaaaggcatgagaatgatataatggactttggggactcacggtgaactgtaggatgggagcaggggacagaagactgcatattgggtaccgtgtacactgctggggtgatgggtgcaccaaaatcaagaaaatcagctctaaagaacatatctatgtaacccaaaaccacctattgccccaaaactattgaagcataaaaaaagcaaaatgtagccctaccaaaatgatcagggtgtgtttaatgagacaatattttacactacttatctttttaaaatttaaatttgtttcaatgaacaacaaataatatttaaaatgtatttccttagcagcagcagcctcattttgaatgctcagcagccaggtggggtcagtggccaccatgtcagacagcacatgctgaaggcactgtgctttctgcctgcccctgtgctgggtgtttgtgaaatctttttgtgtttcccaggggactgctagaaaacagcaacaaacggggaggagaaaaaaacttagaatatctgtagataaatgtaaaaccctcaacttcccatataaacccaagatgttacttaggtgacatttttttttctacctacttctgaagtagaaaaccagataattttttccagagggcctgtattttaacttggaaaatcctgattttagggaaggagtgtcttcgaaggtgagaaaaacagtttttccttgcagtttagaaaattcgtgtctataacagaaagcattcttacgtaacttagaggtatctaagtaagactttgtgaagggtgcctggtgacacttcaatttaaataacaaactatgttaaatttcataggctaaagtgttcatgtaaaagaaatggtaatagaaatgttaacacactggaatagaatgacggtggctgagagactacattagaaaaattaaacctataacattttctaaaatgtatgtagctacctctgatttatataaaatcttgcttgttgcagaaattagcagcaaaaattcaaccatttaaggatatgcaaatggcagaaaaaaggatatgtgggggacagataaatccatctgtttggaagatacagattggccacataaaaagatattggttatatgatcaatttaaaatgataaatagtcaggctgggtgcagtggttcacacctgtaattccagcacttttagagaccaaggcaggaggattgcttgagttcaggagtttgagactagcctgggcaacatactcagactccatctctaccaagaattatatataaaaaggccagacatgatggcttaggcctgtaatctcagcactttgggaggctgaggcaggcggactgcctgaggtcaggagttcaagaccagcctggccagcatggtgaaaccctatctctactaaaaatacaaaaaattagccaggcgtggtggcagactcctgtaatcccagctaatcaggaagctgaggccgtagaattgcttgaaaccaggaggcagaagttgtagggagctgaaatcgcaccactgctctccagcttgggaaagagagcaaggctctgtctcaaaaataaaaaaaaatatacacacacacacacacacacacacacacacatacacacacacgtatgtatgtatatatacatatacacacacatatatacacaaacacacacaaaaaaattagttgacatggtaggatgcacctgtactcccaactacacaggaggctgaggcagaaagggctcccttgagaccaaaaggtcaaggctacagtgatccttgattgcgccactgtactcagtcttggtgacagagtgagacccttactctctctctcaatatatattttacatttattttttatattttagtaatattgcaatataacgtatttttagaaaagggatgtggtaaaagtagaaaaaagggctctaacatgcaacactagattaaaataagttacagacacagaacacaacagtgagcagatgagaagcagaaggacaatagacgggctttgcagggacaaaacgctaccaacatgtgtgcaagatgaacatcttagatcatcatgttttctactctggagtacatcattctcacattttttaaaaaatgctgttattaattcttttttaaaacacaaaaaaagaacccaactcttagacctcattggctattcaagttaggctttatttcttttccttacaataaaactctcctcttccctttcattttcctttgaactaacttcattccggctctctgttgtcttcagcctccaccacagttgctttagacacggtgactgatgatatcaggactgcttatccaaccgccagtgccaggccttgctctgtttaaccttggcctttgaggtacctgatcatctctgctatcctcaggccgttctcctcattttcctactatcttatcagccgcttactcttactctgttccagttgctggtttcttcttttctttctgacctctggatgtttctccctacctgtaagcctgctggcttagtccttgaacctcttttctcatccctgtaagctcactggtggtgatgcccagcttaatggtgtaaacaccgtctctacggtttcagaatgttaacatagtgtacgtcaccaacacatgtctgagcaaagtccagcagtgttctcaatactgcacacagatgtctgatgggtgcctcaatcttcctgagctcaaaaggcaactcctgatccttcctctaaagctggtccctcccatgtgccttcttccatctagataaatggcgactgcgttttccacttcctcaggccaaaaaacatgaggcattgtaaatactcgtctttttctcacatcccacctttaatctttcagctagttttcttcaacatatcccaaatctgactcaattctgaccacctctactgcggccttgtctccattttctctcctccagatgaaatggcagcctccaaactcatgttacttttctcatattttgctcttctcaacacaggcattagaagaatcttgtgaaatatgagaaaaagtgcatcagtcccttgctgctgcagggacgccatgagagccaacgccggaagagcacactcctggatggctccctgccctgtgcatggcttgctccctaccccattctcacttgtggaggttcaaacgcccccttgaggactattcatgggatgcttctttaccgttaaacgtatcttccttccaccagcagcactttctgtctgcccttcctgaattatttccatagcatgcgtcatcatttaggatactgtgtaatttacttctgttttctatgagtacctgtttccactattattatagaacgtaactcagaagagattttggcttgcgtgtgtgttttcctccatactgtatcctttgtgcatagaagagtgttagagcctaagagatcgtaaaatcaataagagattaaataattatttgaatactcaaaacctctaggtaaggaattgtgggtgagtcaaagattaaaaatatgtatccctaacctgttttctccctccaggggcttctcttgtaaaagttacccaaacctccttgttgataagagtgaaggacctttcacagtccacgcgtttctctctgcagaactagctgttatctcttctctttccccatctctctttctctttttgaattacccccttgccttgggtagagtctatgaatttaagcatttgcgtctcaatgatataaaaagtaacaaattctgtctcatttcatgcagttccgtatattcggataatttatgaaaaattgaattcaagagccacctgtgaaaagcatatgcatgtataccttgaatttaaaatgttcaaatacttcccctttttcctaatctataggtgcctctacttccttctgactgtaatgagattaatgaaatgttattaagtagaggtaaagtctatagtcggagtattggaatatggaacatggacaatggatgaaaaccttagcagtacactttcaaattctgtttctacaaacatgaattctgggtggaaaacatttgttttattacattcacttaagagaagtagaataagttggaggagctagaactctgacaaaagtaaactgatatagctagcatgtggatttttttttttctaaattaatactgtttagaaaaaggtagctaagggacacagaatttcaaatggttctgtttggggattacctatgtattcatcatgatcttctctcatttataacataagcatgaattcctgtaacatttttactcctttccaccctgcaaagtgcattcaaatcacttttcccattcacttattccaatgcctgtacaagctgtgttacgcaaatgtcattatcccagggctgcagttgacgaactgagactgtaagttcacaccttcagcatgggataatggccttccatatgcagaatgcaccgatctctccatcctcatctgtcagtgttcccctccacggtgcttaccagagtccagctgtactacctgcccttcagcacacaaaggtgaggtatccatgctcctgcttagtgcccatgctgttagtttcctctggatcaaatatccatcaccatcacagacctgtgtgaaacctacccgcaaaggtccagctcaaccgttcacttgtccatgcagttttcctaactcattcattcacctggcatttattgtaagcaaccctacgccaggctgttttccaggtgtagggattacagttgtggaaacaactccttaccttccttgaattttctctacaatttcttatggtatttattgtgaatatttgaccctattaattactttgtaatacaatcaatttatgcatgacttattggctctcctgaactaagaaatacataagaacagatgcatatgtgatcaatctttgtactctacagtttctttagttgacacttaacaaatgtacaataactactggatatggagtgatacgttgccaaatactacacaattccttaggggacggtcccactaaatttcactaagccaaatcccaaacttgcctgtttttttcccaatgcagataaactggtagaatatttagaacaaagttaatttgcttattctgatatttatgtgccaagcttctgaaattttcatctttttattttattcttttttatttcttggctcacaatccaatttacttgagtaacttcattcattagacaaatcatctaaatcccagtttaataaaaaatgcccattatgtgtgattctctcattacttacatcaaatacttgaatgcaattgtctgcatgtttttacataaattatgtttctcgcaatactctagattttgtgttctttcttgcataatgtaataatcagcatccttcatttgaatatcacggtttaataccaccaaagcagcacataatattttcaaataaaaggaaacacaatgcacgatgcttaaagtatctctttctcaggggaaggcgtatcacggagagtttatcatgcggatcatttcagtaggtgcatgactacctaaaatttgaaaagatggacctaagagaagtgtttgtgccttttaatgagaaaaactctacgccatctaaaataaaacactggaccaagagaatagggtcaagtctgcactgaacaaatgaatgtctggaatcctctttgtttcctcttgcaatgcagtaaccactgagcaggtgtggctaccgagatatgactagtgtcattgagaaaataaagtttaaattggattacctataattaaatcaaatccaaatctaaatagccagtgggtctcatggctcccgcgttacacagcatagtctaggtttcccaggtgttgtgttacaacagacactatcttattcacatgacaattaaaaaaaaaaactgaaggatcaacaatattctctaactatttctgctttgcttgcagtggaaagtgaggctccacaaatccagaactgtatatatggtaaggaacatctaactaagctcatggaacccaccctcctggtatttatgaactcctgcggtcctcccttaaatatgggctggaccaggtgtttcacacatattcattagaatattgcaaaagtgacaggatatcacttgacattaggttgtaaaaagactgtggcttccacctctttcttggatcccttacccacagagaagcctatcccatgtctttaggcagcccctggatatgtccatatggaagggactgagggctgtccacagccgtgtgcgtaggcataaaagggagcccagcccattccaggagttgagtctgagtcccagcaacaagttaacagcaacttacagaaaaacctcgagggctgaggcaggcagctaaaccatgctcagattcctgacccacagaaaccttgaaataataaatgcttggtattttagcccctaatattgcaagaaatttcctgcccagcaataaataacttccatcttaatttcagggaaaggttgtatgaaccacacggaggaagtaactatacagtgcaacaagtatagggttgctagattgattataatagcgcataaaaatacaggatgctcaattaaaagtgaatttcagataaacgaccaataactctttaatgcaagcttgtctcacgcaacatttggaatgtaataaaattttaaaaatgttctttgtctgagttccaaattgaagtgggaaatttgtgctgtatatggcaaacctaaccagatattcagtatgtggtgatgctgaacagaagatgagacagaggcataaagagaagtttgcatttaacgtggtgactacagaggtaaaggtcaccagaggacgttactgaagcacagaagaagagatagtaagttggatctagagacacagctaagtgctctcggtagatggggataaacaccatcctcttgtggtttacaagaaaggagaaagataaaattatcaaatgatgtaacaatatgattcgctgggtttaaaagttattagatacatagctttgtggaagttcggaaacactgaatgccacttttcagacccaaaactgtgataactgtagtaggaaaatttctgaattactcaaataattcagcaatcaatgagaaaattttttgtcattaataaaaaacttattttcaatattaaaagtaactcattctatgactcaaaagttagtggtgaggtgcgcttgaggaacaatctgatcaggcttctcagttcttccctacttcttgggaagtctcttctctccgggtttgaagtggcagctgaagttctgggctcagtacacatggctcagggtatgaactagcttcttccctcagccttgaaacaaaaacaaaaaactttctcctgactggaagcaaaggatatgtgaccatgcctggatcaatcaccatggccaagggaatgccctgagttcattggtttaggcctgggccacctgcctgcttatgatccaatcaacatcagggagactcacagagtggagggtagggcaagcctggaaagggagggtcacccaccaaaggctcgtggctgcccctagaggagaatgttaaactactgaggaaaacccagagcctcagcagctatgtgaggacaccgtcttgaaagcaaagcgctaaaaaggaaatgaatcttcagcaagaatagaggctaagtatttcatcatttttaaaggtcatccactacatgacctaggtattattcccgttttacagattaaagtgcagtctctgagagagcaagtcatttgcgcaaggcctaattcctttaaattaagagaaattgcacttcaccgtgtatgtaatctcctgacaatggtttttctattgtttaaataataggtttggaaggttattaaatctttgagaaactatgggtatatataataaatgacccccatgtccacccacctctcaaaagagatgtttttataaatactgcatgcactctggctgggatacacaatgtctgaagcctcttttataataattaaaacaaactctaagacctgggaatgtaggaattataggaaacagacccatgctaacatgctcaaagaaaaaaggtgtctagaacactgaagagagaggaagagggatgtgaggaagagggatgtgaggaagagggatgtgagggggaggggagggagagagacagaccgacacagattgtgagagattcagattagtttgtgtgccagagaaattacaccttcgcctcaaaatttcagataaaatattgatgttaatgtacactagacatctcagccacactctgacatctttgcagaactgatgtcaactccttaatttaatattgaagtctttaaaattagtattgatggctctttgagatacttgctgaattggaatctcttatctcactcttttccactttaagtatattacattcctttctaagtgaaccctgggcatctttcactgacttttactttgcactttcatagacaaatttctgccaagaataataatatctgaggaatagtgtaagacctcgaccatcaagaaagatcattgttgaaaagtgatttttaattacttcttactggggaaaattgagctcaagtcactaaggtgatctcacaatgtcaaccaattaaatgaaaccatttatatttaattatctctgctgatgggtcatatccttaggacagtgaatcttccattgtttaggttaaagttatcttcgtcacttttttctaaatactttttaacagtgttgggctctagtctgatcttctctcttacctgcgctatacttttattgttcaacggaatatgtttaagtaattgacatctttattttatgatagcaaaagcatccaaaattgtaaatatattttcttaaaacattacacaaagacaactgatagaagcccaatggataaatgtagacatgataaaaccagcccttagattttttgaaaggtatattaggagagtaaatatacaatgatcacgcaattatcacagcataatttgtgatggcaaaaacttgaagtcagaactatctaaaggtaaagaaactacatatacataatgtcctcacagaagggagaattttattgtccaagagaatgttgcctagaaaaataatggtgaaatattaagttaaaaagatataaagtcatgaatactatgatgatcatggcaatacaacagcatatataaaagtatgcagagtgaaagtaactggaaagaaataaccaaaatgttaccaagcgagtaatggggtccagttgatttctagtcctaattaccacttttctgtgtggtcactgtgcaggtgctgtcgacattggtggcatggggcagctgggcttctctcattgtattctctgtccttgagaggctagcccaggcttctcgccatagccatttcagggttcccaagaagcaggagcagaaaagtgtgacttagatgtggaacccttgcagaatcactcctgctaccttcttgtagacagaaagtctcaagggcagtccacatttataggggtggaaaagagactctatgtcttgatcagaagccctgcagaaccacatccaccctgttggatgtggctctgtaggctatatagcttatgtacgttcttatatacatttggtagattagactgcaaaaaatgagaacaaaattctatagcaagtgtccatcttatctatattgtttgctgacgtcaaccttttaaattgaaaataaattagtatgacaacaatctacactcttaagcctcttattctcatttttcccttttctcttatttaccatgatttttaccttggaagctttcctttcctttttgattattttctcatcctggcaccttctaacctcctcactcactactggttctataccttcactgtgacatatcaatcaccattctgatccctactaatataccccattttggcagtagaagtaccctctagtagaagggacataggagtaggaaattctaatccataaaagacacagactggcaaattggataaagagtcaagacccatcagtgtgctgtattcaggaaagccatctcacgtgcagagacacacataggctcaaaataaaaggatggaggaagatctaccaagcaaatggaaaacaaaaaaaggcaggggttgcaatcctagtctctgataaaacagactttaaaccaacaacgatcaaaagagacaaagaaggccattacataatggtaaagggatcaattcaacaagaagagctaactatcctaaatatatatgcacccaatacaggagcacccagattcataaagcaagtcctcagtgacctacaaagagacttagactcccacacaataaaaatgggagactttaacaccccactgtcaacattagaaatatcaacgagacagaaagtcaacaaggatatccaggaattgaactcatctctgcaccaagcggacctaatagacatctacagaactctccaccccaaatcaacagaatatacatgtttttcagcaccacaccacacctattccaaaattgaccacatagctggaagtaaagctctcctcagcaaatgtaaaagaagagaaattataacaaactgtctctcacaccacagtgcaatcaagctagaactcaggattaagaaactcactcaaaaccgctcaactacatggaaactgaacaacctgctcctgaatgaatactgggtacataacgaaatgacggcagaaataaagatgttctttgaaaccaacgagaacaaagacacaacataccagaatctctggggcacattcaaagcagtgtgtagagggaaacttatagcactaaatgtccacaagagaaagtaggaaagatccaaaattgacacccgaacatcacaattaaaagaactagaaaaacaagagcaaacacattcaaagctagcagaaggcaagaaataactaaaatcagagcagaactgaaggaaatagagatgcaaataacccttcaaaaaattaatgaatccaggagctgcttttttgaaaagatcaacaaaattgatagaccgctagcaagactaacaaagaaaaaaagagacaagaatcaaatagatgcaataaaaaatgataaaggggatatcaccaccgatcccactgaaatacaaactgccatcagagaatactacaaacacctctacgcaaataaactagaaaatctataagaaatggataaattcctcgacacatacactctcccaagactaaaccaggaagaagttaaatctctgaatagaccaataacaggatctgaaattgtggcaacaatcaatagcttatcaaccaaaaagagtccaggatcatatggactcacagccaaattctaccagagttacaaggaggaactagtaccattccttctgaaactattccaataaatagaaaaagagggcaccctcactaactcattttatgaggccagcatcatcctgataccaaagcctggcagagacacaaccaaaaaagagaattttagaccaatatccttgatgcagattgatgcagaaaccctcaatacgatactggcagaccgaatccagcagcacatcaaaaagctaatccactatcatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctataacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctttttgcagataatatgattgtttatctagaaaaccccactgtctcagcccaaaatctccttaagctgataggcaacttcagcaaagtctcaggatacaaaatcaatgtacaaaaattacaagcattgttatacaccaacaaaagacaaacagccaaatcaggagtgaactcccattcacaattccttcaaagagaataaaatacttagaaatccaacttacaagggatgagaaggacctcttcaaggagaactacaaaccactgctcaatgaaataagagaagatacaaacaaatggaagaacattccatgctcatgggtaggaagaatcaatatcgtgaaaatggccatactgcccaaggtaatttatacattcaatgccatccccatcaagctaccaatgactttcttcacataattagaaaaaactactttaaagttcatatggaaacaaaaaagagcccgcatcgccaagtcaatcctaagccaaaggaagaaagctggaggcatcacactacctgacttcaaactatactacaaggctacagaaaccaaaacagcatggtactggtaccaaaacagagatataaatcaatggaacagaacagagccctcagaaataatgccacgtatctacaactatctgatctttgacaaacctgacaaaaccaagcaatgggggaaggattccctatttaataaatggtgctgggaaaactggctagccatatgtagaaagctgaagctggatcccttccttacaccctatacaaaaatcaattcaagatggattaaagacttaaacgttagacctaaaaccataaaaaccctagaagaaaacctaggcattaccattcaggacgtaggcatgggcaaagacttcatgtctaaaacaccaaaagcaatgacaacaaaagacaaaattgacaaatggaatctaattaaactatagagcttctgcacagcaaaacaaactaccatcagagtgaacaggcaacctacagaatgggaggaaattttcgcaatctactcatctgacaaagggctaatatccagaatctacaatgaactccaacaaatttacaagaaaaaaacaaacaaccccatcaaaaagtggtgaacaatatgaacagacacttctcaaaagaagacatttatgcagccaaaagacacatgaaaaaatgctcatcatcactggccatcagagaaatgcaaaccaaaaccacaatgagataccatctcacaccagttagaatggcgatcattaaaaagtcaggaaacaaaaggtgctggagaggatgtggagaaataggaacacttttacactgttagtgggactgtaaactaattcaaccattgtggaagtcagtgtggcgattcctcaaggacctagaactggaaataccatttgacccagccatcccattactgggtatatacccaaagactataaatcatgctgctatgaagacacattcacacatatgtttactgcggcactattcacgacagcaaagacttggaaccaacccaaatgtccaacaatgatagactggattaagaaaatgtggcacatatacaccatggtatactatgcagcaataaaaaatgatgagttcatgtcctttgtagggatatggatgacactggaaatcatcattgtcagtaaactattgcaaggacaaaaaaccaaacaatgcatgttctcactcatacatgggaattgaaaaatgagaacacatggacacaggaaggggaacatcacactctggggactgctgtggggtggggggaggggggagggatagcattaggagatatgcctaatgctaaatgacgagttagtgggtgcagcacaccagcatggcacatgtatacatatgtaactaacctgcacattgtgcacatgtaccctaaaacttaaagtataataataattaaaaaaagaaaaaataaaataaaatacaaaacaaaacagaacaaaacaaaacaaaagaagttctaatcctgccctgccagcactggccatatgaaaggcaaggtagctcactggttgtcatggaactcaccttagaaaaatggaaacatggcactaactgttagaattccttcttatctaacattgtgttaatctaatatctgtatgtctttggtacaagagttcacaaatccaaccaaccaaaataacaacaattatgatatttaaaagctcacgatactaaattctgaacttgtaattactgtgcattggtatatttatttctaaattttcaaggtgccaaaattgccccactctgttaattaagccggggatgatgctgtgataatggcttaccatttccgtacccactattatggaataaaagcaaaaaagtccagctgaaaaataatgcaaaaaactaaagagtctccaaatatgaaaataggacaacagacctattgaacattccaacacatgattgaccagccaattccaagtgctgcgaaacagccatctattttggtgtatttgctttaaaagtaaatgagaaagcattgaataaatagacatcccatatagcaccgatgatttaaatttggtacttattatctatagccataccaccctgaacgtgcccaatctcatctgaatttgatatttattgtaaaacaataatgatttatgacatatatatccatgctaaaagaaatgcaatggtacggtttctcatttatttatttattttttttttgaatgcttaaactataaggcagggttctccaatcttttggcttccctgggcaacattggaaaaagaactgtcttgggtcacacagaaaatacactaacactaacgataactgatgagctttaaaaaaatcaccagaaaaccttacaatattttaagaaagtttatgaatttgtgtttggccacatgcaaagccttactgggccacaggatggaaaagcttgctataaggcttaaaattcatttatatttacattccattgcctgtaagaaaagttatagatgatcagaataatattgactcaattcatttatacttttttcaatataatctcccctcagaaattctaaacataaaacaaaataaacaacaattcttatcttgtcattgaaatattacgtattaacgatttaggtgactaattgactatgcagcaaatgcaaatgtaatatacattcgtacaaataaaatgataaattctcctttagcctagttgattataacatgatttcacagtgataaccacaaaggcaggacaagtacttagtactttgctaggtgattctgtttgtctgtgtctgcgtgtgtgtgtgtgtgtgatgtgtgtgtaatgtttacatttttaagtacacagaaactcatacacacccgtgtgtgtgtgtgtgtgtcggtgtgtgtgtgtgtgtatacctaaattaggtatttaaacctacctgaatagcatttcaatgctaaaacttaaacacaccaaaagaagacagaactaaaaaaacaacatagcaccaacaaaatagacctattagttttctgattaggttctgtgtttcattctcagtttactttaaacttatgatacataagaaaaaaacggaatatatctagattatcgtttgcatgatttgtttaaaagagggtaaagttctaagcttgcccttggtttcagtaaatttattcttgtaatccccaatacaccttccacatgccttacccaaagtatattatcttttaaaacttattagagagatcagtaaatgctgaacctgcccagcccacttatataatgaaataataaaatgtggattaaaacattgttttaataatcaaataagatacgtcacattattagcgaaatgttggacgggctatatatgctcaatcgatatttgttcctttcaaacataatgatgtatgatcacagaaaagaatttagcattctactctgagggaattttatggacaacagtgtttatcatatatactcattttcaggagtgacccctaaaaatagattcacaaattgtgaatgcccgattaatttgaagctttaagttagaaagaaaaagaacagctatataaataatggaacatcatttttttttctcactagtaatgcagtctcatagttaaatgaagtgaagggaatataatcaagttaaaacatgcaattataagggtcattctaattattgagacagaaattaatagcatcaaactcagagtctagaactgtatgtttgaatgggagaatgtaattgaagacggtggatagaatctcaattagcaaatgaagataatggccaataaagaaagaggcaaggaaaggaaggatcaaagtctttcaagtaaagagtaattacatgggatgagtagaaagtacacgtgattgtgttatatgcacagataccactgctagatgtcacactcatatcacagcgacaccctatatacagagatcatctttatgcagtgataattttatttcattttaaaagttaattaatgcgtaagtgcagtatagccctaggatgaatttaggggaaaaaatgggtatacagagtttggaaaatggagaagatcatctctaagaaaatttgcagtagactgaaaatttaattctgtaaaaaaatatttacactacagaatcagcaattaaatatatttaaaataatttattcatgtctgatgattaccactgaagtaatctaaatggtaacttcttctttcaataaggaagctgatgtaaaagcaactccataaaacatactgtgggtcacagcttgtcaataatttttagcccctcaatgacatgttcttcaattggaggtgaaaacactttgctttttctcttctatcatgcacagacattactggtttatttgtaatatgataagtcagagacagacattcctttaaaatttgaacttaagtaaaaattcataattttgaacttttttaaaatgattctgtcaaattgataagcacaattttaagtttccttacaaatacttaacaaaaataattttgttgtgagcagagaaatttaaaactatcaaatgatgaaaaataatatatcattttaaaagattagtgaagcaatatgagtatttcgttgatgaaagcttttctttcagcatcacttgagtatttctgtaagtacttattaaatgtctcccctcctggattgcccacctaccacttaaaacactcagtgagttttttagttggggcatgtggacagtttggccacagcttggggcagctaccacatgatagtctgggaaacctatgaactgctcctgagaacacagaaggaaaattctcagagcctccgacagtgtcatacacatgacaagggtacagttaatgtttgctgataatgatggcaaattctgttattatctaccctgcaataattagccaccttccctctgaaaactacattttaggaatgttaactataatttctaaaacttcattaaaatatataaatgcataactatgaaagaaaaagcaatggaaatgttatattaaatctgtgtcagtctgagcctaagagtataactgtaagcagagacaatatatttatttagcattcagcacagcccatatgctcatttataatctaacgctattcaggaattaatggctgaggctaactcttaaacatgagttttagacaagtcattagtcatcaacactggaactgtgctccctgaaaactagctatttccaattctaataatctggagcatatgaggatgttccttgcggcactattcacaatatcaaaggcatgaaatcaacctcaaaggccaccaatggcagactggataaagaaaatgtggcatgtatacaccatggaatactatgcagccataaaaaaggacaagattatgtcctttgcatgagcatggatggagctgtagaccattatctttagcaaactaacacaggaaaaaaaaaatcaaatgttctcatttataagttggagctaaaggaagacagatggacacaaagagggaaacaacagacaccagaggttggaaggtgggaggagggaggggaccgtgaaaaataactaatgggtactgggcttaatacctgggtgatgaaataatctgtaccacaacctgtgacacaggtttacttatataggaaacatgcacatgtacccctgaatttaaaataccccaacactttcggaggccaaggtgggtggatcacctgaggtcaggagttcaagaccagcctctgggtggatcacctgaggtcaggagttcaagaccagcctccccaatgtggtgaaaccccatctctattaaaaaatacaaaaattagctgggcctggtggtgggtgcctttaatcccagctacttgggaggctgaggcaggagaatggctagagcctgggaggcagaggttgcagtgagccaagatcgcaccactgcactccagcctgggcacctgagtgaaattttgcctcaaaaaaaaaaaaaaaaaaaaaaaagcaaacgaagaaaaaaccaaaaagaaacacaaaaatgcaaaaatgagtacaggctgggaacctgctttcttgcctttgaatcctggccctaccccttgcaattcgtcatgatcttgggcaaattgtttaatctttttgttttagggaccctgtcttaaaaagggctcacaatagttttgtcacaggtttactatgaagattaaattggacagggcttttaaagtacccagaatagtacccctaagcaataaacatacacgtgtgagcttgataaataatgattttaaaaacagcatacaccatacagactcaatacagatccattcagggaatccgaaaacactattctgctaatacaagtgggcataaagagaaacatgcgctaattttttaacacacaaatggatcaaaagtatcctacctatctagtaaatgtgctgatttatgaaattgcacgttatttaaatagctaatgtaaaaagtgacacattttaacatagtcacgtaaatgcccaatgaatgtctagtttgaagacatgtactgaaatatgttcgtcagatagactcatgcctttgaagagctatcattttgagataaaatatcccctaccagtggaaatgtgtaagatgagtggcagacccagtgccagagtcagaaagtgccctgcataagcatgcaatgaacagagcaaccgttcttgtaggcctgagtactaagatcacggctttcctgtttgtaaactgttattacgttgagttcatttccctgcaatactttcagcttaaggtctacggtggaatacagaaatcattcttaacaagtccacctatgttttgttatgatctgatacatacaaatccctaggtacatagtgcctgggtgggcctggattctgcacgtgtggaagacgcagctgttagaggaggcaccctctttgattgggccatgccaggctgtcaccaacgatttggcatccagaggccactggagcatatgagaagcagtcaaggtgccctgaatgttccagagaacattgtggaacactggaagctcaggacggccaaactgtgttgccatactcactgcagcagaggggaaagtgtaaaattacaagagaaggaggcccgtgttcaaggttgggggcagtcagctttccaactgggactcctcatggcccagccctgggctgattcctatcttcgtgttgaatgcagcatctctgctcaccccaagacagtccagtccctgacacactgagagtaagtttacagagcccaggtttccaccttgtaaaataaggatgctaataaggaaaataaataaataaataagatggaatttaattacttattttgaaaactggtgacttcacagcattatacgaatataaaagacgaaataataggaagggtctcagcattgctaatgtcaaatcagcccctctctcaatcttccaggggctaagaggctattatttttagatgcctctatttccccaaaatcagtatatttgttttctattaagactaaatatttttttcagcggcgtacggtcgctcacacctgtaatcccagcaatttgggaagctgaggcgggtggatcacttgaggtcaggagttcaagaccagcctggtctacatggtgacaccccgtctctactaaaaatacagaaaaaaaaaaaatcagccgggcgtggtgttgagtgcctgtagtcccagctactcgggaggctgaggcaggagaatcacctgaacccacgaggcagagattgcagtgagctgcactctagcctgggtgacacagcaagattctgtctcaaaaaaatataaataaaaataaaataacaagtgttcttcttcctttatagaacagttttaatgcccatataaatgtttgctcaaattgaaacaaacattatctctaaggtcccttaaaattctgaagaatttcaccaagtctccactctgttaaaacatattgatttactgcttgtagtattaaaaataagttgctttaaaacaatctgggacattgttggattctgttcagagaaaaaataatatggaactttaacatgtgcttatggcagagacttaaaatgacttttagggaatactgatgctctttcagtcataggaaaggacaacccactaggatgcaatggttttaactgacacaggtaagcattaagtagcatttgggccaggcacggtggctgatgcctataatcccagcactttgggaggccaaggcaggcagatcacctgaggtcaggaagagaccagcctgatcaacatggtgaaaccccgtcgctactaaaaatacaaaaaatcagcctgggtggtggcacatgcctgtaatcccagctacttgggagactcaggtaggagaatcgcctgaacccaggaggctaatgtaggagaatcgcttgaacccaggatgtggaggttgcagtgagccgagattgcatcactgcactccagcctgggcaacaagagtgaaactccgtctcaaaaaaaaaaaaaaaaaagcattcaggaagtttattctagttagtgtacattaaggcaccataaatgaacactcagagaaatatatttcactctcaccatatagtaaaataggcaggtattattattattttccaaaatcacagtttcagatgacttgctgagactatttcataggcagttttatacttttattctctcaggccatggcagcactggcatgatatcatgcatttgttgttaataaaatacaaaacagtccctattacaagtggtagatactaccatgggtatttttaattcccctgcgtttatctcctaaaaagccaatacctttttttaaaaaaagacctaagacagtgcaaacttcgtcctagtcataggtgatttaaaacaaatagaaaagtgactgctggcaggatgcacgacatgtaattaaaaacataggttttaaggtactgccacacacatcctaacgtatttaaattgcacgtcattcttctaacgatgattttggcaggaagggacaattttacatgatgtaaaatttgactctgaggacccagaaaacagcgcacttttggaggccacgcttgccctagacgtcggtcaatgtcccccggttgtcaaatcgctcacgtggttttctggaccaaatgaaagacaatgcaaaccgaggtgccttcattcattctgcataatagcaaacaacacaggaaacattcgtatattgcctcagattatttcggcagatacaagtcctgaaatccagcctgagaaactttattttggaaaagggtccatcaaccatggttaaacctggtcacaaaagatgacttgcaaatagtttatttgaggctgtctttaggaattcaggcagtatgaggtagacactgtcaactgacgcgccctacagttcactgcaagcttaagattctgtgagtaagattcccgccttttatctatcggaaaaatgaaaactctcataaaacagtctagtcttttaacctttataaaaaagaggaagtgtaaataaaaacataataaacaatttttgagtaatgtctagaaaagaaagatacacagatttttagtaggaaagaagataaagaaactccaggatgaatattatgggggaggatggtaattgggagggatattaaaaaaaaaaacgaaatgtttctgcatttgttattgggtctatggatctgcctgatgaaacacacggggttggcatagctgctgggtttctccctccatggtttactcagatattagagccctgtgttgaggggacccagacctaatgttggactgtgatgtaaacagaaatacacggttactgggcaaagccactgaaagcccaggttttatttgttataagagtgaaagttaattatctagtaatgaaaatacatgacattcacgttttggtttactcaaacatgccctgtaaaccaagtttgtgagtcatctctgagttcacagaaggtgcacacacagcacgtaagtgcccagctatgcaaactcatgtgtgtttatgccccaggacccataacagatctaagcccacctttgcccatctgtagagaaacacttcctatctctttactcaagaaaacatgttgagtaaatcaagatgaagcctggtgccaactgtgtttattaggaataatgataataaataatattaataagccatgaatattctaactctacctaaaagtttgcctttgttattagaaaataagaaaaaaacagtagtccagcaaagtatgtttgcagaaaagaaaaacaaaatttttccgctagacagagagctattaattgtataaacatatattaaagatcaatcaactttatggttaccatcaattatccctccaaaatgttgatatatgcatgatactatgttagttgattagtttttggaaaatggcaaagacccctagcaaagacccttctactgatgttctaaacccttatttatcatggaatgcatttgaacggaaagagtgttgagaattaatttttcatttgtattctaattaatacttttgacattagaaatcttgataaattatgaagattaaacaggcacacaaaggataattttatcttgttgccatatattaaggtaaagtggattcaaagagcacagctttttaacatattaatattttttgtggtacgtaatacatagccttgaatcatttctaagccattgaaaatctgtactcttttgcatattttttttttctaaaaagcagagagcatagtgtagtgcttaaaagcagagactcgccaggtgtggtggctcacgcctgaaatcccagcactttgggaggccaaggcaggtagaacacgaggtcaggagatcgagaccatcctggctaacatggtgaaaccccatctctactaaaaaatacaaaaaatgagccgggcgtggtggcaggtgcctgtggtcccagctactcaggaggctgaggcaagagaatggcgtgaacctgggaggtggagcttgcagtgagctgagatcgagtcactgccctccagcctgggcaacaaactccgtctccaaaaaaaaaaaaaaaaaaaaaagcagagactctgggtctggtctagttttacttacatctaagccctatcactgaagttaggggccagttaacttctaacagcctcagtttcctcaccaatgaagcagccactacttgacagaatggttatgacatttaatgattaacgctcattaatgtgaattgcttagaataatcagagcctaacactattagagtatttcgtaagttaaccaagtaaaataatacaatcaggaatacaaattaaaattttacatacacatataagcttttttttttttaactgaaagagactctgatgatctattcccatgtttataacgatgtggaatggaagctcaaaggggttaaagaataatattagtgttgtaatgagactgaaatctttgactatataaccagatagatttttcattatgaattaacaaacattttacagaaaatcatctgaaatcacatgaatggatataactaattaaacagtactatgcggccattataaaatgagagcatgtcctctgcagggacatggatggagctgggggccattacccttcgcaaactgatgcaggaacagaaaaccaaataccacatgatctgacttctaagagggagctaaattgtgagaacacatgggtacacataggtgaacgacacaaactgcggctcagtggagagtggggggggcggggaagggagaggatcaggacaaatggatactagacttagtacttgagtgatgaagtcatctgtgcaacaaacccccatgacaccagtttacctatgtaactaagatacacatggattaaaataaaataaaagttgaaaaaaattcaacaaggccaggcgaggtagctcatgcctgtaatcccagcactttgggaggccgaggcaggtggatcacgacgtcaggagattgagaccatcccggctaacatggtgaaaccccatctgtactaaaaacacaaaaaattagcagggcatggtggcaggcacctgtagtcccagctactcgggaggctgaggcaggagaatggcgtgaacccgggaggcagagcctgcagtgagcagagatcgcgccactgcactccagcctgggcaacagagcaagactctgtctcagaaaaaacaaaaaacaaaacaaaacaaaacaaaaaacacaaaaaacaaactaaaaaaaattgaacaagatagaactaaaagcattgttcttacttgtctgcaagatactggtgaagtggaggtcactaaaacatgtgtctcatctgaactacaactgaaaatgcttgtacttcatccatgaatcactgttcttcagctgtttaagctttctatgttgaaagaaaactacaagatacattgaaagaaaatgaaaagccatatgtaaaattcatcagattgatttcagttctttgtgcctttaccaaatatatatactctccttccactgaaaaaagggaaggtcattccaaaaaaaaaaaaaaaaaatggtggttcagttcatcctgtggttaaggttgaattgacttcatctcctatcgaatgatttacaatatgagtcagcaaaatcaacagtcagtttccagacctcagcaacatcaaaatttgacaacaattcaaagatgaggaaagaaagtgagcattagcacaattcagctcccttaaaccaactgcacccacaggcaaaacacccgtagaggaacacgtccctaaggatttcactcgaaatatgcaagcttcccgctgttgccaattctcctgcaacaaaagtatttgtgttttcatctcaatagccattacagacaaacagaaaaccaaaaacgtgggaaggagaaggatcatctgcattgcaaatatgacgcgtcttcactccagtgcaccaataggcatgttataaaggctcaacagatggctttaaaaatcaaagttaaaacagcaaagatgattgaatgttaacaaaatatagttcgttaggattataaattagatgactgtctagataataattttaatagtttcataaagtatgcaattacattgtcccatcaagcttcaggaggagctataatcagcagttcttggatgtcttagagactctttctcttgctctctttggctaagttgtgcctggaacatcaagaggccaccatcagaattataccttcctctgtgtggctctccgtgaatctcggtagcactgatgttgaccaccacataaactaaagcccgtttaagacaataccccctgacctttcagcaacaggggcttttatctacatcagcaccagctagtgggtattttactcttcatcagctttgccctataatgagaacaggttgggccacagcagagggcatatttgctcagggatcagagtgagaaaaaccttaaatctgcacttaaatcttaaatctgtattgctcaccaacatgtcgggtatgaggaattgtctatgtatttgcactttagtgacttctatcatttccattttcaagaatttccatttgtttcaggctcaaacacaacctcctcactcattacttgtggtaaacgctattaagcccaagatcactcatgttcctgtattctgtccttctaggaacttgattccataagtcacacctttaaggacatactcactttacctaagagtattttctgtacgtggtgctacccttcctattttcataatatttgagtgttttgcaaatcaaatgcaatcatatctttgtaactcaggaactgatcttggaatatcttaagttaatgtcattatgtatttatcttatttgaaatacatcttttgagcagtgacatgtgccttaaatttactttgaattctctgagctttcaggaaagacatctgtaaaagataagttgcccagtaccatgcatttaacctcagctctttggagtcataagcagggctgaaagcaaagttgtagctgccacaaacgtaaaaccttaacgacagggtattgtgaaaatacgttgcatcacacgtgtattaaaataccatgcccataatgaaaaccttgctttcaaagaacgtcctccaataaaaaaaatactcaatatatactgccagtttaaatgtactgagtatcaaaatgaatattcctgggcttccaagtctgtttgcttctctgttcacatccaggtacccatgccaggtcatgttttccctggatggaatgatggacattagggaaggtgacgatggcttcagtcttgctgatattacccaaggactggctgaagaggtctgagtcacaagaggctgtgggaaaacaaatgaaagaggcagaggatgagggtcccaccgggccctctgaggagccaatgagtgtgctgtcaagggaggcccagtgtttagtatttacccaaacacggcaaaccacagctcaacaaagataaaaatcggcatttcaaggcgcaggaaccacgtctccacaggagaatgtttaacaagtgattttggctggcaagttatggaatcggacagggatgacatcgaaggatgctatggcgagaagagcaggaaaacagaatacagttcagccgtgtttcccattcattcttcagcaccgagaagcctcagcagaactggccacctccacgaaggaaagcggcaggagaaagtacaatgtttaatggtgggaggtggggctgcaggtaatttatattctttcctaagtaaatgttctatgattactatatatccccttcataatgtttttgatatttaaggcatgatattaaaattatagtaactttcatatacaaaaaatatattaacaatttcaatctactgtaaatgttatggtaggcatacgttcaacaaagaatgcagaatgataaaaatgaccaagaaaacaattaaaatattgccctatcaagtctgtacatgtcatacctgacactactaaatttctttcgtccagcaatcaacactgctgcttttaacaccaaatgaggagtgaatttagaaattataatgaaggaataatataaaatgttcccaagtcattcctataggatgggatttagaagcttcaggagaaaaccacagacctaatttgccatgttgatattgctcacattggcatcagtcatgaaacaatggacactccaaatagcttgtaaaatatctaacaataaatggtgacaaaggcctgaattacaatagcgccctgtcacttttctaataaatagtgattatcatgtaaataatgccaggaagcatctcaacaactatttttattataatgttggcaacagcaaataaaaagtacgccattttcttttgtttcccctttgacattaatttgctaacagagtaatcatacatctcccacattttcttgcaaggaaaataaaaacatttaataaaatggggaaaaggatcatacaacacaaagccatttgccaaagttcttcaaattatgcttaacagatttcattatttaaataaacattttttttaacacatataaaacattcacaaccttcatgagactctttggtcactatgagttctgcaaagaaaaaaaaaagtttgtttcaggatctcccactgtattatacccattttcattggtcagccacataattagaactgttagttctaatttaatgggagatcacagtagaagaggtgattagtccccgggtgaaaatgaatatgagaatggactatctagctttctttcatctgggaattttccatctcttcacattgtaacttttttcactatctacaatttaaaaattacaaagcagtattcagctgttacgcctagaattctgcccatgaaattggaaacagaaaccagatgaaacattttaaaggaaaaattctactttgatgacagttctatccagaacatgtgtgtacactgacttgtcaatggaaaataaactaaaaccttgggtgcatacattcgatttcaggcagattttttaatttgttttttaagagacagggtcttgctctttcacccaggcagttccacaatcataatattaataggcagaaaaggcaaattctatagaacaggataagttaacaaatcaccctaacaaattggatcttctataacattttttaaaattataaaatctgtttgacccaccgatgcaagactgtgtcatgatttaaaaaagacgagtgtggcagtacagccttaatgtgctcctcgtgagtctcaccctctgttgttcacatctctgtatgatcccctgctcttgactgtgagaaagacttgtgatgtgcgtctgaccaatagtatatggtagaggtgagcgttgtcactgtcatgactgtgtgatattatataaggctgcatcttgcctggatggagttatcgatgctccttctaggcatgatgaagcagaggctgtgttgaagaattccacgcagggagaaattgtggaaatggcccccagacagcaaaacgtcggggctctccgtgctcatgccaggaggtagtggattctgcacacaacctgaatgagcttggatgcacagtcctgccctcaagcctgtagatgaggaggcagtggaattaacgccttgatcatagcatgcgagacttacggcagaggactcagcacagtcccaccccgagaaaactatgagataaaaaatgccaggccgggcgcggtggctcacgcctgtaatcccaacactttggggcaccgaggtgagcggatcatgaggtcatgcgatcgagaccatcctggctaacacagtgaaacctcgtctctactgaaaatacaaaaaattagccgggcgtggtgacgggcgcctgtagtcccagctgctggggagactgaggcaggagaatggcttgaacccgggaagtggagcttgcagggagccgagatcgcgccactgcactccagcctgggcgacggagcaagactccgtttcaaaaataaataaataaataaataataaaaataaacgtctgctgtgtcaagccactcttttgtggtcattgagtttacagagcgctcatttgttctatcgctgccgtacattactacaaatagagcggcttaagagaatacagtcttacttttagttctgtaggtctgaaattcaatacaggcctcactagacaaaaatcaaggcgttttcaggctacagtcctttctgaagcctcttagggaaaatctgtccaatgccgattcaggtgcttttagaatccagtttgttacatttatggggcccacattcccatttccttgctggctgtaaactgtgagtcattcatttttagcctcaaaagactaccacattctctggggtcatagccttctttgtgaatcttcaaggccagcaatgctgggtccagtcctcattgaatctttgtgacccattcttctgcctctttctactgcttttaagagttcacatagctagaataggtccaccagggtaattaggatggtctctatctcaagaccctttatcttatctgtaaacccctttttcccataaagcaacctattcacaggctccagggattaaggaatgaacacactgggggtgatatttagcctgcacatgccttcatagaaaacatatagtgaaagttccgccatcttcattaaattcccacatttctaagagtttgttcatgttaaaatttgtttgttctttgctccaattttagtcatttgagcctcaccgcccctcacaatatctattctacgctttctattttttaatgtgaaaatatttccttttctgttaaatttaacaattattcactgagagcttgtgttctatgggaaatgaaacatcaagatgaagacaatgcaaagtgtgtcctcaagcagttcccagacaaactacaacaaggttatcacctgttctcctacggtcaaaaaatgtgtataaaagtcctagcattttccagtaagagcatcatgaattctgagttattcacagataatttcgtataaccagatagattttcaaattgagaagtattaggcattaagtattatgatgggtaatgttatacaacaacctgacttggccataggatgcccagatatttggtcagacattattgtgggtgtgtctgtggtggtgtttttacataagatgaacatttcatttggtagaatgagtaaagcagatttccttctgtaatgtaggtgggccccgtttcatcacttgaaggcctcagtagatggaaaactgactctctgtcaagtaagacagagttcccttgcctgatggtcttccaactaaaacactggttctatttctttggagagccctggctaataaaaatcatcttccagctggacatggtggctcatgcctgaaatcccagcattttgggaggccgaggcaggtggatcatttgaggccaggagtttgaggccagcttggccaacatagtgaagctctgtctctactaaaaatacaaaaattagctgggcatggtggtgcgttcttgtaatcccagctacttgggaggctgatatgggaggattgcttgaacccaggaggcagaggttgcagtgagccaagataatgctaccacactccagcctgggcaacagagtaagactccatctaaaagttaagaagaaaaaaagcttcatccatttcatctattcattcatttagtaattctgtacacattgtcttctattcattggcttgactctgggaataaagtaatgaataaaacatgctatctttccttaagagttgggggcacagactgcagcaatgaagaagtatttatgctcagcgattatcaaagcgcaaagcgagggaagtctgggagtctgagttaaggtaagttttacgggagaaggttctttgagttgagtcttaaatgatgatcagcagtcccgaagcatgatcaggggagtcattccaagcagagagtccaaggtagcaaatacaaagaggtgcggagcaccacatcccattaagttatcctcaactcattattacagaagcacagaaggtaaaccccagagaagtggcagcaggggctggcaagcccgacaagagtacgtcatggtggacctgtgtgctaagccaggagcctgaactttgtcctacactgtgatggacagagacttttcagaattttcagattggcaatatagataagccatacctgtggtggttaggtaaaatatggatttgggggatgagaaagaaatcactagaggatgagaaagaaatcactaggatggatttgggggatgagaaagaaagtgtctagaaatatgacactttcaggaacgtgcacaaggaatttttcagcgcctttgattttaacgtaatgagtctttaagcatatagatcgatggataatgtcccattatcaacatagcttgccttttccagatggggctggtaaaaccccaaggactacatggatactaagtgtattttaatataattggttttctttgtaatctatactttctatgtgaattttgaaatactattctaagagttcatcgactttactagattaacagaggtcatggcacaaaaagttaaagtaccatctcaggagagacagcgcaacaatatcacgtatttccccttccttttaatttaattaaaactatttttactttccttccacgcaggttttttttgtatttccgtgtgtgtatttatctttttttaagacagtactgttgctcatttcctcctgtaatcctttgcaaatgagcaaagttcactttcaatcccctatgtacagtgagctctcatcctctgcagtctggcaaaacccctgaggtagtagagccagcgcccagctcaccctgagcttctgctgtccgtaaagttctcatatatttgtatgagactgcagaacgtatccagcacagcactggggatgatcctactttcagaaacattaaaaaatacaataccaaatatcctcttgaggttagacctagcctatagtgtgaacacgctaaattcatacatcttctgctatggtcattgatatgcaggcagtgtatgggtgctttttcatagtttgaggtctgtatctgaagtctacctctaaagcacatagatgctttaataaagatgcatagtgtggtggagtgaaaagaatggatttggtgctggcattagctgtcaagtcatgtaagtctattgcatctcagtttcctgagaaactccaattaaaaaggcaaataggaatatggtgtaaaatgtcaattttcatttaaatataagcgatcatcagtattgaatcctctcggctaccaaaggagctaccggacaacagacaaaccaatttatctttgattcctcctcaacgccttgcattttgctttgcataaataaagacttcaacccaagctcagtgtatgaggctggacaggcaaggcagtccagatttaatattgttaatccagtgccatttctcagggatcagatgctttgatcctcttaaaatattttcaaaaactgaagactcaaggataacatgctgtttagatagaaaatcggatgacttttgtaggtttccactagataacagcagcaacaaaactcttcctttacaagggcttaccatgacaatatttttaggcccttagtggaagacaagtcatacattttgtggtgaagtacggttacaaggagtttcaaccaatgtagaaaaaaagacctgaatgaaataaataatggtgactattaaaagttcaagggccctggacttgttgaaaattatgttgaggtgccataaaatcctgaatgattagctctatcaacaaatcatcctctttatatttttatgtaataagttatttgagattataacaactgaatgagatttccttcctttaacattatagtctgaaattgcaaaagctcctttttaactacctggacaaaatccagttaaatgttatgttatgaaattctggccagcatttcaaaacaattcctctattcaatacactgatgataattaccttttttcagaggataatttttttgttaattatgcttagagtgtcacttagatatggtatgctgtgtttagagtctgcttagcaaagcatgattttttaaaagaaatacaactttaaaaagcagaaaaaaattaatgaaaatttgatttaaaagaataaccccacagccgtctactcaacactcttatggtttaagtgacaaagttgaatctcagagataatcacttaggtaaaaaatgagaaattatttagaaatgtatattaatataaatgcctgctgtgctatccttatataattataaatcttggcgggcctggaggctcatgcctgaaatcccagcactttgtaggctgaggtgggaggatttcttgagactaagagttcaagaccaccctgggcaaggtaggaagaccgcacctctacaaaacataacaattaaaaaactagccagacatggttgtgtgtatctgtagtcccaactactctggcgactgagatgggaggatttgttaatggagacggaggcttcagtgaactattgttaggccactgcactctcgcctgagtgacaaagtgaaaccctgtctcaaaataatgatgataataataataacacatctttaagaaacgctaagctagtttaaagtatatgcattcatgtcttttctaatctccataactaaatgtcagaaagttgtcttattagtttactttttctccacagcgccgttcatatcagtgtggaaggcatcatgagatactacagagacgaattcaaacaccattcactactttctacctagataaccttgggccaatgtcttacctttcagagaatcagtgactttgcatatcaattacagatacctttgtagaattaaaatgactactgtaaggattaagtactgttgtgtatgcagaggaggtgatccaatacatggcacaaagaaaatactggtgagtatggttgtaagtaaaaaaattcagggccgggcgcagtggctcacgcctgtaatcccagcactttgggaggccgaggcgggcggatcacgaggtcaggagatcgagaccatcttgggtaacacggtgaaaccccatctctactaaaaatacaaaaaattagccgggggtggcgctgggcgcctgtagtcccagctactcaggaggctgaggcaggagaatggcatgaacacgggaggcggagcttgcagtgagccgacatagcgccactgccgtccggcctaggtaagagatccagactctgtctccacaaaaaaaaaaaaaaaaaaaaaaaaaaaaaaaaaaaatcagaaaacgatatgcaacaactgtagaagaaaattgaaatataaaatacaaataagcctttatttacccttgaccaaagttttcatttctataatttactcaagtgttatacctatgtgagaaaatgaagagctaggaaaaatagtttgaaaaacatgatgattggatacatggactcttgagagtctatgaagggaggtttatgtacctaacctcctgcacgactgctgttcaaattcttcagtgctccttatagaaggatcttaattgtgtctaattaacagtgatgaccattatacatggaaattttggggggggggggcgctgcattcatttgccatgctcaatagcatttattcaagccaaccacaaaaaccctgagacagaaaacaaaaatgaatcctacttgcattttgatgattatactctggatgagaagaaacgaggacattggaatctcccagtcctgctgtgggttggctcttaatgcttgcctctcagtttaagagtaaattttgtttttttgttagtttttttttctagagaaaacatctttcaatcagccatttctaggacgggtgggatgaccagctgtgttagtattattactcttataatgacgcaacaaaatgagatgtgactatttgatgaattatgccttatcttcacaattcagttaagattttattcatgttactgattatgctttaaaaaaatgaagcatctgcctatttgcttttcaagagctcacttacaatatggcattttaatgtcttcatgtatcattctgcacacttttttcttctaacagttcattcttaagctttttcacaagaatggaagaatgtagaggtcgtggaaatgtacaaaatgtttcattacgtaagttttaactaagttttaaactaggtcttcaataacaaatttgcacttttatacttaaaaatttaaaactctatttgtcaggacatcagcctcgacaaattactcctgtattcattcaaaaaaggttactttcctgcaatctctttgagtatcatggtggatattgtaaatttcctctcgaatacaaccaaccctgtagctacactcataaaactttcagtgaaagagggagaaccacactaatcaaacaagtactcaaatatttacttaataactaagtgttacaaagggagaaaatgatagtgatagaacagagaataaaactgaggattcaaacgtcagaaaatacctagaaaaagagggcagtgaagctgaaacttgaaacatcaaatgcaggtacctgagaaatagagggtgtcctggagaaggggcatggactgtgtggacacctggagtgaggagagatgttggccttatctctttttgcagttgtgggaggagaacgattacctccaccaaagatgtctgcatcgtaattcccagaacctgtgactatgtttccttacctgctgagaggatttgacaggtgtgagagttaaggattttgagcaagtgagatgacttgcagttatctgtgtgggttccctgttgtcataacatttcttaaaagctgaaaaccttttctggctcaggtcagagggacatgtcatttaaaaaatcgtcagtgagatgcaaccttgctggctttgaagatggagaaagaaggccacaagctcaggaatgttggcagcctgcagaagactgccctgactccttcagaaaagaacacaggcccctcaacaccacggggtcggctcagggagacccatctgcaggttagaagccaacatcagccttccaacctgtggaaatatgaggtgagatctttgtggtttctatgccactacatttgtggtaatatctcacagcagccagaaaaaaatccaatgtgcttttcttctttctataatgaagaaaacatgtttattctcgatgagcaaacggaagactttctgtgaatccaagtaccttctgttattaaacagctgggtgtgaatttggaagtcagtgtagctgggagacttagaatcaaagagcagctgtggcactcaaaatatgtatggctgggggtggacactacacacattggaagttggttcctctcctggccatttgtaagtagggatcacacacacacaaacatacacacacatacacatctgcacacatatgtacacgcacatatacatatagacatttgcatatatatgtacatatacataagctaatttgaggatggattaaaactaaaacttggtcaggagtcatggctcatacctgtaatcccagcacttttggaaggctgaggtaggtggatcccttgagccaaggagtttgaggccagcctgggaaatatggcgaaacctcatctctacaaaaaatacaaaaattagccaggtgtggtggtgcacgcctgtggtcccagctactcggaagactgaggcatcagaatcacttgagcccagtgggcagaagttgcggtgagctgagattgtgccactgtactccagcctgggtgacagaacaagactctgtctcaaaacacaaaacaaaacctaaaacttaaaggatctgtcagttttcaagtcctgaaattcattgactgtgcccatgtggtgctgtgtgcctgagatggaatttcaaagtggtttttcacaccagaacatcctcttttttctaatacccatttatgcaatgctaggaaaaaaaaaaaacctcaatttggaagtttttggttttctttctcagaatcagaatagttttttaaaaatgtcctatttccacttctaggtgagcaaactgacaacatcatttgatcatctgttctacaaattaggaaagatagaaacccaacccataagctaattccaaaaccacttttccttcatgaacacctgagattttgtcagcactttctagattgtaaaataaaccagattcaatttccataatttatttcctcacctttcaaagtgtagaagaaattatgacaccttttctatactgagaggaagattcaatctgacaaaaataattgcataaaagtgtgtaaggagacagtaggcaacaagcctaaattattttataaaaattattattagtagtattttgagacacagtttcactctgtcacccaggctggaatgcagcagtcagatcatagctcactgcagcctcaacctcccagcctcaatcaatcctcctgcctcagcctcctgagtagctgagaccacaggcacaggtcagcacacacagctaacttttatttaatttttttttacaaagacagggtatcactatattccccaggctggtcctgaactcctgtcctcaaagatcctcccatctcagcttcccaaagtgctgggattacaaatgtgagccactgaatctggcctataaaaattgttttcttattataataagaataatttacctccaattttctttctcatgtattcaagcaagagtaatttacctctatttttttcataacaatgccacagagtttactgtaaacatcaaatgctttaaaaagaaacatgatttaacataaacacatttatctcaactctgttgaatgaaattgttcttagagagaaaactgggtgaagaaacatctgatttaaataatagcattgcacatttctctttggtagaactctatttcaaatatcacctacattatatcatatttttgctgctcatatagtttttacaatagttccttgaaaaagattattgttatttactcagatattctaaaataagtatttaatgattgagataaatgtcacaagggaaaaagtgtgaacaattttttagccttggcatgtgcctcatctctttttagtatcaccaaactgatatttatttcatgatgcgcccatttatatacttacaaaagcaatttagttctacaaacaagccactcgaggtaactatctttatttcattttatggatgatgaaactgacattgaaagttgacggaactcactgaagtgacacagcatataaatgatggggtaggatgaagccctgacaatttccacccaggagccacacagagtgagaaagcctctcattgtaacggctgttgtggctcatttgggaaatttttacaaagtttcttcctaccaaataatagaggtttatttcagctcacttcctaggccactgtgagatgaacagctgtttgggccatagaagaaatagatgcctgtgttagatatttgtgggggtaaaaatggaaaattctcccccattaacatatgagtacaaataaacatcaaaaaacagaaaatgaacttcctattatgcactgtgcagaaaatcagtaccgagtcctcctgcagccacgtttttctgactcccaagttacttgctaccttctttttcacacgtttccattctctctacttcaggaattttctttctctttcttcagaaactacatagttcctccccatccatgccataaatcttccctggatccattcttcccaattcaaaggacagaaagtgagtaaataggataaacaacgcagggaaaaggatagggagggtattttaccttttccctggctattattcagaatatatggaaatacatgctgaaaaatgaggatttctttttctttttttaaatactttaagttctagagtacatgtgcacaaggggcaggtttgttacatatgtatacatgtgccatgttggtgtgctgcacccattaacttgtcatttacattaggtatatctcctgatgctatccctttcccctccccccaacccaccacaggccccggtatgtcatattccccaccctgtctccaactgttcagttcccacctatgactgagaacatgcggtgtttggttttctgtccttgtgatagtttgctcagaataatggtttccagcttcgtccatgtccctacaaaggacatgaactcatccttttttatggctgcctagtattccatggtgtatatgtgccacattttcttaatccagtctatcattgatggacatctgggttggttccaagctttgctactgtgaacagtgatgcaataaacgtatgtgtgcatgtgtctttacagcagcatgatctaaaatcctttgggtatataccctgtaatgggatggctgggtcaaatagtatttctagaggatttcagaatatttccaatgaaaccatatcatttctttaaatggtagttgattatataaagattgttctaatatttatgacttttgagtgattattttgtgggctcctagaagcaaattgttttaatacaatattatttttccatagttcagaaactaaatattttataatttagagttgggcaaattgccctcctctttgaatggataaaatgcctatttcatatagatgtggataaaattataaatctataaaaatgttttagtagataagatcacatattcctctttaaatgtgtatacctatttttctatttacatttgcaagaggtgtattatgaatgccagaaaattaaagtgttttctcattttctaaatagtcttaaaaataggacagttggtaaaaataggataatttataggtatagtaataagtataagattacaagttgacgtagataggaaatgaatgtgaaaagttgtataacatgcaaatatagccagcattcccattatttcaagtgacagaatgaaactgtacaattatggctggtctaaaccatgttaacgttaacttttagtggctaggactcgtaattatctgactagcaacaaattagcttaatagtttagataaattcacacactcatggaagattttaataagcaaatcatattttgtcttcaaccaactattttacagtcatttaattgaaccatatctaaaattttaaatagccgattaaaatgtcttattcatttaaaattaatatttcttaaactgaagttttagtttcaaatgtccatcaatagaaaataatgttaagaaaatgaatgaaactgaaatattaggtttaatattcaattcagtaagactggcaacattttcattatgaagagggggttgtttatgtattcctacataaattagtgtgcattcacatgtacatttcaaaagaaacatttttctgatgagtgtattaatagcaaaataacagtagatactgtaacatttcgataatctactaggatagcaaaccattagaactggcaatagcaaaagttacaataattatgttgaaacagatgcaacctcagccctggtgatgtcagtgataattggttccatataggtggagaaattagtcctcatggagcaacaaacataactatatttatattaaatagtctatttcttccatgcctaagaatttatctttaggcaatattcattatagcatgaaatagttaagcagagaaaagtttaaaacctaaaagtccaacagtaggagaatatgtaaatatatgagggtaattcacttttgttcagatatgtgtttactatctatttaatgcaatatcaggacaagcaatttcatacacatgatgattttcttaataaaacatatccaaacatattgtggaggctaaggtgttagaaatgaaaatagactcagctatggaacacagatatttcttcttgctttgaaaggtaactgctcctgttataattgccttctcggtcaaatacacagaggacaagaaacaagaagaattagaaaaaaagactggagaagaaataaaagcaaatcaggtcttatttgaatccttcctggagtaagagggaagcatttccccaaggaattgagttactggcctattataattaccatgttatgaaaactctattatggtttttcaaaatttctttggctataaaaaattgataattgatgtttctattcatctgcgttctgtagtttattaatctgtgatataccataagaacagattatatttttaaacttcaatatcagattgacttgactcattctattttctttttcctactgaaattaatgttaagaaaatgaatatagagtcataaaactaaggccgtgatatgcagtagaatgacataaaaccaattatgcaaaacatcatgatgagtcaagaaatgattaaaaatatagcagaattaaggcaataaaaagcatggaatatggagaatatattgtcgtggaaattttgtattacagaaatcagaagaagaacatctagaaaactgtccggttttacagttgtttaatatctggttggaaaattgaggtagcaataagtatccattcaaaataccagggagtgtgagattttcttaaatttctttttatatatgccctgtagacataacagataaaaacttgaccctttgcagtacgcaatttagagctgaaaaacctaccagtgaaagctgctttctgcttatgccgtgaaccataatgaatccaattgtattctctcctgtctctgacttcttgcttcttgaatttttctttttttgtcctctcttcacccttgctcgctgatgatttacagtgttaacacatcttcatgatttctatctaaaaccaaaatctgccctagagcccaaggttctttccagatgtaggtggctttatcgctcaccttttcaacacttttaaaaagacacttgcccagatttctaaacgaaaaagaggcagccagctggcctctttccttcatttcacagcttgctcttcagtggttcccatctatgagacatcttccctcaaactcacagggacagaaagaattccaaaggacacatagattcccatccttctgatgccgaagactctccagggttcctgtggaattgtatgaggtgtgaactcctcatcaagccaagtgaggacattgtcacatctgctagttcccgaacacttcccttaacctcactcccatggcccctcctctctgggaaacaggagccgcgtgagattccttgctgccatgctgcctcttctggcatttgtccacctgcctttccttttccctgtccccgtgatgcaggaaagacaagcccccgaattggggcttagcctgggagggttgttggcttcacccaggaaggaaatcaagggcaagccagtggtgtcacacagcaacttttattgactgaagcagcaccagatgtcctgctcctagcacagcaggactacaccataggccatgtgcccagagtggcagctcagaggctgttctacactcatatttatatccactttcaattacatgcaaaataaggagcggttaatgcagaaatttctagaatgtaggtggtaacttctgtgttgacaggtggtctccatggaaagcggtgaccacgtctgggtgttgctatgacaatggtaaactggcatggcacactggaggaggtgtcttatgaaaggctgcttctgccccagatctgttttagctagttctctatttggtccagtgtctaagccctgcttcctgagtcaagtcccacctcctacctcaccagccctgtaccaggagagctcctgatcattttcctccttcctgggcaaagcatttctcctgtcactgtgtgtcaaatctgatgctgcctcagcccatctgtgggagctccttcactccctccccaagccagcatgctgggcatgactttctcacaggaggggcagaggactgctctttgtttgtttctttgatgctttcattttcatcctctactgttagattccatgtcaagtgtgggattgtgctgtgtcaagtaagttgtatgataccaactttgagacattcaaatccaactttttcttctcaggattttatagtggaaactggtgggttatataaatctcagtcattttaaacaaaaaagatcaagtttctaactttgaactgcaaacagacaataattcaggaaaattttcttctcttatatcttagtgtgaaattggttcatctttgacttttaagaaagcacaaataggaaacacaatatctgaccaattttctaaaatgtttagagcaaaacaatagctaattaaataatatctcattaattatacaattagccaagaaaaaaaaacacttatctgaagaaagccaattttccacttcattttgctcatttaattgtaatgttaaacactaaaaatcacaaaatcttcaacatactgaaatatgaaagatcttttgaattcaatgagtaaatacgagcatatctacaaggtctcaagactatcagtcttggaaagaatcatgtatctcgggaaagaaatgtttcacagcagtgttgtcttcttggtccctcagaccatattttctataagaaatggttgacttaatgaaaaactcgattgtctggagttctgctttaaacttctctaaatgaaaaaatctcttcaggcaattactacaaacagaaagaaccacaatgaaataaaagtttcaaaaatattttaaaatacaaacacatttccttccttaagaaattcatgttcacatatcattgtacattacattttgggaattttcttgctgttatatattcctgaaatgtgtgttctaatcactaaataatttatccaggaaaaacatccttgtacatgtatttcagggaaagtcatttgcctttttttttttagctggcataaattaagcacctcagatagggggaaaagaaactgaaagaaatccaaagattgatcccttttctttggttcttttctttaatctgctatcattatatccaactgttaaatttctttacatttcttttattccctgtttttctttgaagtaatgcaattcatttaaaattattttacctaaatcagcatcactgaattttgtctacaaacatatagcagtttacgcatgacaaatgagaagattttagctcattttgaaaatttcactgggtgtttgaatgtatttattttcagttttatcttttgtatacttttgagcattccaagaaatgtttactcaaattagatagaagttttgctgaaacggcaaaagtcatctccaagttgctccataagaacagtaaatatcccatcgtactaaaatctgtaaatatggcagtatccttagctgaaatgcagactttaggcaagttgaacatgaagcaacctgactttgcaagtggggagttgacaaagagccctgcaaatgtcaacctccttcacaaactattttcttcaaactgtttttacatacttctggactttagatgataatttttcagtaggagtctttgagggtgagaaaacactaacttgctttaataacccaacatcatatctacagaaaacattcttccaacatcatcaatgtactattaggaagaaagggtaataaagtcaactgtattcctatcttagagacatttttagcagtatgtcttctgttataaaatagcagttgaaacttgcatttgtgcagctgtaatgcaataaaaggaccttaataattccttttcaactgtaagaaagaatatgccttgtcaacggaacgtaaaagtcatgatttcaaagaccatgtaggagaagaagtgtcctttattatgataaaaaagactctgtcacttccctatttatatatatatatatatatattattttctctccatgttgttttaacttattataccttagctaattttgcatcctttaactgactgactcagataaatactattctacaaacttagtcaaaactagatacctaccacccaaatatgtatctacaggtaacttgaagaaaatcccaccaattaaaaggctttacacatagagaatctcactaagatgaaagccatacttttcatgttttgacattaacgtcccaggtagttcagaaaatcatgaaaaatgtacttaacatttgtcctttcagactggcagatggaagcgatcctaaagcttatttagattagacattataaaattttgaaatttgtagcctttttttttctaaaataaagaatagttgatcaaggcctgacattgtcagtaggtggtagttatctaaacaatgatcctgtctactactgccaccatgttatcagtaaagtacaatttttaaaaatctaagaacagaaataattagttatatgtaaccacatacatgaatatgaaacattgtgaaaagtttacaacagcggccttattctttttttttttttttttttttttttacaagctattgaacaatctcattgcttttaccagccagttcatggactggcatttgggaaacacccttctagtccagctttccatcctacaggaagatgaggacaacagtttagaggctgagctggaaagaagacacttcttctcattcccaactagctttccttccctcatacccactgaagacctaacacctagcgttggcttccaagtcatgttgcctctcagtctttgttttcttatttttaaaactgagttactaatttaagacccactctaaggtcactttgagctaatgtctaagatggaagaatatagatgcttcacccagtggagcatgcttagactcaaagacaacatctggaaaatttcttactaggatataaaccaaatggggagagacatagttgagaatgtgaatcatatttcactaatgggtacttgttgtctatgaaccagctgggtggctccattctgtcagcaagtgaggcggggtcctgtcaggtctaatgagcagctctgctcacaccacacctctctgctccagacatgcaattcagagagtttctcaagggccgtgcacaaaaaaaggctattctttgaaatttacatgcttcaatccatcctaatcactgctggtagtgcttatggtaatagctaatatgtgagaacaggaacagttgcccggatactggccagttactagaatgaaaaacacttgctaaataaaatttggtggtgcgttaatgtagaaatgacagacacacaacgtctagaaataaaacacttttgctctcccacttgcaacgtgaaagaaaaatcaaatgtcagctttctgtttttaatgaattttaaaatgcagagtagggtgattgttgctcagcaactgagatgaaagcagccatgggccctccctggtgggaagccgtgggctcctgtgtgatttcctgaaagggtgggaatggggtagaacatggctgagatggggttccctgccagctgtggtgagggtggaacgcaaactaacttgcattgagaaagataagaaaagagacagttattgaaccccagtgtttaggctgagaatcagatgaggtgaaggtgaggtcctacagatactaatgaatgaatggagggatgactcattaattagacactagcatacgactatgtaaccacagtgcatttaacacatggtgtctttcaaggcacacaaacagaaaggggcaaagttctgacgatgtaagtaacaatggacaaaaaggaaaatgcaaaatgatcaataaatatctgacctactgaattatccagcatcttactccctcaatttcattccagtttttttgtttgttttgttttggcttagttcttggatctctactttgtattttaatttagcacatctttacataggatacggctcaatagatggaaattaaatgaatggactaaaatggaagtaagccttgaaatgtttgagacttttacaagaaaattttaccttattaaaattagtagtaatagtattagttttattatttgagaaaaggtctcactctgtcactgaggctggagtgcagtggtgcgatcttggctcactgcaacctctgcctcctggattcaatcgattcaaatgcctcaggcttctaagtagctgagactgcaggcatgcaccaccacacttggctaatgtttgtatttttggtagtgaaagggtcttcctctgttgcccaggttggtctcaaacccctgagctcatgcagtctgtctgacttggcctcccaaagtgctggaattacaggcatgagccactgtgcctggcccaccttattagaattttgaacagaaacactgagtatgtatttgcatgcacgtgtatgtgtgtgtgtatgagtatgagtgtgtttggtgtgtgtgtagctaacgtggatataggcaagagttcatcacagagaactacatattcccatatttgacatatttcctctaaatgctgtgatgcacatttcaaatgtagtataactttaagagaagctcaaaaatacgaacaaatttgaaataaaaaaactatgaccaccaggtttagatagcgtttttttaaaaaaatgtatattcttttttaagttttacaacttgtttttgttttcagctcacttttaatgagcacaaacgaagctcacttcacgtgagatacaggcacagcttactctgtcaggattactgagaaagtcaagttcaattctgcctcagttttaatgatttcttccaagctggctcagagaaagccatggaaccaacgaaatacaaacaatgcttctattccggacaagtgaataggtctcagttctcagggtgccaacctagggagaggggacgcatcccaaacaggggctgatagggaccttgtgtccacggcataaaggcttaaccagctgcgacctctaggtagaaattcttgatcagagatgtgcttttctcctgttcatagccaaatgctgtacttttcataatattcatctcctccctccccaccacccaatagttacatttggcttttagatgtccacagatggcacttcctttcttgcaaaaattttagatagaacatgaataacagattcaggcaaagataccatgtctgaatcattagtaacacaaaagactcaatgcttcctgaatattttacactgagaaaagaatttgggggccggggttttatgaatacatagagagttttttttttttcttccagagaccaggatcctttacattgttctgataatcatagatcaggcattttttccctaaaatttatacatgaaatatgcaaaaacatgtttactttgaacataaatttggatcatacaagaattgaaaataattttaaatgaggttttctaaaaacacagactttaatatgcagattctttaaaactcaaatgtacatgtgaatcttcatgagtaatacttcctgtcactttttctttaaaacattgttttcttggtggaatatctattctctccttttctggcactaacatttcaaagaacacagtgcatggaaaaggcagggtttatgtgattaattctatgatgttaagaataaagcagggacaaaaaaattaaacaagaacaaagagaacgtggattcatgcaggactgaacatgccagtttcttttgttggcatttttatccagacttaaactcagagagtggtgcccatttcagccacaaatagccagtcctctaacttcctgacagctgcacacccacgccagcctatgggaagaaagggaggtcactatgctatttcttggcatgcagtcctcttctcaatctggctgccacctgccttttttatgtaatcccattttttcacaggacaggaccagcctatgacacttgtggctttgtcaacattgcgatggccttcttccttccctgttcctgcacatgccctttttttctgcctggaatcctttcactctacgagacctgaccttctccctgtggttgcctagtcaattctatctgtcacctcagtaactgcagggatgctttcagttcccttgatctcatcacttttaacatggtgcacacaccatcagaatagtgtgtactattgtgtgcatggtaaaattaatacttatttgaagttcctaagtaagtaagtaaagcttgttaaattagtaattagtaaaattttactcattaatagaattagtgcttattcagtacccccacgggactaagaattctcaagatcaaagaacccggcctgagtctgctgccactgccaacggagccctccagatggaaggtgctgaggacaccgtgaagtgtgaatgctgggcctcacagccctgtgttctttcgtaaatgactgagtgaagggaagcttctcatgtttcatgtaagcaccagtcatctaggaggagggggtataaacgaatggagatgttttaagacctttaaaattaccattctctttacagaaaagagaaagtctccagatgaaattacacacagaattccaacacaagaaagaggtaaacatgaggatggggtgtcagacccacaccagcttgacagtctcccttttttccttcttttcttgcccagttttgatttccagcatccctttcaaaagccaacagctccaacaaaccttttttcaaaatggctgtcctaggataggtccccacggttaagacttctctaactagaattgtcttgtgtctcttaaaggataagtctttgatgctaatgcattaaatcaggtagtgtcctgtgtctgttatacaatatagtagataggggctgacattttagttggtgtagtgctagtctacatagtactttgtagaaaagcccagaaataactactgaatacttttcatgccgctgcttatcatgcaaagttatagctagcaacaattactcttcttgatataaaaatgcttctatctagatatgggatttagaatttgcagaagtctttcatataagccaagtgtccatgcaagcactgtgaatcccctgtgtgccaggtgctgccttggactctaacaatcaactatattttctctaatattagggaacttcatttcatgaaatataactctaatatagtttgacacattttataatggtgatataagacacgttataccatagctatacacagtgaattaaacacaggtaagggtcacatgactcgtccctggcatcaaggggagggagaaggtggtggtggaagtgtcttcttgaataaggaaggctttacgcagcaaaggtgtgagcttgaagggaaaccatttggtgaacaggcaagttatcttttgagaaactgttgaaaaagttgactcagttgacctcatcagaaaaaaaaaaaaattaggagctaattttgttgtctgaatttaaagttttaggaaatacaactgtatgacttctatactctacggtgttataggatactggaacatttagggcaggattgttgggctaagagaccacagagtatgaggtcgatcaccctctcaagtaagattcaaatgcaaaaagaaaatgtgaaaaggtgagccagaaaggaaacataagaggaggtggtttcagatgagactatgcaaagaagaagaacaagattcaggagcaaagaaatgtgcagaggctccaggtaatgccatggtagttggtgggaaacagtgaagaagaaatatccaacctcacaaaaagaaaacctatgctttactgatgggtttctggcagtggcttattaacccactgatgcctgaggttgcaattttttgaatttttgcaatcggacattggcgatgaccttgaacagcagggtataagtaactcctacatgctgaacgttctagtaatggaacactagttataaattcctaatcactcttgttggcactttgctcatttcattttatgagtatcccagggatgtagcaatttatctgaattgcgtgtgacaatagcaatacatccaagtttgactttcctatactgtgaattcttagcctattcattaatgcagaatattcaaactgttgattttgtttggtcatttctaatgattttctttaaacttttctctatctcaactcgaaaatgacctttatattatatacctacttttattctgccatgcttcatattttccatgaaagtctcaacctccacttgctgtatgatctttttctaataaataatatttgcatttatgcctctaaactcacatttgaatttgtttctgagtcaagttgtctatgttctctgtaataatgattaattttacagttgcttaatttcaataaaatcatatactgtttcataccgacagtgatttcagtattagtgggacagtggttaggctctaaagcttggatacatctcttcaaatagaggcaaccattacagtgatggtgactggtttcaatacaaacctggctgttttcatcagtctcttgatttggtcctgtaacaatatacagacttaacttctgttttctcagtgtcaatccttttattctgacaattatttcccctatacttttcctgagacatcacctcctattttcatagcaaaaatcaaatatatgatctttccattttggatctgaacccttggggtcattctctgagcaatgctattttttccaacgtatgtctaatcaaatactcccggtgtacagcaattacacaaattatcctcaagtcacactttgtgtcatttcccactaaaatggtcatacgttagaggtacaccgtctactctatcacttttcctgttcctctaacacccagggtaaatgatcagacccagcctcctttcatctgtgccctttttgtagcacctggtgttgtgttcccatctcccctcccgtgttctgcagaatttctgctgtaaaattattttttcaccctcttttaccactccatctgctaaatatagttaccactttacaaatatgtgattatttctttcagttcaaatgcaggtcttttcttctctctcagtaatttcattcactttcgtaacttgagctggaattgggcacatccccctggcacagagtaagtgctcaataaatatttataaaattaattacagagcctccatggtaattgggctctgatcataattcatacccgaacctctctcttgaactctagtcctgaatttccttccgtctcttgggtgttcccaacatttctcgtgaacaccgcaaacgtgacttaaacatttatgcttatgttaaaaaaaaaacttaaaaattattggtctcaatttctacggttggctccaacccaaaaaacactatatcactttaagcaaatctttgttcactaatgaagagtgagatcatttggataatactgctacacaagtcaagagtttaaatattattttggggactgtcttcacaatgtaacttggtttgaatgacttcttttcctgaaaataatatttttaatgtcaccagatagccattatgtattaatgtcttacttagtagagctaattatctgtaagttacttttattgtagtggggagtgcatagaaagacaaaatctcgaattaataccaggtggaaacgatgtacttgtaatatgatggagagaatcactcaagataattttttaaaaattttttaatgctttttttttgaaatggagtctcactctgtcacccaggctggagtgcagtggtgcgatctaggctgactacaacctctgcctctcaggtttaagcaattctcgtgcctcagcctcccgagtacctgtgattacaggcacgtgccaccatgcccagctgattttttgtattttcagtagagacagggttttgccatgtcggccaagctcgtcttgaactcctgacgtcaggtgatgtgctcgccttcgcctctcagagtgccgggattagaggcgtgagccaccatgcccagtctcaagataacttagagatacttgtcagtgaggccttcctgacaaggttatttgactggaaatttgaagcgtgagaaggaggttagcatgtacaacagcaggaaagaggaccacaccatgaggaggacccacagaggcctctagacaacggttagtgtttagcagtatgcgacgtccatgggatggcattagaggtcagggcagtgagaagacctcatgcattaattttaaaacatcactttgtgtaagaaatatctaatcctagtgcaagagtggaaacatggagacattactaaacaattttaggttttgtgtgaaataattgtggcttttcctagagtgataagggtccatgtgagaggaaggaccagtggtatattttggaggtggaatcaacacaatttgaagatggcttagcaaaagaaggaaagggaagatcaagaacatttcccaggtgcatgcattgagcaattcactagctgggatgagaaagacagagaaacagggtggagaatatggggccacccaagaaatccttataacgcaccgaacgcagctcaggtaagacaccatggggctgagtgagaactacaagaggaaaagtagcttggggtaacaagtaagaagatttgggactggatgtgggaggaataagtaggcttcctgatagaacatgtgtgtgcacagttcacaccacacggttgagtgcgcaggcgcccagaggagcccttggggtgctctcctctgccatgccatgtgcccgcaggaggaggccagtgattgtccagcttttcccatgagcgaaaaacccaaactttagtttggggaaatcacttcatttaaacaagagaggaatacaacggacaagacagagaatagaaatgtaaagagcggaggaatatcactgaagctccatccgtgattctgcatttcaatctggctttagtctctgccccataaatatttcaaatacaacatatataaaatgaaatgtatgaaatgtatcaacacctgctctggagaattttcagttaaacatggcatattgaatacactcatggacttaccacttcttgctcacaaaatgtttcaaaggcacaaagaagcccatctctacaaggaaagtgagaaaaaaaaaaaaaaacaacacattgacagcagcaaaacttgagaagctactgggttaacagacaactggaactgacttagcagaattgataaagctgaaatttaaatgggtaatttgggaattcgtgaaacaagccaatttgcagcacagaatcccaggaaggctcaagagcaggaggcctcagatgtgtgtcaaaacatgtgaaaacagtgctccaaaaaaaagacctctgagaatagtgaataagacaatttcacatcccctgacaccatcccctacttgacaggagaggcactgccattcccacattccagcaatagactggaggctttctctccagagatgctcaattagactatgggatgctgggctagcctacattgagattaaaagaaaatatacattctgaaaggtggacctccaaatctccttttcctacttggctctgagaattcttacaggaattcttattacactcaggaaggatattagagaattcttagcagaggaaattcaccagaccagagaaaatgcctagagaagctaaggcaaggaaccagtaacaacactgtccagcacatccatctgcaatggaggaagctgtccacccaacggtctgtccctacaccacataaacctgtacattttagttctctagagtatgagaagacatcaaaggccatcaatgacttagaaaagccattagtggaagaaagatcaaaccaacaaaaaaaaaaaacagaagcaagtagaagagaaccttcacagagccttaccaccatctcaaaaccccttctgtgtctacactcacaagctctaccagataattgaatcaagattcctgtaacacgcagaaagttatgatgggtcagctaatcttttcccagttatgattttcccaggtattgcttttaatttttaggcaatttggaaaacttgggggatacagtaggtatcagtgttttgcctcagtcttattctgtaaacagaataagaagcttccatcttattctgtaaacagaataagaagcttccatcttattctgtaaagtgaggtctttgtgcattgtgtagtacctggtccgtcatatgttctcagtaagtcagtcaataatatagttgttaatattattattgttaaataatcaagaaaacataaaaaccacagaagtacagaaaaaggttaaaggctattactttaaaaatctgattgtccgaagcctggctgctcccacaaatcaagaactgtcatttaaatttctgaatcaatgtgacggcagatgccaaattcagtaacacaactattcagttatgcctctatctggttcgcttctgtaggtgataaaaagtggtcaaacactctttctgcccagatggaggttatagtttagctcaccgagtcatcattaagggctggttgagctgacctgaggattttgccagactaagagtcgctgaaaataccatgaggacaattaatttgttttgatcactagacataaccacaaaactatgggcaagtgaaagttatgcaaagcgtttataatccaagtcctaaaaagacatttcttaaaaaaaaaataatttgggctttgagaagctgaagttagattaaagcaaataaatagacaaaaacataataataagaagaactgacaacaggcttcctacattggacattggagagctgcctaaacagctggttccctcccgccctgccctgagcatctgtagtagcaagtggctcagtaagaccttggggaaaggagggcaacgccacccagaggagcctccgggagttaataaaagtcacttctgcaccccgagaaaagccacaaatgaaatctttgcttcttgaacatttatctttttctatcaactgacattctgagcatccagactttttgcctcgaaattcacctgcacactcgtggggactctgaagaacactgttgtctcagaacaatttaaactcctacctgtagtccatccatcaagtaaattcagctgccgccaaggtaagcaggaaagggcgtcatcgccagggatacgtgacgaataggctgactgctggcccagaccatgccatggctgggaaggataattggtagagatgattgcacagggcgtaatctaccacaccactgctcgttaataaccaccaggagagctggcctgcaaggcaggacctgtgtcacctgaatgttcatcaaagcaggttgattgaccatgggaaagaatagattagcagccaggactcagcgagttaaaccccagtctgtctgtgctcttggaaaaatcatttgacttccagagcctgaatatttttttgttatctgaaaaatgaggaatttgggtcagattctcagaatatttctagcaaaggtgacctagtctgatgcaaattaaaaagccccttggccaataacaaccagtgaaactgttttctttttttgttgagactgataatgaacatgtaaaggtccctaaaagtcctgcatggaaaattaaaatgcttatcactatttctcttccagacggttaataacatccaggggtcctttgtgcttgaacatactagtccaaccacttttgagagcctttctagtaaaattctttaaacccaaactcgtatcccgggtacgttattttaacaaaacatgcatacgtaaccctactcaaacagggctaaaggctgatggaactgacctgaggattttgccaggctaagagtaactgaacataccatgaggacacttaactttgtttcgcttactacacataatcacaaaactatagacaagtgaaagttatgcaaagcgtttgtgatccaagtcctaaaaaggcctttttcagaaaaaaaaaataatttgaaaatgcttgcacacgtttttccataattgtggtaaaatatacaaaacattaagatattttaaccagtccaagagcacattttggcagccttaggtacatgtacgatgttgcgcaacagcacatattttgatgccaattcaacttcagaaagtcatatttaaatacacctaggaaatcttttaaagcttattctcagaggccaggttggggaatagttgctctgacccatctacactctcagttcagtgtctactaaatgccctcttcgcctaagttacccggctaggaactcaagggaagaggaagtcccacggtgcttcagtggtgcctccggagttccaccactttgcaaaggttatgacttcagactgaattttcatccatagtgaagagggagataagtggatagaattccccactgctcaatttcagatgcatggagatgaattactaatatagcttcttttttcctccctagcttttggtgcattctccccatagtattaacctgtagtactcaaaactcttaaaatgttaaaatgtgtgttcataatattcctcatcatgggaggatatatagggcgctgtggctcacgcctgtcatcccagcactttgggataccaaggcaggtggatcatttgaggtcaggagtccaaaggccagccttcccaatattgtgaaaccccatcactaataaaattaaaaaaaattagttgggcgtggtgccgtgcacctgaaatcccagctattggggaggctgaggcaagacaatcgcttgaaccctagaggcagaggttgcagtgagctgacatcacaccactgcactccagcctggggaacagagtgagactccacctcaaaaaaagaaaaatcctgaaattcattttatttgttcatgtcagggcaacttcattgtactatttcaggacacatggcaactcagcgcacacctccataaaccagagacggctagtgaaaggagaatcaatgacaaaccatcattttcttcaaaatagaaaaaaatattatttaatcatgttttaaactttcttttctgaatcatcgagacttgatgttattttaatttccacctaaaatatgtaattaacaatatacatcgtgtttctcatgaatttctagttcgtaagcctctagataagaacattttcatacattattctgatgagtatttgtttagaaataacaataaaatacaaaatgcttcaagtttatataaagcaactcatcacttttttttttttttttattcctttttgcctctattttttcttcttccttagcatggctgttaagagcctaaatacatcacatttttatttgggaggaaatatgctgttgtccattttcctgtctgatctgcatcataaccagagaaattaaaagcaggaaagtggtgatgccttaggaaactgtctcaccaggcaaggatgttatcctgacaaattgccacaacatggcggcttctgagtaaaggtttcaatggggccaatctattcaaatctattcagagtgaaattaatattttattgcatgacattcttagatgtaaagtggcacaatatgatcagcctaaatgaaagttttaactgtgcatatatttggattcttctattaagattgtaattaattataattgtctaataatttcttatttggtagaatttatttgaatgtgaatttcatgttgagttatttgatagattcaagttcaagaggtatgttaaaataaattttcccatgaatatttagttttacctactcaagtaagctggaaggttagagctgacaggcggacacacacacacacacacacacacacacacacacacacacgccaacacacatacacacttgctagcatgagagtttcatttttctgttacttggcatcttactcttagcaacttaaaggagatcattttactaaccactctttaccttgaaaggatcccagcaaaaacaaaaagtaaaatagtgtattaacaccttcaaaagtatttgggtatttggataaaatagttgttgacattcaaaaaagaattagagaccatcaaatactctacttaaaaatgtatttatctgacataccattttgcatatacaattacaaccctctctgaaaagatgcagaaataaaacataacatgcagaattaattcagcacacaaaaacagcaaagaattaaaatacttgcaatttagaaattttacaggactttgcagtaacagaacctataatgagtcaaaacaattagccttgatcctaaaaaatcatggataccataagttgaaaaaactaataacttattaaaagggctgtatttttctgcattgatattctataacatcaattacttcattaaacaaaataattacagtataatcatagaaattagtaaatgtattcctttaaaaattttacgtcctctttaaaaaagaaaaaaaaatgagtttttaataatcagttaacctggcactgagctttaaattgaatttaagaaaaaaacaaaaactctgccccattagtgcaagagtaaagttgggttgttgaaatgcaaatgcaaatgcatgtagtctccccctgtctttagtttgggaataagaaatacatatttgaacgtaaaggattttttgttgttgttgtcactttctgtttttatttcataaggctgcttaacagttttactttagtttggagaagcacagttctgaaaactaaagggggtaaatcccgtcattatctctgcaggtgagatgggtctgtatcaactctaagactgaacgactctgaaggtgaaataataaatgacgcatgcctgaggtcttttctgggaaggaaatcgcccccaagagaagggttttttagcccagaaagcactcaggctgcctctttgcctgccctcatggttgctgagggacgtttaagtcaaactgaaagtactgcatgacccgatgagaatcattaacctcattagcaacatggacgagcaagatggcgaccacatatcccctcggtctgccttgggggctgtcgtggcctctcccaccactcaccacccctgcctgtcctaataagaggtctattgtctaacattttaagaaccctattctatccacttataagaaccctgttgtcttccattataagaaccctatggtcaaagcctagtgtatgacattcagaacaagaaaagtttctgaggagtcctgtgcccttgaggctggaggagcgcattaaatccacacattatagacctaactgagaagcaggggtgccaggaagcataattattcagaagagaagtcccacagcccccgacctcaggattccctgcacattcagtcagacactcggccttcttcctaccaatcattgccagtgatcctcctggcagacacagcctccatcctacattaaaccccacacctggagacacaccctccaccccacattaactcccacacctggagacacaccctccatcctgcattcaatcccaaaccaggagacacaccctccatcctacagtcaaccccacaccaggagacatactctccatcctgcattaaaccccacaccaggagacacagcctccatcctacattcaaccccacacttggagacacaccctccaccccacattaaatcccacacctagacacacaccctccatcctgcattcaatcccacaccaggagacacgccctccatcctacattaaaccccacacctggagacataccctccaccccacattaaatcccacaccaggaagcacgccctctaacttgcattaaaccccacaccaggagacacactctctatccttcattcaaccccgtaacaggagacataccctccatcctgcattaaatgccacagaaggaaacaccccctccaccctgcatgcaatcccacatccaggtttccttggctgctgtatcattcccttcactgtaaaaatatttgccttcctgtcatcctttccagtcacaggccctggtgctgctggccctggcagtaaaactctttgaaataggtgttttattctctgtctctaattcctccctcccattttcctttccagttttcctctgaaaccgctcatgtcaaggttatctatgccccatattttgctgaatttaagcagcagcacctacactcatctcaggtcacctgaaagcagcaccacacagcttccactgtatcctcccccaactgtctctggtcttccagtcaaccctgtatcttggctcttctacaacccactggctgtacttttagtatccttggcaattctcttctctgtcagatcttttttttttttttttcctaccctcacttcccaagtaactttttccagtctcacccatttgcagatgactatcgattgttttattttattcatttattatttcttttttcttgagatggagtctacctctgtcacccaggctggagtgcagtggtgggatcttagctcaatgcaacctctgcctcctgggttcaaaagattctcctgcttctgcatcccaagtagctgggacttcatgtgcaccactgtgcccagctaatttttgtatttttagtagagaccggctttccccaagttggccaggctggtcttgaactcctgactgcctcggtctccaaaagtgctgggattacaggagtgagccactgagccaagccaggacccctgattttaaagcgcgaacctggacttttccatgaaattgagacacatatatccgactgtcttctcaaccacctgggatatcagactaagctttcccaaacctgattcctgatgcactcccaagtgtgcttttccacacagtcttcccagcttgctagagaataactccctttttctatttgggcaggacaaaaacccggagtcaacttgtattcctccttttctgtcaaataccaaatcagcacattggccaatttggctagtcctactcaaaagacgctgagatgctgagcaatcctccccacctcattcttcagtggcttgagccaccattatctatcacctgaatgagtccaatgtgcttctttcttatccacttttgtgccatcatcaacaaagcagccctaagattctcttagatcacaagctagatcatacctaccacaatcactcattatcttttcaacaaccttacagaagacccacaatcaccaacaagcacttaccaaagaaagaacattttgtcttcatataattctactgtagcttttttcctcttatttctcacacttacccagcattccccatcctcagcaccttacaggacctgtttccactgcatgaaggctcttccccagatgccctcatagttcactcctcttctccagctgcttaaaggccatcttcttagtgaagttcgttctcaccatctgatgtacagcctcagccccttcctcttgcttgacccaccccatcctctgccgtcctgcttctacatagcatatcacaatgcgacccactaagtgtttcatcactcactccttccttttttccctcacaaacgtatgaatcccaagagggccgggattttatcgctttggtctgtgttctgccccagtgttgaaatctgtgtatcgctttgagtgatactcaataatatttgttgattgagtgaatatcttacattctaatatcaagagacttttacgtcctaaagccgacattataacacttaagtctgtaataaatgcatatgattttgctattcaacattttaaacataagaacatcttacgtgcgtgcgtgcactcaggtgtgtatacaagcttattagactacaagccttataaacctttttctaagattaaatcatctcagaatgtgatgacatattgcagtgctgggtatgtttgaattgatattctgagccaaattatcttaagatctagagtttccctctaatcttaataaatgtttgtgttgctctacaatagatttatatcgttgagtatcttatattctagatttatattaaaacatttaatcctcaattaatctatccaattaatccatccattgcataaagcaaatcaagccgagtaaactctggtgacctacctgaggtcagacaactaataaataaatgatcttgtatataatccaaggtctaacctgtgacttaacatatttattaaattatatcccaatcaataactattaaactctgctcaaagtagatataatggttactgtcctttcccacatacagagtttttaggccagttgctcaattatattggacaataaagtccaatcataaaacacatccttaatgttcatggctgttatgtatcaagatgtttttaaacccccaaatttgtgactaccaagtagctcataattttctccataaatattataaatttttactgcctaatagtaattttcctagacctttaatgactataaatataaaaccgattacaagctattgaaataaattctatcagtttttttttgactttcaagtaatttttacctctcatacttcagcagcttttgcagtgtcacaatgtattttttgtggttaggaacaatcgattatagattctttaacggcactaacttgagtcaccaccaaattcaatattatatgctgtgattttttaatctcctgtttttttctacttggaaaacatgtgcttagattatttcatttgcaacatcagtactagtattttgtttcatcacacacacattcacagagcaaaaactatccaacttgctaccgtgggaaaattggggaaagcgtttttacaagggttatcctaaattaagcatttctccaccaaggatatatgttgaactacagaagagtattacgaaaactaacaggatattgatatagtgaaatgtttaaaatacacatcaattgcgcattgagtctaaatgaaaggcattgtcttatccctctttgaggttactgccgccatcatggaaggaagccatctgttaccagaggcagtgatgctaagaaaagcgtgtgaggctcagagtcatgggtccaacctcacatatgacttcaataaatcacctagcattgctggataattttcctcctctgagagaataggagcatatttgtctcacaaagttgttacaaaaattacgataaaagtgataggtgtagagatcagacattagacagtgaactctctcagggccagctctctcacgcccttcaattaggagacataagaaaggtctgtaatttttttttggtgttaaaggctaagcaatgacaacagtttgcatgtaactattattgttataaatctgcatacaatcccccaacaaatgttgagtcagatatcttctttactgcaggctctgtctgataagtaggctattaactacaagctgtgggcttatgactacagttaataagccaagtcttaagaatgtgactggtagtgatggaccatggaaaaagtaaataacactgttggccatgccacagcctcagtccccatactcagggttctacctaacaaaactgccagtataggaaaagcacccagaatatctgtacatgtatatgataaaggatcaaacacatcaactcctaatacttgtgttttactaaaatttctgaatctcatacataaaatatgtgttttccttcttccttttctacctcctcctttctttcttttgcaaaaggctaatcattttgtaaagcaaagccatcgacataggacgtaagtatgaaacaatatgttggcctgatactatgaggtgttagaagagcgaagtagtaattattgtagtacttgatcacattcatgcttctgatactttcaagattttcactttactattagtttccttttctaaacttcaaaatccaagtgtattgagaaacacttgtcctttatttatttgtttttatttatttttaagacagagtctcgctctgtcagtcaccaggctgtagtgcagtggcacgatcttggctcactgcaacctccgcctcccaggttcaagtaattctcctgtctcagcctccctagtacctgggattacaggcacccgccattaagcctgactaatttttgtattcttagtagagacggggtttccccacgttggccagcttggtcttgaactcctgacctcaggtgatctgcccacctcagattcccaaagtgctgggattacaggcatgagcaactgcgcccagccacacatgtcctttaaattacacactacctatgaagaataattgacttggcttttctccactcaaaaatgagaaatgtgaatgactcttgtgatcctaaccacagtgtcatgtcttgctgcaaattagatgaagggtatttcatcactaaatcttactttcttaactaaaactctcacctaaactgaaggagacattttataaaagtgtcatgtcaagcatgatttaacagtcgtaagattgccttaattcactgctatctggttaaaaccctaattgacgtttggaaatgaattgaatgtcaggtgcctcgaaatctaaaagacaaacattactttatttatttatttatatatttattttaggggcaacaatcttgaataagtgtaaaaggaggaaaaggatattgaaattcacaagaattctttgttccaaaaagttttctgcagtcaagcataatttggttattcataagaaaaggaggaaacaggaagaggatagacgtggtgtcatgtctacatgcacctgcagatcaaaaccacaaggatatgttgctctaggtttattaaagctcattgttctgtgcactggcactgaactgcacagttggaaaatgctatcacttatccacaacgttccagcttcaagaacaatgacatgcattttaatagaagcaacaacattcatattgaaaacatatcattttcttcaattttttctttttctttttgaagttaacactgttgtgacagggaagatcagcttctttgtatgcagaagtgcccactctccgccagccacatctcaaatttgaatgttaaaaacctctcttcattgacatattaaaagtacctacattagtttttctcagtgactaagtactatgttctgaaagtgttttccacaaaattcatgtgttgaaaacctgaccccgaatgtgatggtatttggagatgggacctttggaaatgctttgattaggaagaaggagctttcatgaacgggattagtgcccttataaaagaggacgcagagagctctctcacaccttccactgtctgaggacacagggagaaggccctgtctatgaaccaggaaatgatccccaaccaggacaccttgatcttggactgcccagatgctccagatctgtgagaagcaaatttctgtgctttataagctatccaatgtatggaattttggtacagcagccccaacagactaagatattaataaaataaagatgtaagatctctgttgaaatgcacaaataatatctgagaagaagtagagtatctttaggatatttcatgaaatttcatttgagttggttaattattatttggccatatataaagaatctaatcctgagaatttcaagcggaagccatatccagtacttggatgaaccaatgtcaccctaaaatgccttaatgaggtgagactaatgcatggagagcttaaggtaaaacggcggggggtgggggaacatgtgatcccttctgcctgagaggttctggcatctggttaagagtctaccatcagccagtgaaacagataagtcaaccattaacccctgcctaagtactaacctacacaagtacatcaagtgctacaggagttaaatgaaatggaagattattcttcataggactgagcacagattcccaggagttaactcttgacttagaccaagaaagatgaacagaaaagacatctgtaagcgaaggctgccaccagactaaagcaggaggttgtgaatgaacaagacttacacgaagtgatctatgggacccatccatagagctggcgattgcagacacaagtttagaaatgggccgaggctcctgaagcagcctctctgcaggagtggaagatgtgtggcagccaccggcattcctgaaccacctcagtctgctcttccatggaaactacctttgctaccaagacgtccatttctctgtgtggccatttgagacctgcttatccttgaggtctgaattcagcagtctacactagatatcactcctaaatgttcctatcccatcttttggccgttcctttagtacaattctgcgctgcttttttaattgagtgtttgtatttacactttattcaccattttattctaggacatggaagattgcacctgacgaatagatggcaggtgctaaataaacacttgttaatgaatgaatggtgtggtgtacggccacacggtgtcgctgctgccgctgaaaactggagtcgtggctgctcccagaacaaaagatctgggctaacttgcccccagataatcatgagaaactggtggttggagagataagaacagtctctgcactgtgggcgccttcttgctctgtccccacgtagcttttcctcggtgtgtgaacaaaaaacagaaatagacctctgtgttgtctgttgtaactgatgtgctaatcttgattctaagggcggggtgttcatgacctcatggaatctcaattttatcccaaaagctctaaataccatcgtattggtgggagttaagtcttcaacattcgaatttaaggggacgcattccatccataggagtccctttccaggggacttcaagaatagaaaaattatgttgctttaatcctagaaaaaagacttcctccgtctccacccacagtgtgtgtgattcatctttcagaggcatctctctcctgtccaaactcaagaatggaccaagggtgcaaaaaagaaaacgaacaacatcatttttgttagatttcgtaggctacatcataaaactcacatacaaaaatgcactggaaaaaaagaaattttaaaatttatatagccattcatactcattaatcaaaagacgtgttttgttttttttttgtttgtttgttttttgtttttactcagggtacttagcacacctaatgctctaaaggctatgtagtatgccatgtccacaagtacctgctgagtgtgatttggaaacctaattcacatgctttttagaaaacaaatcttctaagtaatggtacatacatgaatctactcaaagtgctccgaatattttcttgtgcttttataaagaattccatctagtcttttctctcagggatctcatgacactggcctgctcaacttactgaggacctgaaatgcatcgacccttttaaaatgggtcagcctgttgccatgttttcctgaagaattttatttattcttgtgatatgtaagttctcacatgcaagtgtaatgaggaaaaaatgtgtcccccatctggacccctagtctttttctttttttctttgaaacatttgtttttgtaacttgagaacactcagaggagaggagacatcctgccatcctttgattctaactgaggaatagcggaaccggctgacacatcccgtagctgagccgcagcttccgccaacaaaccatttgtgtttaccgtgaaattaacctagttgccaaaatgctaagctacctagcaagtgattcgtgataatcactgtgagcaaagaggttaatggatattgttttttttgtttgttttttttttttttttttttttttttttttgtaatttcattttttccaggtttcctgtaggcccagcacagggcttcaaacggtgggataaaaacaccgtatgttatcagtaaggtcttcgatcaggaactgaaatgccacggacaacacatgatgtacgtctgcgggaattcatagatctataatccatcgcatcacctaccttcctgaggggctttatttgtaattggcacactgatcggaattcttacagaaactagaacgcaggaaacagtatagtatagtagtttagtgcatgagtcacacaaaccaagatttcatccccactcggagaaaggggtgaagacgagacgaagcacccactctagccagtcaagaatttttctcctacaccccgggtaacactgtgacatttaacaacaaacacaactggctgtattcatgggccagagtaggaatctgagatgatttgctcaaaaaagttagcgagatttcatgtgacttagaaaaattcaacgtgatagaaagttttcaatactaaatgagctgacaaatttaagcttaggttctaaacctacctcttaaaagaattcagccaaaatcaatgttaaaataatgaattgcatgcttatttaaactcttcaagctttggtcccttcatctgtaaaatggcaataatcactgtgccttcgaagactgctggattaaaatggcttatctcaatacattttacaaggtgggcaattactaaatagtagcccaaattattaagtctatgttgctttccaaatatagaagtcactgaacaaaatggaacagaagcatcagtgacaggccaggcaatggtataaattcaatttccaggcctctcagctaaaattgtaatcagaaacaagttcaagttcagtttcctcaggaagcagttacactgaggaccaactattttctcacacacacaagatcttaaatcgcgctccattgcttcatggatatatgtgttgccatggacagataacaacctccttatgattacgcctacaattttattcttcactcactatcctccatcaagaactagctactttgcacggaagccctaaagaaattcttactgattgaaactcatcaagctcccttcgcctttccatatttgcaccaactttgcaaatcaattgtttaattttttccgaagtagacgtcctgccctttggtcctgaagagattcagagtgagggtgtttatattaagaaacaaatattgagagggaatgttaactccttgaacagtaaataaactaatccttcaacagaaaacattatttctgagactcagtttccgtttatataaaatgaggtattgatacacacccaggcagttttttgtgaatatttaatatgtataccctaaacggtaagagctttgaagtgaggaataaggtaatatggctaaacggtcttcactcttgaacatgatgctatactgcagtcaatactacttttttttttttgtttttgagttggagtcttgctctgtcaaccaagctggagcacaatagtgtcatcacaacttactgcagcctcaacctcctgcctcaccctttctagtagctgagactggaggtgtgcaccaccatgcccagctaattttactttttgtagagacatggttttgctatgttgaccaggctagtctcaaattcttgggctcaagtgatccttcttcctcagcacctcaaagtgctgagattgtagacatgggccacagtacctggcccaaaaataatttttaaaaagggaagctttatattgtattatttttttctggacaatgccttatgttccttaaacagaagtctatctaaataataaaatgtgaagctttcctctcactggcggagaagcagagtctccaggagttgtctcctgggttggctcagggtgacagaggcatgcacaggcctactgggcgggacgaaccacatcatgtgctttccagcacgttgcttagtttttctaccctaggaggcctcaagagattgtaaacgttttaagattgagacacaattttttcagtcatgtctgcccctggcctaaaaatgtctggtaagtccagtcctggaatcccaaaggacatcttagaatgccaagtacgtcgatattaacacactcccaccctataaaatgggctgagggtcttctatgtgccagaccctgtgattctttcactagggactagagacatgaatgaatgtgcttcctccttctcagcttggtcctcctcagcatgtgcgcgagggtggtcctccagctcccagcaaggactggggcagcccaaagcacatctgctaactccgccctgagcacacatggtataccctagagtcacaaatcaatactgtgattccctcatggacaaagatgggagcacactgccttagggtaaggaggcacattaagaggtgactagaggcacaggccccatggtcagacaggcttgaggttgattctgctggtgattagttagacaatgtgtccatattacttaactctaaaggacttcagtcttctcacttaaaaaacaggaagaatgaaaccaatgaggtcattcctgtgtcttgaagccaacaaccctggactatccttggccctcaatacctgttagctgtttggggcaggtcaatattatccttctcttgcttccaattaaagttttcattgccattacattcccagttgggtaaagaagacttaggcagtaacttttgtaaatgctttggcccacactcaaagtcatactaataagtacatttttaaaaatcgatagcaaatgcaatttttttagcaaatgcttttttgagtttctaggttaaatttattaatagttctacatatgattttctaccctgttcttctgtagagagtagacagcccagagtcccattttcctgcttcccatcactatggctacaggattaggttcgaaaatctgcttttgctgaaatatcacacatccctgaacaaaaataacttcaaatgtttaaacttatgtcacatagtattttcttaagggagattatgtgggttaaaacaatttactccccaattaaaatcattacgttctccaccagagttgaatgaactatcttcttacattagagatacagttgagtctcacgtttcacatcctgccaaactcagaattccattacagtggatgctgaggttggatgtactctgttgcatcaacttcttctttttgtgtgggcaacaccagtgctaaggagaagattcctctgcccttcaaccttggtggaactgccaatgaagctgttttctcatttggccatggttgggatctatctaactgtgattcatcttaactcgtctttctcctggaggctgggtcctggagccatcagtgcaaggagagatgtagcaccctcagatcagctgccccaccccagtctggtcctcagagctggttttggtggttccaaagcagttccagcatgttatgtgccaccccataaccctccagtaaatcccctagccacctgcctctcttagaaggcatttccacctagagaacccaaactgctgcagccatgctcggggtcacagagcattgcattatgttgggtggcagaacatcgcattatgttgttttgggaaaactggttgctttattgtggaaaggtgggtggtggtttcttaatgatgacaatggtctatctttcacgttagttccattctcacagaaaaggtcaagatatttacacaatttctgcctgaatgtgtctacactattttggaatatagtgaaaaacaaagtatccttatcctttgcagcattagcaatttgcataagtaaaatagagttgaattagtaagtcataacaaaaaataatgcacttttaaatccaaacctcttttaccagtgatttcttaaaaatacataaggcgtgttctgtgttttcaagaagtcccacatatttcttgacaagaaaatcatgcatttttattactcaattaagctttaaataaagcttcttaaatactaaaccaaatgttgattgttatttttctatctaaaagtaaaataaacattatttaatcccagatttccaaataaacaaggccactgaggttcccataactgtgattttgacaaccggctgcagagcgtagcttgtgctaacctgtttcatgaggggctggcagccttttcactgggaaacctctgattgctttgacccttatcaccttgtacaagttaaacttctggtgttgctgcatctttgctaaaaaggaaactcctgcattctggctatgccccattttgcaggcatcacagttgagcacctttgcctgctctgatccctgtagacttcaagattcacttgtgaacttatttccacatctcagataacaatctaaaataagatgaaatgacacaaagcctgcagcaagaatctggaaactaacctgattgtgtagtgtcctcttagaagcctgtgcctcctgcctttttattttatcttttagctcaaaatgaactcctttcacactgaggatggctatccaatctcattcccagtgcctttcaacaagtactccccttatacactcctggctcccatcccctaatgtaaatgtaccacaatttaaaaaatgcagttgatgccaatgttgctcttccttttttctgtgccctttgaatttaattttttcttataataaaagtgacagccaaaaatatccatactatctatttttttatttggtgtctatgtgagggcgtagcatggggtagcattttttaaaatattgagttatgtattcattcaggcgcatgttactgtaaagaaaatagtttaaaattatttttccattaccaacttctgacaattataccttctaaataccctttaagtctgttcaattatttccagccaacgtctcagtgaaaacccatctgactgactagtgttatttcttagtcttttaatgaagctacccctatggatttgatcgctgaattacttatcctctacatagaatcctctaaacctgtgtttcaatgaaccctagcttcactgatggccctacagcttgtcttcttaaacaaatgaaatcctgatcgtgaactctccagtcaaacaaagtccatgacttgtagcacactagaatagaatttgacacccttcatatacaccacagggccctaaataatctcaccacaattcattccctttacctgctgtaaccccctggaacatatttcacgcctttgcctatttttccttcagttctcaccttcgagtagcaggtcctcagggaaacccttcccacttaagtacttgctaaccccatgttaaacttcctcatagcactttattatctcagtcactacatctccaactgcagaagtcgcttcatgcagtgaggatgtgtctttgaatgtctgtgcccccaggagggcagggtctctagtgcaccactctatgtccatgcttagcacaaaagatggacacagcggaccctaaatacccggaacacaagtttagaggatttctatgtagaggagaaataattcaatgatcaaaatcattacaaatggtatttcttccatccagataagaaatgggatttggagtgattttttttttctttttttttttttgagacggagtctcgctctgtcgcccaggctggagtgcagtggcgtgatctcagatgtctgctcactacaagctccacctcctgggttcacgccattctcctgtctcagcctcccaagtatggggtgatttttaagtgcaaaaaaagagagaaagatggaggcagaatgcaaggcataaagacaacatcgtgaagctattttatactgtcctaccaattgaccagattcagtataagttttcaaacggattaacatgccaacagtgctttaaagtaaatgagaccaattcatctgccccttgttttaataccttttgactttgtgaaatgaaaaagggtaaattaacctttatcaccaggcagaatttttgcatcatcatgaattctcagaatgctctaagaattatatgtctttcttagcatatatccaccaaattagacatccttctcagaatggtatattaaaaactttaaataaaagaattgtgatttttgatggaaattagataagaaatttgccaatctttataaacatcatcttctgtgaatgctttacagtgaagggcagactggaaaattcatagtagtgtaattacaagtgattagtaaacatgaaaatttgcaacctccctaagtaatcaaagagctgtaaatgagagaagaaaacacttcccccacccagcaaatgagaaaaggataaaatgtatcataatacttcaagctataataggactattgttgtgagcataaattagcagagacttcctgagagcaattttcatatttattaagtatcttaaaaatgttcttaactagtctttccccttctagtaagttgtcttgaaaaaactcagaaatgttaatgaatgtatctacaaataaaccagactactgctagttcatgaggcatctttgtgtgtttggaaatagattccctccttccaggttcacagaccccaatccagggctcactctgctgtgagtggagcccactctgcccagttgagtggctctcctgcagggcacaatctgaacatccctggatggaaagatggtaatttattcatttataaagttggaggaaaccttcattcaccaacgacatgtgactattagtgaagtcactaggtaaattagattaaagcatcaggatgaaatattaaagtcattaaaatgtatgttctaaaactttttctgacccagaaaaaaagatcaatatataacattgcatgaaaagtcaaagtttaaaattttatgtgtagtgaaggcactaacttgttaaaatgcaaaggaaacagactagaatggcagaggttttatctgagtacacgggtcaggggtagttttttcctttcttgccatgaggtcttagaatccggaacatgttcactgtggaaaatcagacaaattgagcagttggaaaaaggagaggagggagagtgcttgcatggaagcctctgctctgggctgaggaggacatggcagagcgattggctattaggagagtcaggaaaggggagatcaccagctcaggtattttcttacctagtctcatgaactaggtctgaatttcatggtaaaggctcttggctaaatctgaaattgctgtactaaagctttgaaaacctatgcaatgccgagaggggcccaaaaaacagcttgacttggagagaatgactcatcctctactgaccactttgctccttgttcccctgtaactgacactcttcccagattcggcttctagccagtatgtctactcaaaacagaaactttctaattttaaacagcaggcttatctttgtaaccagagaaatggggaaattacccctaagcaagcatatgagtaaataagttatgcaaggagagatgtctccatgactatttccttaaccaccgaaaacacagaaaattattacagtttcttaaaacacatgtgtgatattgcaacttaatttttgattaaatttccatctcatggtatcgtacatccataatctgagtccacaaaaaagaacactcattttgccgtgtcatcattctagtattcaacgaggaaagaaagaaaagcaaatcatgacaaggtcatctttacaatgaaacaaagatgtataagaaaacagagtagggactgtgttattgccttgatttgtggttcctgttttctcccataaacacattaggttagcagagagtttgcttcccaaagtgacttcctccaactacaatcatcagtagcaggtgggaacgggttacagtggcagaatttcagtccctgccatggagtgggaagctgcattttaacctggctgcaggctctttgtttttatgttaaagtgcaggtagtcctgttgtggacagctctgtgcatctgaagatgactactgggtgctgtgcggatgagtttcgcgcagcacaagtagatttgtgctacaggcagctctgcaagtttctggtagaaccgtttaggcttagctgagctagaccaagcagcagcaacagtaacagctaggcttgaaacgttccacagagcacaggggcactgagagcaggcccccgggtcttcgggaaacactatgcagtcttgtctccatgcctgaaactttgcctggagctccaagaactgggattttaataggtagaaagacctagaaacggatgtttttatgttaatagatcttcataaaactagtagaaaagcaggcctgtatatttttgtcaaataattttttaaaaagccaaagttataaatgtatgattttggataacctaaaaatagtttgaagagtgttagcaagtcaaataaaattttctttcttttttcttatcaggtttaatgggaaaatactgcgtaaatatcaactattgtagatctgtctcccagaaaaacagtgcactgaacatgacaaatttcttcaaaactgatccaagttattacatgacagatttaaattgtgttattttcacacatcattcctctatgtctagaaaactcagttacctcaatggaataatttttttacagtgaagagttttgctacttaaagaaaaagagaagggatattttatacgtatgtataaaatatgtgtatatatgtatgtatatgttctgacctccttctggtgtcattgtaacaagatcccctagggatattaaactcctgatagatataatggagataacaacatttaaatcttccaatttgtcatcaccattgcttgaaaacaaataaactttaaaataaccaaaagcctggagtggaagtaaatcgacaaacatcaaaaagaatcacatacacatttaaactataaaaccaccattcattagaaaatgtgtattatagctattttgccaacctgtctggaatgaataacgaccctcaagattttcaatattcacttcacacagaatgttccatggaaatgcctgggttcagaatctcattccccatcttattagtggcatgctgtcaaacaagtaacttaccactggttttctgaactctaaatcggatgaaatcaagcacctgcattacgcaatgaattatataactctacatatgttaacacaacaaacactgcataaaagtatgtacttgggcttgtgaggctgcagagggttggggtgggaggaaagattgcaagtacccagcctgccttttctgacagcctgatccacactctgatgatgcaaagggaggaggaggcaggttaggtggtgctcaacacaatcacgagacacccaactcagcaaacaaaaactcttcatgaagagcctaaggttggatgtttcccaatccatggtctctccatgctgggatgctaaacatgaggtgtgtagaggaaatgtgagttcacaatcgatcagctggtcaacaggttcctctggtcaacaatgtcataatcaaaccaaggaaatcttgaattcagataaccaatctaccccatatgaatgacaatttaaattatcctatgtgaggtaattttttcaagtgctctaagatatacacttcttggtgactaagtcaggccgtatcacccaactctgttttcatatttcctattttcttaacaaaattaggcaaaaaattattgacaagtgtgcacaatcacatcattacataatcacataatctttgaacataggacatctcacagggtatacttttcatacatggtgctttagctaaggcgttttctcaactcattaaaatgacttttccttctaaacaatacaatctatcagggccgtggacagggatggtctcatgaacatgcaacctaggtcagttatttgttgttgttgtttgatttttaacttttaagtttagtggtagaagtgcaggtttgttacttaagtaaacttatgtcatgggagtttgttgtacagattatttgatcacccagatattaagcctagtacccattattttcctgatcccctctttcttccaatattccatcctccaaaaggccccagtgtgtgttgttcccccagtgtgttcatgagctctcatcatttagatcttacttatacatgataacttgtgctatttggttttctgttcctgggttagtttgcttagcatattggcctccacctccatccacgtccttgcaaaggacacggtcagtccttagaagagtagttcttgataaaatattctgcagctgctgttgtgaagttcttaataagttgtagagaaagggcactccattttcttcgtatggtacctcaattatcaattggtcttgttacagagataagagtttttaaagaaaattgtaagacccttgtgaaaattactttttttacttaagatgtttcatgagggttttctttaaaataattatttgcaattctcctgtagaatttgatatgatgggtctagctttgttcagcagaaatgaatttctgcaaatgctgaggcaagcaaaagaaacaaaaaacaacttaacccatttttccttaatttttcattgttttttaatttatcattggaataatgattgtatttatttaaataaagaaaacaggatcaagaagattttttaagacatttgaaatgtaaagaaatgtagtataggacatttgacttgtaaataaatgttcatagaatttagagctgaacactcaaataatctacaaagtgactttttaaacactttttccgtgcataaatgtttcttcaaaaaatctttgtaagagagaatgtagataatattgaaaactatggaaacactttagacgaagtagaaatttattgtattatttataaaacactcagcgccccatatgtgctaaatatcattcaaaaccttaaaatataaagtgaagaagacatccaagggctaccccatgggttgtacggtctagtgaagaaaacgccaataaaaggaaaggaaatcacaccgtcctcaatattgctttcttttccgcatcttttttatgctctataacacagtttgcatagcatttctctagaacaattcctggaacagcgagaaagggaccctcaagtaactattgagtacaatgaccaaagacaaaatcacttagataatcaatgggtggtcaattgtcttctctaccacactgccctgtcataccacatagagtgctgctgggtgtggacatctcttacgagtaaggtagagtcagttgtagaattggttgcatctccagcttgcagttctcctgctgtgtcactcagacactgaagagcagcctcatgaaaaatgctttctatctcaatatttatgcaggctcatgttttctttcggtgtagaaatttactttttcttattagtacccgaagaatcaaaggcttttaagaattccgcataataccaccattcttgttaaatggccctgcattacataattacaaggagaagagcagaggtagatttcaagtaagttatcaccattcaacatgtgaaattaattttgtaatgtatgagcttctgcatttttattttggtacacatactataacgcccttttgaaaatgtatcatcaactgctgatttggaagcctacaactttaaaatagaatctgaaaaaagtactgtgggagccaaagcaagtgcttaagttcactttgtgacattattaataaattctatcacatcgttatagaaatacaatgtacaaatttttcttgagggataaattttcacccagatattaatgtgatgtaggtacattaatcaaatattcataattttttgtcttcttttggaaattgcttcaaccaaccttcagtttaagttggctctccataattgtatatagatttttcatttagagaagttatttatgatcatttgaatgaatggaaattgttaaggaactttcttctgaaattatttttgtgtatatttccagtttattttttttaaacaaatgggctattttgtaattagaagaaaaaaattgctttgaaacttgaagccctggaaatttcatgacatgacatgacatgccatttccaacagcagacagttggcaggactagtccaggaacattcaagtcttaatttctagtccactattctttatacaaacaatctgaatttatatactaatcaatcaatgcatgaaagtttctcccagccaaacacgcttttaccatctcatcccttggtgagtgctggtttgctggtgaaactatcatggcgcttataaaagaagagagcccgtccacttgaacataagatcctaattaaaagtaaaaaggtcagtcgttacttacgaatacttttgaactattcattaatatgtcaacttctaacaggaggattttaggttttgccatagacacattctatttctctttggctaactctctcacctccttcaaatctgtgttcaaatatgaacttctcgaaaagaccttttctgatcacttcattttacaccattaaggaccacccaccatcagcctcctgtcctgccctagacattaccaacacttgtatcctgctcttctttttgggtgatctctatcaactgacattacattacacttattaagcgcatggtttactgtcagttttcctcctctgaatggaaaaatctttgcctaatttggtgactgatgtatcccaatagccaaaaacaattgctaactctcaaaagtcactcaacagttttctgttggaaaaaaaaatccatttagaccatattgagaatgcctatttaatgcatgtagatgcataataccataatgctacttttaatatcataattcaaaacataaacaaacactagaccatgtatttaatgaacttacaacagtgcctggcatatgctactcaatgaatttactattaatcttccttgctgttaggcactcatgatcaccactacagacttctcaacctttccccagttacaccaaactttcgtgggaaaatataatcttaacatatattaagagaatgatagactacttgaagcttgatagtgtcaccaggagattaggaggaatttatggtaacatacatagaaaagggcaaacatttctcttttattatcttgtcttttacttctaaagttatggaaggtaggatgaagatgacctggcaaagccacttgtttctaagaggatggaataaagcggtgttcagtctacggatgtttcatgtagcatattccacagaaaacaacttttgcaaagtaaactaatagtgttagtgaaaaaggatcctataatcacaaccatggagacagtgcgtgatgtaaacagggttaaacattttatttaatgcggaaggatgtagagagctcctctactgacgtgcactgtgactctcagggagacctgaggagcggatctaaccatcttagcttgaagctgtgtattgagagaatggtgttaagaaatgttttctctgctcaacacagtgtggaacgtggctctaggcttgagagctgccagctctcttctcctaccgctgttgtagcgaaataaagctggaagacttggcctcagcagaagtagctcagtactggagaacaaagtctattaatgggggaattaatggggcacttggggaaatgaagaacacagtgtcagtttagaaattcttctaaatggtgctgtggtttgaatgtgtcccctgacccccggaattcttgagttggcaactaaatccccaatgaggcagtgctagaagctgggagctcctgggaagtgtttaggttatgagggctttgcacttatgaatgaattaatgcccatataaagaggagctgggacctactgggaagtgtttaggtcataagggctctgtacccatgaataaattgatgccccaataaagagggctctcagagtgggctacccctctttgcccttctgccatgggatgactcagcaagaaagcccctgatcaactaccagtgacttcattttgagcttctcagcctctagaactgtgaaccaatacatttcttttctttacaaagtacctggtctgtagtattttgttacaacaacacaaatgtactaagacaacctgcaagaacaaaaagcctctctagtgatataaatagcccagctcagcttaggagtcctggtggaattttccatagctgtgcaagctatgaagacagaatgtgtgtcccctaatgtgactctgtgcatagtgtccccaagataagatgctggttgaggatccaatattgtagccactgctccctggggaacatgcgtaatacatgagtgatatttgggtccacgtgacttggtattctgagtggtgtaatgactcttggtggaattatatgtatatcgcccatgaagtcaaccctcaaaagtttagaatggaaagctaattttcttttaataaactcatgtacgattataattgataggtctaccaaaatagtacagcagttccttccacactgtattagatactattgtaattatcagttataattttatgtctcagcaaatattgccttttcagaagtcccttccttgagcaaatctaaagaaagtttgcaaagaaaaactgtaaatatgtataaatatgccagtaactcaaaaattacttttctctgttgaaaggcttaattgtactggttgaaatgttttttagaatatgtcaacaccttgtcactatttacagggtattcctactaccctgatgaaaagagcacctcttaaacaataaggtcttagtcacggctgagctcttttcttcagatgacacgtttccctgaatgttactaggtgaattgattagacactgatatttcctaaatcacagttaatgacaagcatatttttagatactggacacaaattcaagccagtaatctgcaggtgcttgtgaaatgttgtagtcacattttccctgccaaatttctgaaggctacctataaatcatttttttaaaagagaaaagtataaaggtatacaaggccaatgaagaaaggaatataatagaaagtgaacaagtttacaataaataaaacctataacagctaacaatatatgtttccctcaccaatcacatgggtatatggaaggctttttaaaaaaaatgttaaaaagtactgtattacaagaatgtcatagtatttgcattatgccacatttaataaaatgtaatttaagagtttggaaggttttatttaaaagctttgatgtcctcctataaagttcttgtattttgagcaataacatgagacaagacccaaaaggcaattaaggcccctacaccatgcagtgttgtaggagcacatattagaagacaaaggacaagatagttatatcaaaataaatagcctaaatgatctctaagcaatttaatcagggcagtatcccacaggtgactctatcccaacccaaaagtaaatgagacaggtttcatgtctggatattacacactggcagctgaatcatgacacttttctcatttaatagtctgggattggtggggagcaaagaccttggacagttaaatgtatgtgtacctagtcctgatgagacgtcacagttgtgacatctcacaagtgtgtgtgagagtgatgcagggatggagagatggaggaggaaagatggagaaggacagatggaggaggagagatggaagaggagagatgcaggaggagagatggaggagagagagggtggaggaagaggggaagggaggggaggggaggggaggataatgtgggaatgggaagggagggaaagagagtagaggggaagaaagatgttcaatggaggtaaggagaaaacagagctaattacaagcatagagaacttacgtatttttgagttgtgtttacttgaatttctttaagcacagaagatcattcccagaaattaaactgaaactgatgaacaaagaaacagtacaggtggtagagaactactgaaacacacaatttcagttttgttctgttctttcaggatatatagaaagctggggtggggagatggataaaaaagcttaaaacaagacaaaggtaaacaggcatagacgttttcctttccgttcctggcttcagccttctgcccatctttcctgtgagttgtcttctgtcatgcacactccaacatttgtgcaacacatatctctacaatgaagaatatgtcatgctagcttttctgtccaatagacgctgaagttatgtattgtctttttccagtgatcaaaacaaaaactgagacttgggaagaaataaactcgaggggacctgaatgagaacttgagttacactctaatacatttccagggcttttgagaagccagaggcatgtcctgtttcctcaaacaccataaaatgctccttagaatttgaccctatgacagaaactgctacttacctacacaatgtctactctcagaaatcttcattcattatagaacccaaatatagtctccagaagtaacacccagtttaaaaatggaacaggcttttatgtggagttaaccagtgaaatgctaacaatatctcattggttgtattggttgtacaggaattatgagagcgcttttagatgggactgcagtggcagacatacaccactgacatttatgcctcttctgtacactttctccatgccaaggatgcaccagtgatgactggagttgcagcagccttcttgggaccatgagtgaaaggcaaagagaatttcaggtgccttgttcatgaccaacttaagtggctggacccatggcagcagaacacaccaacttttagactgcacttttcatgacagcccagtaagcctatgagttttaaagccaatgtcggattatcggtaccagcagctgaacaaaatttttcatgtgccaacgtcttacgatgagactacaagctcttagaggaaaaagattctggcaaaatctaggattatctgtggaactggatggatattgaatgagtattttctaaaacgataaactcattaggaaacattctatctggtctattctcctcttctacgatcccgccccattcctagttatcattcatggcccagataaaatgacatctccaaaaagcttgatgttaagaccctgaggctaaattagacattctctcttcaatattcatgttttgtctcttttttcccctactatagaacttatcactgtatattataattacgcatttaaatgcatttttttcattgagtccataatctcaaatttatatatttttttcccacaccagaacatagcggaacaccatatcaggacctaataaacatttgttgtttaagttcttactatgcaccagacactaggttaagcccctgggatagagaaagaagaaaaggatgatgttatttaatcttggagaacatttgatctggtatacttcaaagcagtaaaatgagatgagaaagtatctgtcaagtaaaagactggagggaaggggccagatctacttaatagacacacaatcgtttgcaacatacattgattctgcaatataaaatttgccaactaagtaatgcttaactacacacatcaattttctggttgttcaattatatacttgaaaaaaaaaacagctgatgaaaattttgcctgtatttatgtgaaagacaaataatcaacaccattattatcctattgctaaggaggtaacaatacatttcctgctggtcttatctacaaagagacactacgttcgttatttccttccatctttttttttttttttttttttttttttgagatggagtcttgctctagtgcccaggctggagtgcagtggtgcgatctcggctcactgcaagctctgcctccagggttcatgccattctcccgcctcagcctcccaagtagctgggactactggtgcccaccaccacgcctggctaatttttttgtgtttttagtagagacagggtttcaccgtgttagccagggtggtctccatctcctgacctggtgatccacccgccttggcctcccaaagtgatgggactgcaggtgtgagccaccacgccaagcctttccttttatctttagctttccctctcttcaccaaataaaatcagcgaacacctgtgccagttacttccctaaaaacacagaatcaggaattcgattattgataacattcgttctatggagagtctgcttgtatagggaagtacagtaatgggctgcatgacgatgtctcagtcaacaacgaatgccacattcagcagtccccttagattatagtggagctgaacaatgatcactaagcgacattgcagctgtcataatgttgtagtgcaattacttttttatacaaataaatttcacgtagcctaaacgtatgctgtttatgaagactacagtagtgtacagtcatgtcctaagccttcacattcactcaccactcacttgctgactcaccctggacaacttccaggcctgcaagatttatctgtggtaactgccgtagacaggtgtaccattcttacgtttcactccatatttttaccgtaccttttccatgtgtaggtatggttatgtatcttcagatctgcaaagtcttaccattgtgttacagttgcctacagtctgcaggaccctaacaaggtgacaggctgcaccccagagcctaggtgtgccacaggctgtaccatctaggtggtcatatgcacattctgtgttgttcacacaaacaaagatgaaatttcccgatgaggcatttctcagaatacattcccatcactaatcaacacatgactggagtggactccataaccatcgactttaacagagcactaaatccagaagatcactcagagttattttcatccaatcccctcgtaccatagaggagttgatcaagcaattctcagccttttttattattttgctcaaatggtttaacccctcggtctctctacttcttcctttgagagtatcagtttttagcattaaaagagatgatacatagagctttatcccatgctggaaagagcatgatgggtgccaactaatttttataagcagcgcatgcagtccctatggatttgactaaaattttatccagtgaatattttctttatcatactcttcatttatcaaagacctcctatattggtgaactccaggaggggagctgttaatatctgcagtcattgttcttgagcccagagcccagagaaaggtgactgagcaaaaaaattaaagaggacgcaatatgcaaacagtaaaaattgctgttttctcacttactttgaaataatataaaaatgattctataaagacttgttcattatagatctcatttgaaatgtgcaatagcagtggattaaccggttaaaagtcgcaatcacttttgtttttatcttctagatagaattttttctaagacacagaaatctttgcataaagttgattatacttgatttttatcagcaacaacctcgcactgcatcatttattttggactttgctaatatgtattacgtgaagagttaaggtagttgaattatcttaggcactgtgagttatttctacaaaatctaagcatagacttaaacaaaagttctaaaattaatatatgtttaaagaaaaccccagctccattccatggcctcctctggggcactggctggccttggccttgcctatcttttaagtttacttcacagactttcctttctaacctccctgctaatggtaaacccatgagggcagaggtagcctttgttgtgttcttgactttctccccacagcctaacgtggtgtccaataaagctttggtgaaaatacgactacgtgcagggtagagagggttatctcataaatacagcatggaaagaacaccactttttagatgcaacgattgcatatttcctgtaagttgtaggcaaacgtaggtgaatcccagactactttgctcccctgcaaaatgctttctgagcagtactaatcactatgtagcctgccagagctttttatgccaatttccacttcatttgtttgtgatttgtccttactcaaagtaagtgcatttgtgctcaaaccaaccttctctctctgctttgagtcccttaacagaggtttcacgatgcttatgatgcagagtgaaatgtacaacaattttgcagaaagaccagctctgaatttctagctcctacttttggcctcaaatgaatacattgctctgattactacacccctctgaatttctcttttctcctctgaaaatagcacagaattgtgaagattaaaagaggtgatatagagacatgaattaaccgagtactggtaaagggaggttctcagtgagtgtataaagaaataaacagttataaacatggcaatcaaatgacatcaccatttacttttatctttaaaaccccatgggaaggggtttaccctcactttagagaaaaccaccttgagaatcagtgagacccatgaaagggggcgccccaagtcacagatggctaatgtgactgcaggaagaatcccagcagatgggccgggcgtggtgtgggggaaggaaggcgccaggcacagttacgggcagtgaggtacagggcagtgccctgctctcaagcagcttgcaacagggccaagcagtcagggcctggcataaagtcgagttatgagcaaagaacagctatccctccaagagtcaccatcgcataaagggggagaatcgctactggacgatgtggttcagaatgagtttgcagaatttattttccttccgctttccctccgtgggctgctgacctctaatcacaggctggaggtattcaatctggaagaagtatgtaacttccaaatgatgcaagctactgggatcaagccatctaggaaaagtgcctgtgtcatcattttaaaattgacagtctcttcttagaactttttaataccacactcgccatactctatatgagtcatactcaccacatttgttacctagggcaaattactaaaagtttgaccttgagttataaattatggtactacatttttaagcatgagagttttattgaaagagactaatactattctgccatgtattttaattttattataccagtctttctgtaccctttctgttatggcttattattttacaatacagttttaaatgataactatttttaaccatccattcaagggttgaataattttctcctttagaaaattatatattaccatttttcttcatctcatgtataatcatggatttgcacttttctctctctttaggcttattaagaattccttccttaatagttttaagaatgcatatatttctattaattttcatatttcctagccctttttcaatacagttttgaataaagtcctttcaattacatttttaaaataagaaatagagatttataaaattctctccctgcgggataggaaaatttggtgaaaagtttgtcctactgtttcaggaaatacatcacattggttacagcataggtctcagggtgcagcagtcttaggtatggattctaacgtcagtgtcactgggtaccaaatacctctctgcttccgctttcccgtttgttaggccaaggataaaacagcatccgcctcgtaggaatgccactagcatttaatgtgcatgaggttgcatgcatagggaatacagaaagtaagcagtcattattcagctacagcgtactgattattctgttgcctctgttgtgaccaggctaacaacaacaaccaccactttaaaaataatagcctttttcaaaatcattagaatctttgtctgctcaagctgccataaaagaatatcatagaataagtggattaaacaacagacatttatttctcacagctgtggaagggggaagcaatcctcccacctcagcctccctagtaactgggactacaggcccgtgctaccattcccggctatttttttctatttttagtagagatgaggtctcaccatgttgttcaggctggtctcaaactcctggcctcaagcaatcttcctggcttggccttccaaagttctgagattaaaggcatgagccagcacaccctaccccttcctatcttaaaggcctgtcgctgtgagctattatggtaaggagaaagggagaaagagagtgagggaggagagggagaaagagagggagggaggggagggagaaagagaaggagggaaggagggagggaaggagggaggggaggatggaaggagggagggaaggaggggaggatggaaggagggagggaggggaggatggaaggagggagagagggaggggaggatggaaggacggagggagggagggacggaggggaggatggaagaatgaagggagggagggagggaagagtggaacaatggagggagggagggagggaagaatggaaggaaggagggatggagggaacccttgttctcataggggcactcattctaacatgagggccccacctaccctcagaacttcatctaaaagtaatcaccttccagaggacttacctccaaataccatcacactgggatgaggggtggaacacagcaatgtatgaggacacagacatttagtccttaacatttagaatgtgtaaccagctgaatatttagaggcaactctaagggcacagcagcagaaagatcaggagccccactcctcatggacaacggctgcaaaagtctcatctctacctggccgtgccatgtgttttaaactttgctttgttctaagactatgttatagacaaacttatttcatcgacttaatacactaaggtgtataaatgtctaactaagactttaaaagatttcctgcagaagagacgtttgttggaaatgttgaactttaaaggaaaaattgtgcaaagaccctgctttgagtttgaacgctgatgattttgatgtagcatttacctctgaaaggtcgtactttaaatatcagagctaattaggcctacctccaaactatctcacacacgaagctaagggccatgcactctagaagtcactttccagcccacaacggctttcaaatcgcagagagaatgcgggacacagacaatcttttcctaaacaagcaacccccctccctggctggcatttgaaatgaacagtgtcttaagactgttttcctccctcttcaggaaaatcacagcctgagaacaggaaagcgagcggatctcaagaaaggagaggacaggaggagctcccaaactagcttcattcatttcataattataccaggacccatcccagcgctatgaaaatgccttaagctttaggcttaaaaattaaattttcatacataaagtttatggcccatccttcaacaaagttcgagtttttaaaaaatgtctttttttttttgatttacaaagtaatactctgttaccgatcaacgattgttttaaaaataaacttcaaaactttacaaatatagtcggagtccttacccaaaacaatgccattcttcccctactggcagtactgggtcctgaaatttctattcatcatgtacacatttcaataattttgccacaaatatatacacatacacatgtatttcataaaccctaagaagaagagattaaaaatttaaaatattcatgtaaataatataaagctattatttggcacattactcataatattgttttggaattcatccaccttaaaatattgcagcttaagttaatttattttttgctaccgcatagtctcttctgttgtataatactacaaaattatatccattttgctaacaaatgtaattgtttctagtttttcactattgataacagacctataaagcacatcagttaacatgtcttcttgtgcacacttttttttttttaacacatacttgaaagggaagtgttgtcttagagatcacaaacatccattttactagaaattgctagactcttcaacaaattgctaagtcaatgcacctgatctacagtggctaagtcccatcaggtggcatccttgcaagtattgattattatcaggtgttgcctatctaattggggtgaacactacctctttgctatttcaacttgcattccgcttattactagtgaaattaatgtttgtatttgttcattgaacatcaatttcctcttttatgatgtgtctgtttttatttgcctgatttcccactgagttgctattgatttgtaggagttatttgtatacttcgggtttttgttaacactaaaaattatacttttattaatatactagtatgtactttactgagtgtgggttggggatgttagtgaacattgttcacctgaagtaaatacaaggcaaacaatgttaaagaacactagtcaaatggcaagcacatagccagaatacctggattttattgactcctggagaaaagtttgtaatattgtttctgaaaacacatatttgtggtttttagaattttgatattattcataagtccttgtaattgattttcatataatttcagtttttgcgagaggttaatccaaaattcccatgtcgttggtttattaatatcttcttataatattatcatacttggtttaaacaatttaggctaagttatataggacatacaacttgagcactgtcacctctcctggaaaattattatgtatattatgacactctttgtctccaataattgttttttgttagaaagacaaatcttaatctttgtcgtgtttgatattatgataggaacaccacggttattttagttagtatttacctggtgtatttttctactctacctttactctcattgacttgcctcttttgtaaacaacgtatcattcaattaaaatacaaagttcaacgtagacatcacttactatgctttaacggtgaatttaggattccggataccttgttttgtgctatatataatttttctatgtgtcatttacacatgtctgtgtttgttagactcttttttctcccttctactggcttgaaagttgtctattctgctaaataatcatgattaagttaaaagctactagagaaaggaggaccagccattcctgaatcttgtgtagtagactcaaaaagaacgcctgttttcttctctttcctttttgtttctaagtgaaataacccaggcatagaaagaaaaatactgtgtaatctcacttagatgtggaatctaagaacatcttctcagaaatagagattagaatcagaatggtagttgccaggggctggggagaggggaaatggggaataattgtcaaagtttacaaacttccagttcgaagatgcatcagccctgggatctaatgtacagcatggttactttagctagtaatactgttattatatacttgaaatttgctaaggtaagagtagatctttttatttattttattttacctatttatttattttatagagatgaggtcttgctatgttgcgcaggctagtgttgaactcctaggctcaggcaatcctgccacctcggcctcccaaaatgctgggactacaggcatgagtcacctcttctggctgagagcagatcttaaatgcccccatcacacacagaaaaatgttttctatgtgaagtgatgaatatgttaattagtttgataatggtaatcatttctcaatatatcacattatataccttatatgtataaagattttgttcattataccctaatgaaactagacaaaatgtgttaaaaagtagatgtggaacttaatccaaatataaataaatgcatgaatgatatggcaatgtaacaaaacagaaaaaaaattaaaacctgaagtctgtcatttcctgggaatgagtgaaattctgagactgcttaatctttagtactccttccttattattgtcccatattttagatttaccttgattttttttaacctctaaagttagtcactattactgttacttctctttcctatagagaattgttagagttctaattctgctatttgtagattctcattcagagtcatttgcttttgactctcttgggtgaatttcagcctgtggactcacacttgacttggatctgagagtgaaactccggggcatggtggaggatgccctccctctgttgagcttcttcctttcttgctgccaggcgtccacaggcactagccctgcctctttttttcatttctgcaatctgggattcccaggacacataagcaggctgaaaggaatcccaaaccagaataaaggcaggtttgtggttagaaatttaagaacatcctttcatgttccccgcgcagtgcaggcaaagacagatattatatttcccttgctatttccttttgctggtgggctgatttttaagtttgaactcagcctttatgaggatcatgcatttgaaatgctcgggacacacacggaggaaactcagctccaactccttatcttcaggaccctggagcttcaaacagccatcgccacccagttagcctggggctgaaagagtaaaacgtgcccaaccaggaccctcagcctccagcctcaagttatcactcaggtcccaaaatccacttcccttttggccctgaggtttttctttacttccttgcaaactcagctatggagaggaaggaagtatgttccaccagatacccagagacaatgagaattttctaagccttggctttaatcaaaactgtcttttaagccaataaaaacagcatttgcaactcaaaactgccatcacagaagtcatcatttaaattaatgatgaaccataagaacattagttcagccaaggaaactgagtctccaagtagaatcacattttatacgcctttagctcagtcactaattctgtcttggccaaatagtctaatgaatgttagaacagaattgtattctctatgagaacacttttaatgagatatattaattttcatttaaaagcagtattatttcttgtgggtgatatcacttattttttcaaaaatgtattacgtaaaagcaatgttctgactagctgtgtattctagtgccgtgtattctagtattcgagggctaaaggctaggctgttgggtaatgatctaaaaaaatctgtaagctgaaaggttagatttcttaaacaaaaatgtacggtacagatttactcctcccaccaaaaggggcctctgtgacttctttcccctggagttatggtgaacaaactgcaacagaataaaaataaaaaacctgctttgaccacatttctattacattcaggtaaacaaaaacatcgtatgggactgcttttagatttgtgacatagttgttccttccaaactagtccaaatcctgaagctctgtctgtggcagttaatttacttctctggcacttgatattagctactttgatgtctttcttggaaagtcataatcaacaatcatgagtcaattttcactgaccttcaacaatccaggaaattgtcaaataggaaaccatatcatcttagcaataactctatgaccaatataattttgaattatttatatcaccttaatttaaggaagcatcttactggcaacaataataaaatgctggatttttatgtatgtgttctagctgaaataataaaaatgaaaatctttactccaattgtgactggctcacctaaattatacatattttctaaaccaatttttgatagcactcaaaaacattaacttatttgtgttttgaccagaatgctcagaacaattatagacacaatagtcctgcagttttctaaatacagtgtttttctatctatataatgcaatttgtcatagcagaagaatcatagcctcaggagacaacatgtcttagaagtaaatcagatcgttcttattgactagctccatgaacttgggcaagtttgttaactacctgagcctcatctataaaatgaggatgataacatcaaactatcaagaataaatggagtgacatttgtaggtaaagaatacaacacctactactcagctcttgggcactatgcagaagctgttatgtggtgatgatgatgattaccaacgtgactacaattaattattagaatttcctcgtcttaggaataattttaagaatagactcaaacattgctatagtaacacattattgtacgtagaatttcaaaaagcatgacattcaattttcaggaaaaatactcattcagaataagagctcctgtctttccactttttagaagataatacaagaaacatccacagaggttgcacatgtatctaaggatctagtttaataaaacaaattactggtacacaaatttgcagatcacaattctctcatcgttctagtttacaagctaatgtgtaccccccctgaagctgagaagctccgttacttaaagccctgtttttaagggttagcaagcattttattatggaagactggttcctcggcgttctagggtagatagcagtaagggtttctcacctgctgtcccacccaggtacatgacagccatattcaccgaggtggtcatccccagaataaggggaacagggccttaaaacaaacactgattaactgcccaggggtagggaacatcctcagtaacatctagaacgttctttggccatttttgcgccataaacttggacaagttaattcttcttgttgtgcctcatcaataaactaaggataatttcaatcctagatgagtaaattaagtgccctaggtaggacgatgaacagagaaaacatgtaggaattgggtttaagtcccatttctaaacttctacttgaatcaaatatttcgaacaggataaaatatgcagctgaattagcaacaattaagaagcacttatcaatatgtcaagtatataaatttaagttaatgttgctgaggtcagatttgccttgatacaaaggctgctccttatatagaatcatcatattcagagctcttcaaattaagttgaaaaactgtcctctaacttaatttgacctcgactattattagtaaaaataaatagtggaacctgtttcaaaagtagcaaagtgtaacagtatttaaaaattatttagttacaaattgtattcatatattttatgctatattttatggaatagcaaacaaggataattactaaaaatagtgagattaaaaacatatacgttagggaaaaattctatcagcattttggtgaatgatctgtctctgcacagtatcatttgacatgttacaattagtaaacagttaatgcaccatattcagagttcttcaaagccagttgaaaaagtgtcctctaacttaatttgacctcgactgttattggtaaaaataaatattggaacctgtttcaaaaatagcaaaatttaatagtacaatttaaaaattatttatttacaaattctattcatatactcctatgttttatgctatattttatggaatacaaaacaaggataattattaaaaataatgagattaaaaacaaatatattagggaaaaattctgtcagcattttgataaatgatctggctctgaacagtattatttgacatgttacgattaggaaacagttaatgcaacataaaatgtttgaaaactttaaatagagcaagtcagtgctcaagtttccctaatgtgatgttgacttttataaactctcaccatttacctatcaacttggttaccctaaaagccagctatttctataggtccatggtgtccccacagataaagattcccacacaaatccaaaataaaatgtgaagaaatagatttccccccattgcccaggagacggggaaccatggcccccactgtattccatgcctactttgtgtgcgtttgggctgtgtaagtcatcccaaaccggcccaccgcactcaggctcgcccggcatattagctgatactgatcacctgcccaccgcacatagactcaccaggcatattagctgatattgatcatttggaactgacttaaaaccacctttttacttcagctactcatctaccaccaaaaacccagtgttattcaccaagttggaggttttttacgttattttttctaagtggaatggtaacacatttccatacaactcatttaaaaatttaataccaaagaaaattttataaatttttgttttctatgtaagagaaactgtccaggtcttagaaacagttgattttggagaaaaacaaacacaactttttaatattttcaagaatatatttgaaaatattaatatagttcattttatgtgtaataatgtgatttcattataatatgttaggttatattgatgattggttagatagaagccaaggataaaatttataactctgtcaaagtattcactaaattttaaaaagtagaacaatttcatactcatgcctcatatccttccttcagaaaaacaattttaaacaagtacaccatacaggtatgtccccactaatggcgtaaagtgacctgtcctgcagttgaacatttttatttgtcatctatgaacattgatataacttgaaaaatacattatcaaagaattatacttagttttatacattatacaaaaattctaattttttgtctaataaaaatttgatgatctataaatcctcaaaatagtagcacagagaatctagatgaaaacttaaatagtggattgtgatgacttttcatttactgcaaaaataaaaatatgattcaatatttgaaaacatattaattcaacgtgttaagatggaagaagaaacaaactgattaataaaaaccaaatgacatttagtaaaatatctattattgaataaaattaacaattttggaacttaagaagataaaaatcacttttgtgatttttacaaaacaaaagcataaaacctagtaatgtaacagaaaccattcctgttaaagagacaagaatagagtgtctgtttacttcaatgttatttttttttgaaagtgctttctaatgcaattagttgggagaattaaataagtataattatttgaaacagtgaagataatattcattaattccaaaaaatgcacaacaaaagaatccattaacaacagttattaaagaaaagtgagttcaatgaagttgctacttagaaaatatatcatgttttaatatgtattagctataaccatttagaaaatataatttaaaaattataaaatagcaattaggatgaaaaagtaacaataagagtttaaaagggagtcttaggattaactatgaactctgaaagatctatgtgaagaaaatgataagcttctacagcagagtaaaaatagtttaaataatatataatgaatataaatgaatattaatattaaagtcttcatatctaaacgcagtaagtattgatcccagctacactgcaactccaattgtaatagaaatagcaatggtcactgacacaataagtgacacattcttggttggtagaaaaaaatggacatttatattaaatattaataattaaatacatatctttgcatacttcgtgtttaggctttggcttcactccctccttagtgtcttacatgactttacatcctcaccaaagttctgaagatattccaaattgtaaggtgccactcttagcatcagaatgcatattttatattgaacaatggtatgaaaaggtacattgcaggtgtgcaaaatataaagtgtatataatttagcttgaattattgtcatagccatatacttgtgattaaattttttttaaacactgtaatgactgaaataaaataggactcacttattcatgcctcatatatattcaaactacatttttggatctattttctagagtcagtacaagtgagatggtggaggggagcagataggaataagacatatatacgaggtcattcttgaaaagtgtgttcacaatttcaaaatcctcgcaatccacaaattgaaacattgttacaaaaaacctaatccaagaatattgacactgttaaacatatgtccaaatccaaaatgtattttcacaacaacttaatttggactctgtatcaactcaccataaaggattatcatcctgtttaaagaaaataattgtaaggtgagcaaaagatggcattcaaatactaattgagtttctatatttgaacaaaatgatgactacagctacatataaaaccattatgacctgaatattaattagattctttttgactaatgttttcctcttggatcaatacacttagttaattctctcaagaggaagtaattattgtagcagtgaccaattgttgtttatagctcacagcaagtctgaggtactgaaaggtagtatcgctgcttacgtttctaagtattttgtagtatttagagaaacaagtagtagtcaaaatgattttttaaattttatttcacttacttgaaagattagagatgaatatcctcatttccaaagacttatttttgcaagagtagctatgggattacagtcaagttcacagaaaacctaaaaatctctgtaaattccaagtacatacaaaataaggaagatatatgtgtatctcaattttttttgaagtaacataaccaaatacccccacttaattctattaaattgctaaaaaaaaaacccacaaatatctgaataacatcgacatcacaaaggacattataaaatggttaatagcccccaagtaatcttaatatgggagagattttcataaaacaaatccctttccacatagaatgtttattcataatgcatcatatactcatcaagatgcttgctatttggagaattacaattactttctcattctgctgtatccttttattttttcaatatatgaaacattttcttaatttcctgattgcaaagtaaaatacacaatgaggtgcattttccaaggtatcatcttcgtctttttgttgtttttgtttttgagacggagtctcactttgtcgcccaggctggagtgcagtggtgtgatcttggctcactgaaatctctgtctcctgggtttaaaccatggtcctgcctcagccctcctagtagctgggactacagacccgagccaccacacccggctaatttttgtatatttagcagagatgaggtttcaccatgttgcccaggctggtcttgaacctccaactcttgatctcaggtgatccacccgcactggcctcccccaaagtgctgggattacaggtgtgagccactgtgcctggctccattttcatcttcattgtgctttgaaccacactcctaaggctgtgtagcttttgatattgagaattttctctctgaagtttaatcaagtatttttatcagagctcatgtattctttgacttttttgaatatgggaagcatgtttttatctaactaaaagccctcaatatatcgcattcatctggtagcttttttcctttttctccaatcttttgaaagcatccttcacatacagtttaacctcattttttatacgtatattgtaaatatcacacatgactttatcaggttgcctgatccaaaataaaattttttgtttctttgcagtttatcaattaaccagcatctgttgaattcttaatatttacattctacttaaaacactgcaaaattacatcttcataaaaaagcatgaaaattatatacaggtgatacccaatgaagtctcagaattacaagtagtgccaatctatccttcccctacaaaatgtcttgaagttattgcatcattactggagtttatattacagaattccattacagatggaggaagaagggcgttcaagccaacagttgggggaaaccacgacctctctgaggcacagcaaaatgttgacctgagcttggggccatatataagatgagcttcaactctgcagtgtattgttgttttatgattaatgatgaaatattgaaaagcttctgaggagagaaacatgatcagatcaatatttcagcaatctctttctgagactttggttgtgatagggaggctggaatgtggacgagagacttgaaggaggcaagcggttagaaaggagttgacatagccgcgtgtttcctacggtgcaaatcacaccaggcatttctttctcatgtctcttacaaatagttctcatttttaattaattcactacagttaccttcttcccagtctttatactggttttatgctttattaacaaaccacgattcacactctgtttccacttcatctcctgttctccttcgtctccatccatgatctccctcggccacacttgccttggctcttctactttctgaaaccatctattttcaaagatcacagagaagccgcagagcttttcttctccccatgtggcatatctccaggcttttctgagtctcctctcttctgatatccagctgtgactagtacagcttgaaccccattatgtttgatgactacacattttatagcccgacttcctgttcaacctgattttgactctgatagaattaaacctgcccctcaaatgaagatcgcgtgtctgccaatgtagctcctttcttctactaaaaccgtctgatccttattttcatttgtaatgtgaaaatagaaatattgtgtttgaggacagtgctactcatcacctgcacggcaccccccagggggctgtggcttccttcctcctagaaagttccctgccgcccaccacactccgtgacttccccacttactcactgatgcttgaaatccccctctgaggacctcattccttcaacaaacaactcaaggtgctgatcgctgtgaaaaatgagacacccctagagagagagggagcactttaaactgtcaccgcgttcactctttactgagattgcattttaaattgttatgagagcaggtcctagtgggaagagagttaaagaaagatttcctagaagagctggtgcagaaagttcagaatgttgaagctttcaaagtccactccttttattatttcctcattctgcctggagcttactctgaattattgtcactacagatatcatttgcattacatatgttttcatttatggatagatgtaaacatatatatacttgcaatgcgatatacacgaatcagggcgtagtggacactcaggaccatgaagctgtaggggttggtgccctaacagcaggcaaccatcaacccacagaggttggtgaaatcgttcattagtaagaaacactggcagtgcttggaaaatgtcaaaataaataaataaaagtttaaaaaatacgtagctttgcctgatgccctgtttgaaatgttgtaggagactctcctcattaactgaagaaaaactcactgcaatgcaatacatttttcatagagaaaaaactgcatcaaaatcaggagatctaaaatgaacaccaccaacaaaataccaccattacaattacatttcaaaagagagaaaaaaaaaaggcaaagaaaatctcaggtgcctgagaattagctcttttgcagcagctttaaagaaaggaaaagaaaagaaatggtaaaatacatccactttaaggtatacatcactatatgtatattaatcctaactcactactaaatcccaggcctgtatatgattaatatacttatacatataaaacaaaaatggatgcagcttccacattatgaattactcctccagctgcaagcttacatgtgattacttggtcctggcagcgctatttgaaaggcacagtgcattccacgatgcatacagtcctcccttggtgtccacaggggattggttcgaggatccccatacatagcaaaatacctgccctacagatctcatgtatgggcaaagtcagccctccctatatagatggatttcacatccccgtgaatactctattttccatccatgtttggttgaaaaaaattgcatgtaagtagacctgtgtagttcaaacctgcactgttcaactatcaactgtacacccacacctgtcaggggtgtgtgtgtgtggctggacacatggagtcttactagattaatctcagcatgctggtacagctagttttcctgtatgaccttaataggtatagtactttatggcttagtactatagtactttatgcccttaataggttcttcgaatctgggactttaagaaaacttataaatagaaaaacatttttttccttgccaatgtcataacaaaactacattgaacaaaagcatgttattccactaattgctgtacatcctttcacctgaagtctcagtttccaagacctatagacaatgaggattacatatatcatactacataggaaaaactatctaaaaccaggattctatgagtatataggcacagataactatacacgatcacagtatttcaaaaaatacatagaaaccacatgcataacaagtgatttgcttcaaacttgtaataccagttatttacttgcagtataccttttttgaaggcagggcttttatgtgcctgtttttgttgaattaggtgagaaataattgcattcttcctaacactccaaaccgactgtagatgaacataaaatatatttggaagactgtacattttcattctgtaattcttgactgtacatttttcattctgtaattcttgaatgaactctcagtaaaggaggttagtatgagatgacctttactctaactcaccactatatacctttgcttgtatcagtcttgatgaataagtctcgacacacagataaaacgatagataaaatttgttaagttgtagctttagcttctcatagaaatcaaataagaagtattttgtaagaaaggaaattagttcacaatatttttaattacaaaggaaggaaaaccacatgcttaaaacagctattgcgtcatgtacctgacatttctaactattatcatttaaaaatggggatcattatgttgccatcatttgatttttgaggaagaagtataaaaaatataaacaaatgaaagccaaagagccaaatgatagagggaaaattaccatttactcttacctttatcttttaaaagagatttggataactcatttgtaagaagaatatacacttgaatgacagtctttctcataaaatataacttataaaaaggcaatgagcatatttgtattagttcacaaatgaatgtgagtatatgtatataatttttccagttttatgtcaaaagtcatgaaagtgctattccattcatatttacgggtaattcgagaaatggatgggtttctggatttcatatcagataaccggtgcaaccctgctcaggtcaattatacttttttatcttcaactctggggtttcagaagcaaattataataaatgcctaataaacttattttgagagttaagtagcaaataagaatagaggacattctattaacttcaattttcagttaagcaatgaatatattttaatataaatatttatcatttgtcgttcatttgaaattcaaattaaatgaggttttctgtattttatctagaaactctaatagagagcagtaatctgtagcaaatagtttataacctggatatggtattcgaatattcagttaaaaggatttgtagctagaccatctgggtcaaaacactgacagctcagcaagatgatttagcctctgtaagcttctgtctgcgtgtatgtctggtgaaacctgtactggtcacttctccaaatggttgtgaaggtgaaatgatataacatacttgctgtgcttaacatggtgttaagtgttcagtaagtgttgactctcaccattatcactggattacttttctatggaggctgttgaagtgtcctgggagtattcagaacgacatttgtattgctatcagtgataaccgcatgcattttttcagcatattctatgtcacttaaaataaatgcagagttgaagtaagaaactgtgactttattgtaatatataactcatttactatatggaacatattaaataacccctcctccattatcttagaagtgactctaatactcactaatgtatttttttgcaaagttaaattagacatcaaagcagaaccagagaagaaaatagtttataaagtccaggcctctgaaataatcagcattttattaacactatacttcttctagctgctactatcaggcttataacgtgaagtatcacccaactggcatacgtggggaggaaaaacacatgactttttttacgtttcacttttctaaactatgagcacaaaattaagattttaaacactatcaacgtgctcaaaatgtctctggtgcccaagagttgcaaacgcattattgattaatcgtcagcacagtcgtaatggcattaattgaaacatccaagcaaataactgtttctttaatatttgtttagtccacaaattatagtaagaggtctgtgtttatagggaaggccttctgttctttaaattatatctattctattaatagattaatctatgaaatttctattaaatatcgaacaaaaatctataggtctccattaaatttacttaaaataaaattaaatgtttcttagaagtgcatcaggtgcaaagtcaacataatacatagcatttcttgtgtctaaactgccttgtgatcaggagatacgggattattagaattttttatcacttggaaaaatattgccaccctcaacaaaatttatgactgctttgctttgaaaactattgtactgcttttattttttcccagactcaagtacccaaaaggtttgctcacagatattccagaaggaaatgttgtgtcttggccacattcatattttcttgagagccatcaacaaacatgcttgtagctgagcagagtgtgtggtatagaatgacaggtataaatagttaatacatttttccattggtatcccttaaactacttgctccaagaaattcttctaacaatgagattagtgatataagaaaaacaaatgaaagcccttggccttataaagataaccaatgatagtcaataaaagagtagcttttacggcatagttacattttctggggttttttctttctagtttttaagataaattattgtctagtttgtttttattgatttttttacaaataaatatgggcgaaatgaaagcaatatgacttctcttttatgttttattaagaacagaaactgtaaggtcagaaggtataaagcttctgtgttgtgtatttgttggaagaaactcagtgccaagattaaaggaatcatctttaatgttttaaaggaaaggacaaaggagaataaatacattgatttgtgtgcatgatactatggcctttatttaaaattttacgtgtagatcacagatctcgtagagggagtgataggaaaacaaacaactgtgctgcttttgtaactgttacacattggtgaacttccaaaacttctgagtgttcctaaaattggcatagataaaaggtaatattgtaatttttaacctcagcatacaaaaattcatgtgcacatcttcctaaaaatgcaaataatgcaaaaattgtatacgttttgcaaagcttgttttagtgataatactcagtgtgattccattcacaatgagtataactttacacacacctgtgcaaaacactttagtcacagaataaaaactctaaaatgctataactttggcatgactaatgatctatactaatgaaagtgatattgttatattttatatgttattccacaaggcatgaattataattggatgaacaataaattaacttgcacaaaaacaggattgtttaaatgatactttgtgtaaaaaggaaaccatgaatagttaaaaagtcaggaaacagcagatgctggagagactgtggagaaataggaatgcttttacaatgttggtgggagtgtaaattagttcaaccgttgtggaagacagtgtgacgattccttaaggatctagaacttgaaataccatttgacccagcaatcccattagtgggtatatacccaaagggttataaatcattatgctataaagacacatgcacacatatgcttattgcagcactgttcacaatagcaaagacctggaactaacgcaaatgcccatcaacgatagactgaattttaaaaaaaatgtggcacatatacaccacggaatactatgcagccataaaaaaggatcagttaatgtcctttgcagggacatggatgaaactagaaaccgtcattgtcagcaaactatcacaagaacagaaaactaaacaccacatgttttcactcataagtgggagttgaacaatgaggactcatggacgcttggaggggaacatcacacaccagggcctgtcaggagaaatacctaatacagatgacgggttagtgggtgcagcaaaccaccatggcacatgtttaactacgtaacaaacctgcacgttctgcacatgtaccccagaactttaagtataataaaaataaatttaataaaaaaagtgatacacataattttaagtgaagtagtgattcaaagtcttattttccttctggtcattgattcaggaaacgaagtctttagttccagtgggatcccaattttaataaataaaaggaaatgtatatgtgttttgatgtttctgtgtagaaggaaaaccctcaggggaaagaaaaatagaacagtggttttccctgagaactaaatctcttttcagaaatacaataaatgttcaatttccttaatcagaaaataagttaaaaacatttaaatacatagttaaaatatgtaatagagtactggaattcatttcaaagtagcctgtgtatgttttcgtataccaacaaatgaaaacaaactacatattttaaaaagataaactccaggttaagtttaaattcagagaaaggtcaaaaaaattaccaggatgccatcagactatccattttacaatgttgtgtgttttataaaattgcatgtaacttttctgccaattaaaaatagttccttcataaacccttactatatagagccatagtttaatccaacactatacatacatatttatatgtcatctacagataacatatatatatatatatatacacacagacacatacatactgctgttaatctttaagaatttcttatgaagttgggttgtattctgaataaataagcttaaaaatccactgaagggaacgggactgacttcccttggatttctgacctttcactcctctttcgtgcctcatctctgaatctgaaggtgtctggcttgacccagcccccatttccccatcaactaatagctgtccgtcagctttcagtcaacctcctcaccacatacttaaatgtaccgtcttaaaaaagcatattctcattgtttcctggtgccatgtttttcttttatatctagagagttttcttgaaattatagacatggatagagctgcatgtctatactcatgaaaacagcaagttcactatgaggtgtctcatacttccctttctcacaaggatatgcagaaacaacctgtttgtatcatgtactgatttaaacacaagcgacagaatttaagaaactccttaaagtgttaacataattagaccttacccattccctaaatgtatttttatttttgttttttctgagacggagtctcactctgttgcccaggctggagtgcagtcgtataatctcggttcactgcaaggtctgcctccctggttcacaccattctcctgcctcagcctcccgagtagatgggactacaggcgcccaccaccatccccggctaatttttttgtatttttagtggagacaggatttcaccatgctggccaggctggtcttgaactcctaacctcgtgattcgccgccttgccctcccaaagtgctgggattacaagcatgagccacggcgcccaaccccctttccctaactttaaatacaataattaaaatgctacatttataaaatcctttatggttctctttctccttatgctcatataacttccaccaaagagaagaatctattcttgaatttcagactacattcacaatttatatataattccagtgctcaatagagccaagcttggtaagtgttcagtgaagtatagtgattaaaattcagtttaattttcaatggatggagtgtaaagttcaaggaggttaaaaacacagcggtagtgctggtaatctacaaaatggctaatatgtgacttaaaattcataaggaaactgaaactataaaattatcagctatacagaatatgaatacatattgagccacatgatacaattacatctgatgctgctatagctatataaaatataattttttaacatgaaagcagcattttaatattaggttgacacaaaagtaattgtgagttttaccattaaagtaaggtactaaaatactaaacatataacaaaacgttagataacatatgcctatttttagaaaatgattaaataaattcatgaatggaaactcaaattttagctacgaattcaacataaagtgtagctttttattaacataccgaacagtctatagccacttaaatggctaacaaaaccagcttgtaacttgctgccactatcatctctgtttgacttggtataagatctgaacaaagagccaagtgtgattatgtggaatgctttcatttgtgtttataaatttggctcttggagtatttataggaaaaacactttaaattacattctcaattgcagtatgtatgtaataaagggagactgctaggataacttctctgaaagtaacaagcctcatttaaaaatacttgcccttccctgtattaacattatgtccatatatgaaataagattgctatattgttataactatttactgacagttgttaaagttgagctatggacacattactttccataaacatcactctactgtttttatgtttgaacattttcctaatttttttttaaaaaacaccaaccgtattagcaaacttctgagcatctccgtttagacgtgcaaaggaaattattccccatgccaagcttcgtctgtctctgtaaacgcagtatacacactaacacacacacacaattaagcagtcgatggcacaagtgtgcaagccacattttgaaacacttatatttagtgtaaaaagccaactgcttcaaacaagtcatgaagaaacacacagtcacacacaagactagacagatacaggtggcaaacggacatctcaacagaatgtcaagtatcttcctggattctgaatcaccattaaatgtgaatttttggcagtattgtccttggataagattccaagtcccagtagcccatttaatagcgttttttcatgagcaggaatactgactttattactcaatgtcaatacagtgtggttagtgcaactttagcaatgtatcctctaatacactgattctgcagacacggttttattgccctaaacaaatagactcaatgaaaggataaatgcttaactttggatgtggtaactcattcgagtatcttaaccctgttcaacttataattagccaactttgaatgtgcattttcttctatttgtcattcattgcaattttcaatgcagcatttctaatgaagaaaaaaaataaaactctacgtaagatatggaggaggccaggagtgttggattatgtctttttgatgataaaaagactgagtgcttgcctgcagcagctcactgtcagtaaaaatgaatctgaagcagatgccaactgcgtcaaaagcttgtgttctatacattttttattaagcaaagatacaaatcacaagaaaagtacataggggcaagaacatcaaaggatactggtgtttcaaacagaaacacaggggcctatctgctgcttccttcccagcctagaacacagtgaactcatagctagaacgctgagcgttaactaacgcgttgaaaataaataactctgttttgtatgctctcttcattacaccgtacacttcaaatgtaaatattctgaattatttagaagtacgcttaaaagaagattttaccatggcctatttcttaagcaagcataggccaatcaaaggttactttctctctttaggcatatagttagctttgtatattgcagtatttgatattagcacgtttttataatgtagtatataataagctttgaaagagagtggatatgttaccacgttctgaaaaaataatttctaataaataataattgaatagacacgacatgttttcttcagttgtctagaatctgacaattaaattttagtaccgaaatgtgcgaccggataccaatctgagcacttgcatacatcactgtttcagtatatcctccacatttcacagaaaaattaaaatatacaagcaaattgtttacagtgcccacatttgcatatcaacactgttagaacttgagactgcagctatgctgggaaaaatgggtactgtttgaaggtaaacctatgttgataataactttgtaaataaattttaaggcttgtgtgaatcagctcacaaaatgctaaccttgtctagatgagcacagctctatagcaataccgtgtaagccataaatataattgtactttcctagtacccatatttttaaaaacatgttactatatataaaatattatttgaacgtatgttaaaattttcaaaaatgtataaattataagacttttatcttcatttcttctacttcctgtaaacatacagcattagaaatacttttttggtaattagttgtcatggaagttgcaattgcaaaagtagatatacatatccacgttttttccaaacacacttgaaagtttcccagtaatagaataaagtagtggtttttaaatgtattaaaattaagtgagttttaaaattctgttccttggtctctctggcttcatgtgttcaccttccaaggcagaggctgccccagaggtgtaccaggatggtatgaggcctctgctggcccctaggtggcactcagccctcgggagcacctgacccactgatggttttcaggtcaaatgtaaataaaatggacctggaaatataaaagtggaaaatactttgctaccttaagtatgatctcagggaattaaaataacctctcgacagcattatgggaaaatagaaggtagagatatgaaaacctgatagtaactgcgagaacaggtggtcccaggcccacagagtaagatgacggcataaggtctttgcataaaccagtggtttttcaccaaaaaacagctttaaattatcatgtctaaagctatgaaattaacacttcagaaggaaacaatttgagactggcacactccaaccttctgtttcaaatttctgaagttttactgaaatatcttatgcattgaagctcacattaaaggtcctttaaaatgttgtgacaaatgagactgttctttttctgttttttgaatctaagaagtatgtatagccaaaagttaaagcttttaacttttatgttgggctttcttacttgacatataattctatatagtaacatctgtatgtgataacatatacatacaagtcattttttgtataaacattaaacggaatcaatgtaatgtctctacttgttttcaaaatacataaaggaataaagtgataactgtattaaaacttaatcttattacattgtaaaacactgattttctagagctgcctcataaacacacctaacatgcattaaaaaaatgttttgcaaatgacaaggcaaaggcttataaaggttaagtgacgttttgatgacatagatgctggtgaatgtgcctgttagggcttgatcaggtttaccaattgcaaatgcattcaactatagcaaggtgaattcatgttctcttgagatgtgattagcctttgttataaacactttccctgggttgtagcacattgtagcatccaagggaaaacattcttttattaatccaagagtatttttaattatgtaaactttaaagttatacaatattgctcaaatacgatttcaaaataacttctgaagtcacgttttgatcaatagtgattttttgtgaaaataaacagaaacataaaatcttacaactgcatgcaaaggtgaatataatccatgtgaacctgtcattttacagatagaactgatgaagctcaggaacactggagcacgcccaagggtcaagatcataacacagatcttctggccactggacaagagggctctcttcttcattttctcggactcattagcacatcaacatcccaaggatgtcctcttctccaagcaaggtcctattgccagaggacggaatggtgccatttttgcttatttaatttagtatgacatcgttatctccctctaagctttgcgtttgtaaagcaactaatgtgtaatgtgtttttctatgcagcaccataaaattatcttaaatgaattgatcttagaagattacagtcagggagaaaggtagttagtatattgtatgcattcaccttttcagttttatttatttgaataccagttaggaactgagttggctgtgacagcatcctaacaactcatttataatcggaacaattttaattacttgtagcaatagtatgtttaaatggtagtattttgagagctttttatagtaattacacttcataatggagtcgggtatatatcagattcaacaagcatcattcagaatctgacaaacgttcattttctaaagatcataattatattttacattaatggttgaacttaccacagttcattgctgtataaacattttaatgtcaaatctgaccctacacttttcagtctcatatattcttactatttctactgcacattagtcattctgcctgcattgtatccctttgattatattttcatttaaaaaaaatgcctgatagttagaaacagactgtttttaaggtcaacatcctgttttttagcagactttagaaattactaccagtaatcatggataaaaacactcaattgttggttttgtgaaggtacgttgagagtcttttttacaacatttaaaaattatatatgaatatgatttttctaaatttaaagtatccactatccttttgcaaacagtttagatgaagacttttaatgcacattttccatctgtgacatttgattttgtttattgatttgtagcttcagttctccttcactgctgccctgtataaatgcgaacatctttgccatctgaaaagggtatgtgtgccatgaagtgaattaattctaagaacacattcttttcatctgggtacaggatttccaaatgcaaattatctcttgcatttttactcccactttgtaccaatatattttgcttttgtccaatcattttatagaactaaggacaatcattttatagaactcaagttatatatgtcgtatagttaaaagtcttcaacatgtaatttaggaaacccaggtccttggggacacgaaactttcccaagaaatgtgggtagagatggacaaaacccaacagacacacctcagttttccacattcacttaggtttttgagaagcacacactttttattctttttaactcctcaaggaatgcatgagtgttttatcatattaaaattctggacatgaaccaaaaggagaataaaaaaaaaaatccgctttacccacctataaaatcctactctgccccagaagcatggctaacagtttcatgtgctgacctccaggtctttctccatgtcttatacatacattttcatcctagaatgtttgcaaatctggacacaccattattaacaataagtttggccaggggtggtggctcacacttgtaatcgtagcactttgggaggccgaggaaggtgaatcacttgaggtcaggaattcgaaaccaggctggccatcattgtgaaacctggtctctactaaaaatacaaaaattagctaggcatggtggctcacacctgtaatcctagcattttgggaggccgagaagggtggatcacctgaggtcaggagttccagactaggctggccaacatggtgaaaccctatctctactaaaaatacaaaaattagctgggcgtggtggcacgtgcctgtaatgttagctgctcgcgaggctgagacacaagaattgcttgaacccaggaggcggaggttgccgtgagccgagatcctgccaatgcactccagcctgggggacaagagagaaactacaaccccccccacccaccctccccaaaaagagaaaggttgttcttcaggagagacaaacactgcgggagggtacctccactccgtgttccctccccgtcaccatgtggctttctgtttccacatgttgcttttgcgcaccatgccttcccatatggtataggttcttgcgcgacacacttgcatatgccagccccaacgtttattgggcagtctaagcaaaatatttacattctcgtcaggcaaagatggtaaaactcacagcaactgttctccaagggtggactcaggactcctggaggatccccacaacactcttgacagatataaaacactaaaatttggatttctacgactcccaggagggtaactccatgtgtcagatgatagccttcttctaaccacttgcctggctctttccaaaaaccacacatattttacaaacttcaatatatgtggccgtgttcaaaaacaaaacaaaacaaagaaacaaaaacaaaaaaaaactagtttaaaaaacacttttctgtctcctcctttcctgaattcagtttcaggatgcaccagttaattacctgtaagaccttgggcaaagtaacctcacctcacctcgcctcaccatgcctcggttcctttatttgtaaaatggggataataatggtgtccacaccataaaactgttgtaagcataacacaatagtcagaatgatgcctagtgtgtaggaaagttttgctattattatgaatgctaatgagaaaagtccttttaacttacagatattttggttgtccacaagttttactccatgaattttatgtttttgtatgtcaaggagtgtgttaaaattcaaactgcttgtatacaatccggtttcatcatacagcaggccgactgtagccttaaatgccatttcgttcttgcttaaataatcaaattactctctgaagccatgtgcagtcctttactttatatttcatttagaactcccatctgaaactgcagcctttctattctagagggaaatgaatttgtggccatgaatcttgaaccacatttctcataagaaacacctagacaagggtattagttcagaattatgaaataatacagaaaaaaagtgggcttttccaaatataaagaggatgaagacagatctcttgttttcggatatcagggctttctctccatggatgagggcaggtttcgctaatgctgattttggaccaggcagctgggaaatttgatttcctgagcattgccctaaatggaatagcacagatggttggtctttgcttttcttgaatggcagtggtgtaggaagaatggagctttccagaactagtaaaacagtcagggccacaggcttctcatcctgttaggaacttcagaggtcaaaatagctttgttaagacatgcaggctctgcttcttctccaggtgtccctctaatttcacagaagatcatgtgtccttggctattttaatcaggaacaaaatctacttgtggtctcttccagcctggaaagtaatccaactgaagtattttaaataccatctgcacaaaccttttaagtggctatgatatatccgcaatgctataattacacgtatgcagtgagtcacctttacctctgacagcaagcaggtttgtaaaaagctctctctgccttggcttagtggaatttgtagttacatccctaagtccgaaatacagctggagaaatacacattattctttatgtgaccgttcacgttaacgatatgcgcacataacgtttttacgttctttctggtaccataaacaaaagtcaagaggagctccagttttcttttctcccgactgcaaactctgtaattccttcttgccaagctccattgcgtctctccgccatgctctccatgtctcacttgcttctacttagtgctatctgtcctcaggggccgttgttcttgtcactttggaacattcttttatttttaaaaaacaacgtttttccttctatgttagttcaaaactacagtccttcaccaagggcttcagttaacatgagacagagaaaaatcatggagagtatgtttagtcggttgcaatatgaattacccattgtgcctcttcattttaataagacggttgtggcacaggaaggaagacactcttctgagataatatggtctcatcattaagaacatgggcatgatcacgaggacacccaaaaccagcacctgatagcctcatctattaggtttgggaacaccacttgacctcgaagaaaggtttatcctccaagaaaggggatagcaatcatactgattttgtagggccacagtggaaatcaaacaagagaatgtatgcagctcacacggtagactccccagcatctgatgcttgataaatattagttttctttcccatcgcctgtttggctgagaatgtttcctagaaaaccaaaagttgatctttcagttgctgttgctgtttgttattaggagatgtgcactaattacacttgaggccacttcattccattgtggccaaggagttgattcaaatgaatcagttttgttattggataggagtcaataacaattccatagaggcagctgaaggaggctgacatccacgccaagtaaagaaaaagggctaagtttcacttgaaaaataagaaacttcatttagagaatgattgtacactaaggcttagtaacttgagagaacaaaaaagagtttcaatctacttcacacaaaacaaacaagggttcttcaacacctagtctgttaatgtggaactatgtggacagattctgtgtaatttagaactaaacagtttaattttactcacatagctaattagatatcttgcctctatttcctggcaagttctaaaagattccccctcacattccttgaatataattagtatttttgtgtaactctttattttcagataaatcaagcacatctggagaagttactttaatgatactttttaagaaagcacacaatctagaggaacaatgtaatggaacaacatcccatgatttccaccagaaggtttctttctaactaccctttcttacgtccaatattgagtaatattagaaatgacaagcccaggaaacttactttacattctaagacttaatatttacaccacacatgttgcagcttcccattatcgttatagataacaaagacgggggactaatgtctgcaagcttttattaccttccagggaccaggttaagtactttacataaccttaattaaatgctggctgcagtctcgtcataggtggtattattattattattattattattattactactactttgtaagtgtatgaaagagagggttagcaagttacacaacatcacacaaatagccactgaaagtggacccggtcggttgagcgagttggactcatactatctctcctccaacctctctgtggcccactgaatgcatttagtgggagaagtgcctcccctgttcctaggtgaaaacaagggcagtctcaggacatcccaggttgctcttaagccatcacatatctatggtcatgtttagttgcaaaacttttctccagatagcaaatcccaagacaatatgataataaaattaaggtttgatttaaagttaaacttctgccttttttagctgcaaccatcaaaagacagaaagctaaaacaaggaggatataaaacttctttacttttactgagccttagttttacttattttgctagccatgctttctgttcctgcagcattaaagtttgactgagaaaagaaaacactagagagtagaacacttttcttttttactggtactgcagtggatggattcgtccactcagggcctggcagtgctgggtgccttcatgagtttctgacatgcccccactgggaacagtaagctccctttcctaaggtactatttttggggccaccctgaagggctcccttcacccttcaattttcttaagcaaaccttaatgattccagagaggctatcttacaagaatgacctacaaatatctcaggcttgttcacacaaactcaggaaattcaattcaatgctgtagccatttctcctgtactgctgacgatgaggctatgggtaatcccactctgcctttaggtttacccagtagtagcagataccacatcctgtccttatgacttgtccttctaagtgaatggatgcaagttcagctctacgcatgcagctggagttcctgccactgggttcaaggtgaaggatgttgccaccaactctgccgccctccccaataaaattccttttcaacatttgtaacctcgttgtagagtcttctagtggatttttaagcaaatctatgattccaagatctctcagatggtcaacctcccaactctaagatctgatacctgtcaggtctacgtagcagccaacattgagcaaaatcaagtcccattacgtcagtaaagcactaatataggataccagtatgctatgaattattttaagagtaaatattagttacttaacaactacttttaaagtcctcattccatatataacattaaattacactaatagtgtggcagctgtaaaaatggtgatacgtgcataaaaataatttaaaaacacagcaccatctttcaagctatctgttcaagcaatgactgtcataatgagcataaaaacagtgcacatatggatgaaaataaaattatatttggtgtaacagcaaaagaaaaattttacaaaatgaattaactagttacagttcttctaacacccgttctaagacagtgtatattatataacagtttatcggacaaatactctttaccagtttctagatacctgtcggtcatttctcatattgttattcaactgttttccctggaagcctctttaggctaatttgcctacataatttcacccattatatatgagattgctatcacgtaactcccatacatttaaaatacatttaacttttcttataggtaagatagattaacatcgatcaattagttaaagtagagggagccagggcctgtgtttctcctattttttgcacaaacactctaaatgactccatcaagtccagtagtagccagatttggaccacataaactgagttctgtccactgtcagtatgagcaagatgtaacactttcagatctgacacgtgtctcccactcagaattcatcacattttgtccaggtctggcagtgacgatggtgccgtggatgatggtggggatctgctggacggagtagagcagctgtccatggtcctgagtaacatgtgctcaagacatgagcaaaactttcagctttgctttcttcagctactgagattttgctactgggtaatgcattgtgaataaaacatctccaccgtactggaagcaccatagttaaaaggaggtatccacctttgtctgccatgtgttcacaaactaatctaatgtctggctcagagtagatattcaaagtgtatttgctacaaacaagaaatgaaaacaggaatgaatcaaatggtacctctgagtgcaagtgagtaattagaatcattattgacctcttcttgagaggagactcattatttcattcagcttgtatatttaaggaatgtgttatgtgctaagcactctgtgcactgcaactgttaaggtttaaccagaaccaacaactgcaaattcagcacggtcttttttatagtggcatacagatgtgcaacaaaaccaaacggaatcaaatacaaacaggcagggagtggtgaggaaatgcttcccaggtaaagcagagttgcgtggacttttgaaagaatcagtcaaaggaaacacacttgtatgtgtgtctgcaaaaacccatgtgtttaggcccgagggtgatgtttgttagaagaaaagcatggttttcacatatgtctacagatgtgaaatttcagatggtcgtgtttgaatttctacacagtaatgctctatgacatctgaatggagggagagaagcccaaagacgtaggaagtggtaaacacagatcagaaaggtctctaacatgagatttgaacttccatgctgttctatgggcaattttaaacaagggtcagggacactgcatctttcatagcatgagaaaaaaaggacagatgatgtttctctgagttatgggggaaaacaaagatgaagaagggccattcatagcttttctgtctcccatgcttcatacaatttaccaaggacaggtagatgctgtatttaggaaagattccttgtgagaagtatattcataattatgatccaggtttaagtagcagcttcaactacaaaataatgagcatatgacattgataatgttcattaactttatctccctatctgtagtttcatttaggatttctattctgtaagtctgattttttggtaagcttttactttcaagaaatcacaatttgtaattaaaataattcaaagcaaaatgaaaatatccatctgtttcttgtgactcatcatcctttacaatgtcagctctctgtaattccgccagttcacaacttcaactcaactgctttaattcatttctttctaaaatttagaggggcaaaatttcatctccctaaattgtatttgttaaatgtatatgtaatgatgtcaaaataagatcttctttgtaccctagtgtaaaatattatgggaataataatggaatttcctgttttattttgtgtaatacaaacacaacttctaaatgtttctatgacaggaatctgagtcttaatatggtttggggattatctatattctctttagtgttgcataattatacattattggtattttaattttaaaaacaaaaataatatgcttatgatatgtgcaaatattaagtaataaagaaaatattcaaaaggataaatatggattaaaagtcaagatatttaaaagctagggataatgatcataatactttcctttaaattgataaattacatataaaaacaaaatacaaatttatacttacaaccatgtaaagtaaatctccataattaaaatacaacctccaaagcatggtagaatttgaattaactaagagagaagtatttttcttttttatctactaattcccagtgattctgacatttcacttgttttcggaaagtacattttgatttacacataaaaaaattgcttagtgtagaaattttattaaagctgaagcgtaatatttaatttctgtggtcatttttcttgtgatatgtttctttcttaaattatagccgcaatatggagaacatttcctaccagaaagatacaaaattctttattcaacgggtggtaaaattcataaacccagtctaatcagttatatgcggagacaaaagttaaagaatattaggctaactagctacttttaagagctaatataagacaagtaatatctggttctgaaatgtcatgtaaaccatatggcctttgcaaaataattaactcatgtgaaattagaagtttcctttcaggtggacaatttgtttttcacatcaagcaggaacagaaccttctgccctatgtgaaaaagcaggcagggagcctggtgtccagaaggaatttctttcatcagagtttgagacgccagagtgagtttgttgcatagatccattattacctagttactttaataatggaggtttggacacttgatcattcaatgaaaacaccaaggagatataccagggaacaggaacaatgaagaccctggccataccaacaacaaagaaatatgaaaatgacccaggtgagcccggtcatagatttcagaagggatggacttatttatttgtatatgctgctttttcttactttccaaagaattttgttgtcgtcgttgttgttgttgtttagttttgttttgagacagagtctcgctctgtcgcccaggctggagtgcagtgtcgcgacctgggctcactgcaacctctgcctccggggttcacgcctttctcctgcctcagcctccagagtacctgggactacaggtgcccgccaccacgcccggctaattttttgtgtttttaatacagacggaatttcaccgtgttagtcagaatggtctcgatctgctgacctcgtaatctgcctgccttggcctccccgagtgctgggattacagcccaggcgtgagccaccgtgcccgcccgaattttttaactgaatggaatttataacaacccactataagattaatacatgtaaacatgttgatattttctgtgcctcagtcttgcatcatcaacatgtttctatacatgaaaatattcattagaaaaaatgattcagtttattttttctatgttatagtcttaatattaggcctctagtatcttcatcattgttcaaactgaatattaaacacaatcttcagtagtcccaaccatgtatcttattacataaaagatttacctaagagtcagggtccctaagaatagagatggaatatttaatgggttaatttaaaaggctttttgtaaagagataatttgttagttctgcaaattcatggatagtattaacagaaaccaacaagggacccacaaagcactccagaggcaaaagacgtgaacagtctcttttcttcaggtgcagaggggcaagggagggaaagtgtggttatggcttgagaaggggctattccaccagagctgcgtctggagtagaaccatgcactgcacatgcggaaacagcaggagggggctaccagcatcgccctctcagttttgtcccgcacctgccctttgtccagtatactctgaggactgaacctccctggcacagagagaggaagagagcccaatgatgccgtcctcaaggccagactccaagggcacagagtcgtggagagacacaacaaggaagcttgaagcagcaaatgaaaattggccagcacaatgagaaactgacgatgctgaaattacttgtgcaaatattaatatcttactagtaagtccaatctaaatttattgagcaactcttaagctcctgcattattaaccaaagctacggctaaaaagtgttttaaaaaaattaattacactaatatgtgaaaattattatttatatatctagctcagtatgcgtttctttttatacttactttaaaagaacactaaccatgaaatagacttgtcacccctgtgccttatcttccaaattaggcacaataaaagagctcatctcatcatgaactaagcaatactgcaatcgtgtattttgactgtaagacacagcagtctcttataaaccaccaataaataataacaatcatatctcattacttagaattgcattccatactttaaaaaagatgctttagacatattaaagcacagatatttttgtcttatatcagtttggtacaaataaaacaaggaacattgaagcaaaatgaacatgcatttctaagccattttaacattcagtgtccaaagctgttctactagtttttgactcagtggtgagaccagatttaaggtttgatagagggatgtcctattagtgtctactgtagagctttccacacttttaaacactttctacaagttctaaagctggtgctttttgaacttaccaaatagtgtgtataaaaagttttaggataagaatcaggacttctgttctttattgcgtggttctcaagtgactattgcaccgaaatactgcgaagttgaagttctatattcctgtcactggaaaaagtaatgtggcaatgacactgacgtctgattaaccccgaccagcagccactgtaagatgccatcagcagcaactacaccccaatttcagggacaccaaaatgcgggagaaactgaacatctctgaattgatagcatatagatcgtgtgacaaacaatcacctatgaataaaggcttcggtgcttcatatccttttaataaataatacgtgcactgacggttttcaaaataaacccaagattctagagacagtattccagagagtgcaagatgtcaccgttctttctgattgtacttgaatagctaatgtttatcagacacttcaattaacatcgcaggcaatgataatgatctaaatcactgatctctgttgtttcatttaacctcaggataatgccatgagttcctccactttgcagatgagcaaacacaaatcacttgtccatggtgccatgttagagaatgaagtgaaaccagaaaccaggtctaaggactacagaccctgaacattccagaacaacttgatagaaagttatattcatgtttcttggtattttacattttaaaaatattctaagatgaccatctattttagcttctcttctcatataatctatttttttcttactgtaattagatgactttctaaatttatttgtaataatcatgggtaaaataaaaacctggaaaaaagtgcttacttttcaacccatgtgtaattagtaactttcctaaaataattccagaaaactttgtctttgcccttttagtagctgtcaatgtgtatggaacgaaagcctcaggtaaccatgtggtcctattctctcttctttcaggtaaagtgccaaggatatttttcttatattttgccaagtcacctgatctgaacccaatctaaggtgttaagattatatatacatataatatatgtatatattatacacatataatcttaagattacacacatataatcttaagattacacacatataatcttaagattacacacatataatcttaagattatataatcttaagattacgcacatataatcttaagattatataatcttaagattatgcacatataatcttaagattttctatataatcttaagattatatgcacatataatcttaagattttctatataatcttaagattatatgcacatataatcttaagattatctatataatcttaagattatgcacatataatcttaagattatgcacatataaccttaagattatatatgtatcttattatacacatataatcttaagattatataatcttattatacacatataatcttaagatatatataatcttattatacacatataatcttattatacacatataatcttaagattaaatatatcttatacacatataatcttatatatattacatatattataaatatataatcttaagattatatgtcatctttttaagggcttattaagggcttaagattatatataatcctaagattatatatatataaacatatattcataatatataaaaatataatcttaagattacatatgttatattatacatgttatatatgttatatattgtgttaaaattatatatatctgtgtgtgtgtatatgtgtgtgtgtatatatatatatatatatatatatatatatatatatacacacacacatcttgagagaaaatttaaagttaattctcccttatgcaaatttcagatttcttcaaccattatcccaaacaagtacaatgctcttgtcttttctccattgcctgcttcactaattactcccatctcaggaacacagcatgtcccagactcactctgtagaacattttcctgaaaaaaacaaacaaaaacaaaaacctaaagactttatctccaacaacatcttaaaaatgaaactgtctaattgcaaaaaagactgaaggagcccttaaaatgatgtgctctctgttgtttttctctttgcaaggagagaaatcttaatcaaaaccacaataagaagcgaaaatggaaggtgtggtcaaactatgctcagggtctccctcctggcaccttagtcctcaactcatctccagctgggtccagcttaaaaccttgatcagtgattagagctggaggagtttatagcaccagaattcagaagtgcccaaggcaggaagaattatttcgtccctgtggttataaattctatagttcagggattatgcactataaactcatgtatatttcaggaccacatccattatttctaaacataataatgatttaaaataaagggttatcacaagagtgtgagatagcatggcatttggactcatggccagaggtaaaatatttaaatattttaaataattaatatcttttcccaaagagagggtttatctatttctgatgttaagcattattcactactcataattcagaggatggatgtatttctacatgcaaaaggcaggtacatttacttcatattttataatagtttgttatttagttaatattcactattaactcgtatgtggaggtccctaggcttgggtccctgaaaacacgaaaataagggtttttttttttttttttttctccagggcttacactctattgggtatatttctactgtataatgatttctaaataatagctttatgctggtgaaaatgaatagaaaatgtgattattgtattcatctgaagatatctgtggagggcctgctatctcccagacttgtcttagactcccaatttttttaaaaatgctcatctcatggagattatattcctgtgcatgagtgatggacaatggtacacaaatgtgaaaatataaaaacctgtaagtcagatgacaatagtgcaaagaagtacaaagacaggaataggaagtgctgggaaagagtaatgctacatttttacgccaataaaaatggtcggatgggttagataggttgaagagcttggggagactctagagcatcgtaggtgtaatacgttttaatcttaattggcataaaaatataaaacacataaaatagtcatgaatatacttttacaatctagaaatgtatttttttaaatccctggagaaactggggaccaaacatttagaaataattaaatatagagcttgaaatttaccaaggctatatgaagaaacagccttgtatcttacataagatactgagagaaaacctgtttaatccaaatctaaaaaaacaaaacaaaacaaaagataaaagatgcagacgttcagcgtactgtaattcatttttattgactaagaagtgaatgttaaacggtattaaggaaaaacagacatcagttgctgggcgtccgcaagctaatactttattcagttaaccaaagttacattcaggccatttttgcttctatagctgttaaacccctcacatatgatcaatttataatgctaaatgttgttattttaattttagatgtttaaaattcctgtaaggctaagatagcctgaaattgaacttgacctttcaaaagttcacactagggtttggattttgactactttctgctactgttttagcattaacccggagccatcggtgatcgcctctgtgttggaagatcattcaatggcaccactaacgattaagaaccaacatcctgtgagaggtgatacatttcaaaaggattttcagtgaattatataattaaatttgatttctgaatatgccattatataaacattgctggtggtcctgcactttaaaacaagaaaatttatcgaatgttttaaaagtatataatcagaaaggtttttattagcaaaggaaaataaaaggctaggtgacggattacctgaagagtgaatatggtgaagaggtgctaaaatgtagcaaacgcttgtttcccttcaataaattgattttatattgaactcaagcatcactaccagtacatgctagcgtctctctggtgaaaacccagggtataaaggacctggagaacatcccagggcactggggacatattcaaaaatggtatagaagaaaagtttagaaaaacataattttgaggaatctgccttagttaaatgaagtttccaaaataatgccaatctttgcttcctgtttctgcaattaaaactaaaaacacatacattaaaaggtaagaagttacaataataatgtttgattcctttactgttattctcagttgtcctttcattcaaaaacgctccatgacatcagtttactgtaatagtttttatttactgtatttgctttgaatccaagaataccatactagacactagactgttatacaaagttgtgaataattccctatacaggaaattacttagtgagtacaatgtatattatttgagtaatggataccttaaaagccctgacttgacctatatacaatgtacacatgtagcaaaattgtacttgtacccaatgaatttatgtaaatttacaaatattgatacacatatttaatgttaaccatatgcaaacgttatagaacatcacaatttagttttaatacagttctaagaagttatttcattttcatttacatcttcaggctactctgatactaaatcaagtattttcttccaactagatgttaagaaattaatgttaaagtgatatttgtgcttttgaataaatttattttgaagaatgtgtttgtaaaatacatgtaccctagaacttaaagtataataaaaaattatttctggaaatactggtataattctttaattagacttaaatgagtaaattttacatcatatatatgtatatatacacacataaatacataaacacacaatacatatatatgtcatatataatagaacaatgaaagtgttgctttgcagatctactgatgttaaatttgccatttaaaaagcagaataaaagaactgtaggaaataaatattctcctgttaatcctatttcttacttatgataatataaggagggaagaaggtgatagaatacagaaaacattaaaagatcttgccaaaacagatcgtgcttttcttcaaaaaagaaacgttgtaagaaatttataggagaaaatatacttttgccaggtaatgtaagtcatcagaataaaataagacactgtaaatatttaaatttaaaaccgtcggataagataaagtttttcttcacccccatcacccccagagaacgcactttttaaataattacttccaagagggggtttttacttgacatattgtaagtgtctgaagtgattgtagataaccagtcgtctcaacatgagagaggtgattttcaggattcctacagtctttcaaaaagccactagtaattggttctttaattcaacagatacttactcaatagccatcatgtggtagacaccttgtaagtgctgagtatattgcaaagaaaaatcagtttctagcttctcataaaatttaaagtctacattcagaaatatgccccatattggccaatatttttgtatcatatcatatatcatacactatctttcttttctttctttgagatggagtctcattctgtcgccaggctggatgcagtggcgatcttggctcactgcaacccctgactccccatttcaagcgattgtcatgcctcagcctcccgagtagctgagattacaggtacgtgccaccacgcccgcctaatttttgtatttttagtacagatgggttttcaccttcttggccaggatggtctcgatctcctgacttcatgatctgcccacctcagcctcccaaactgctaggattacaggtataagccactgcgcccggcccagacactatttttcaagttataaatactatttgttgataatagctattagaatttctgtcctttgtagaaagcataaatctacaagtttgtataaagaggccacaaagagtgagaggaagaacttctcatacatgtcagaacatctggatttaggatttgatttgcccatttgctaattaggtaacatcagctgagtgcttttgactgcatagttatctttcataaaaacaacaacaaaacagacaatttcctttttgcctatctcacagaaggtgtgtaatgttcagttttgataatgtataaagtcgtttgtaaacacagagctttctgcatctaacatattttcctacacttgggcacagatggggaaatatgaggggacctcaaaaagtttgtggaaaaataatattaaaaggtaaaaataaaatatataaactttatttctcaatatatgctccatcaacctcaagacacttttgtaagcgatgatgccaggcattcagtccatccctaaagaactgagtgtccttggaatttaactacataaatacagtcttcttaacgttattaactgaaggaaatgtcctttacagacttttttttacattttattattattatgctttaagttttagggtacatgtgcacaacgtgcgggtttgtttcatatgtatacatgtgccatgctggtgtgctgcacccattaactcgtcatttagcattaggtatatctcctaatgctatctctccacactctcccaaccccacaacagtccccggagtgtgatgttccccttcctgcgtccacgtgttctggttgttcaattcctccctatgggtgagaacatgcagtgtttggttttttgtcctggcaatagtttgctgagaatgatggtttccagtttcatccatgtccctacaaaggacatgaactcatcattttttatggctacatagtattccatggtgtatatgtgccacattttcttaatccagactatcgttgttggacatttaggttggttccaagtctttactattgtaaatagtgcactataaacataagtgtgcatgtgtctttatagcagcatgataagattaggaaacaaaaagaagtcagaaggagccaaatcaggactgtaaagtggatgcctaatgagttcccattgaaactcttgcaaaattgcccgtgtttgaggagaggaatgagcaggagcattgttgtgatggaaaagaacgctctggggcagctctcctgggtagtggtctgctaaacttttggctagtttgtcaaaacaatctcataataagccaacatcatcattctttggccctccacaaagtcaacaagcaaaatgccttgagcatcccaaaataccagtgccatgacctttatactcaactgttatgcttttgctttgactgtaccacttccagcccttggtagccaatgctttgattctgttgtgtctccaggatggtactgggaaagatatgttttatctcctgtaacaactcttcagagaccagagtggtccaggatcttgatgccacttgcataagatctctattgaaagctctactcttgtttgaagctgatctgggtgcaatgttttggaattcaccaagtggaaagtctgctcaattattatttttttgtcaagattgtataagctgaaccagtcatcatgtctgtggcactggctgttttctgctgttaactttcaggcctcttcaattagggcatggaccagattattatttttcttgcaaattgatgtgcatagtctgttgctgtgggtttcatcttcactatcatgtcctgcctccttaaacctagttatctaattgtaaactcttgattttgccaggggggttcattgtccccataaacttttcagaaagcatcggtgatttcaccattcttctgcccaagcttcaccataaatttgttgttctcacttcaagtttattagaatttatgttgctttgataggggctcttttcaaactaatgccttatccttcttagtgcctcaaactagatcctgttcagatatgttagaacaagttaatatgagtttattttggtacaaatattttttgaaatccctaattttttcattagaattttccacaaactttatgaagaccccttgtatagttcatcatgttcattatgtagaagcaagctatcttgctaacaaaaaaacagtttatggacttaaggccaattgccaggtggaacttgaggggtacctaataaaaaacaaagctttaaatagatgcaatgaaggcccaaaagaaaaatgtagtgttttaggtgatggtctgggaaaataggtaagagatatccttggaatggttttccttaactcattagctaataactgtaaaaataataacaataatagtgattcatagtgataatgtatcaaggggttatactattcaggcactagttgaaaacctttatatatgtgattactttcatcccatagtgaaggtggttttatcacacatatcgtgcagacaaaacagcagtctgtgaaaatgtaagctacttgaccacagtagcgtgcttgcatgtaggaagtcagattaagagaccgtcttgaaagtcaggtttccgcctctctctcaaccctatacgataatgcaccgtaaggggattctctcctatgttgttgtgtttttctctgacacaaaggtcaaaactaatagctgattaatgttcaaaagcattcatctctactaaactggtgtgtatgtgccgtgttttcaacactcttttcttctcattaagtcatttagttttttactgaccccaactgagtccaggtagagttggcaccgtcagcccctctacaagccagagagtgaagtcacagggtcctagtgaccctgtgttttccaggactagcaggcaggaccagcagtttaaatgttggcctccatgctgattcatattaactcaaaagacagattttttttttctggaaaatgctgcttccctttatgcatgaaactgtgaccagaagttcagccctctgtatatcaaatagacacaaaatccaagaaaatcaggaatggcacttttgtgtttagggaaaacacatacaaggaagtaggtataaaaatgattttacacagacaatttttgagtaatttaaaaggaattaaaataaggacattatgattttctctaggaactaaaacttccctcaaacatataatagggcatgaatattgtgggcttgcaactgagaataacatctgttaacagaggcatcatctatttcagataagtattctctactctcatgaaatataaaagaaaacaaaacaaaaataattatttttacttagttataacctggcactgacaaatgtattaaaggaagcaaaaattagcatcttccatcaccaaaatcttcaaataatttattaattttttattcattgtctcatttatatattgggcaggaagctgttttttttttttttttttttttttttttttttttgagttctctgtgctgagctcatgttgattttcaatctccttaccatctctagcacgtctatattcaaagattctgtaaaaggaaaataaattttaaaaaatttcttctcagcagcgttggtgactgtgtggcaccttctggacattgtcatatgaagagagttctaccagaggtgactgggaagtttttcacttttttattttttatttatttttttgagatgtagtcttgctctcttgcccagactggagctcactgtcattatcttggctcaccccaacctcagcctcctggtttcaagcgattctcctgcctcagcctcctgagtagctgggactacaggcacactccactctccccggctaattgttgtagtttttagtagagacagggtttcactatgttgcccaggctggtctcgaactcctgaccttgtgatctgcctgcctcagcctctcagtacttttctaaagaaaggataagctccagctgccacttttccctcttccttttgcctcctcctgcctagaacctgaacatgatgtctaggaagcgtccataaaagaaccaagaaagcagtgatgagagaaccaggggatcacaaagcctcgatgaaacccttgaaataccattgtgttgtcttataaaattaaccactgttatttaggctactatttgaattttcaaataaaacaattagaaggacataaaccaattcaaatttgggagaataagccagttttgatgaaaagagatttaaagctgttttattctaaatgtgaagggctttgcaggcaaagtcaaggattttatattttattaacgggtaacatgttcaatatagaatatatagaagatatttattttgtatgtcaaactgatgtcttagatacattccatttgattatcaaagtgagctcatgttgtaaatagagaaattattaccatctaagagcgacagaaggtgaatttaagttccaaaagttaagtgacttgctggaagtcacccagatagtacagagtcccatcctgacacaaacgtaagccttactgtttcagtgtcaggactgggccacctgctagctcatcgtgataatcaattgggatgtgtttaaaattgctttgaaatgtcaaatcctctttaatatttcctcattttatacagatcagattcccctcactgctactcatacccaaataatgcacctatcagcaaggaaacatctccagtttgaagatgatgcccctccctacaaggagagccaactaaatcacttggtaaaagaaaagaccaaaaaataaatatacattacaataaattagtaacttcatcctaagccataccttggtgcaggtcattcagaaaaccactgaacttttgtcttgagaccctatttcaccttaatcatttcacaaaatatactcttaatctatcaaaatatatattaaggtgtaacgatgagatgatgaacaagtactcttttatcaggctgtggtatttgctacactaacgtctggatggtaatgccaatgcctgttcttacaggacccactacaaacacacagttccccacgttagagtcccttttcaacacaggcacctattcgttttagggcacagaatcacaacaggttccatgcctcctggataaaatttcaaaaataatattgcggatacatgcattggtatctattttgaaagatagtttttaacccaattacatcaagtaacttcacaaacacactccccaacagagaaggatgaagtgccagcaaactttgaggcttagctaaatcggccatttccaatgcctgggaactgagctgcatcagcctcccgctaggagagagtcaggccgccacaaagccaggcagcaagagaagtgagacccgaactggaatctaaggggcttgcagggatagagcaagagatttgctgagggttccatcagcttaagtgaaagggataatcgactaaaagtaaggtaagccactgagcagctggaatcactgtaaaattaatgtgcttttacaggcactgctttccctgagggcagagcggtgtcacagaacaacttcccagtattgctgttctctctggaataacaggaaagaatgaaaaagagtaaaaaattaacctttcaatacagaatccacgtaagaccgttttagctgaaggactcaaaaaggcataacatcctcaaccagcagagagtaagtgcttgctcaaaatgtgtcctcctgcaaagatggaatgatctcttgcatgtacagatgccacaccagccgtagacactactgatctgtattttaaatttcacttcacaaaagtgatttgggatttcaaaagcaggaaaacaacctctcatactgtaacttgccgatcttgtatggatccccttccagtctttgcttacgtgtgtatatgcaattgttctcaagcatcagaatgtttaccattctataacctttatttaataaactgtattgcagggtaactttcatactgatacatagtgtgcccagacattaccttaatggttgtgcaatattatactcggtgcatttgctgtaattatattaagtatgcacattactggacattttgatttatgattgtgagaaatgttataatgaatcttcttttgctttttaaatagttggtaatgaatagtctgtgtagatttttagaagaaagagtactggtttaaaacacgctgaagttgtctgcattaaaacgctagtgtgctcttcagaaaagttcttccaaaatatcacgacactaacaatacgtggtggcacaagttgtagaatggcccttcctgaatagacactaaataatatataacagcccagctcgatccttccatcatcaccatttttactcctttatgtgactaatcaatgagcctcactctgataatgctggattaaaaaacctacagaacaaaaaaatacagtatcatcgtgaaagttcaattgataaaaaatattttatcacctccatattgtgaatgcctcagcagggtgtaagatctcatttctagaaccactgatatccactgctcatcttgaagacaaaattttcttccttatgcaaaaaaacagctccctgcccatggtgtattaagcatcctgatgctttccttcttggcctcttcaatctcattcacacatctggatgtatccattgtcgatcacatgtaggtgattgtacaattcacatgctctcctcttccaaaacgtcctcatatagtgagcagcacctctaaatgagtgcccgaccgcagcagggtagtgttctggtgcgagtccacagatcagcccttctttcttccattctccatagcaccaatcaatccctaacatctccagatttaaaaaaaatctaataatttttcaatctctttttgcaaaatctgcagttatgctttccttacgctaaaaatatacttcaaaatcctcagtgtgggattcagtatctgtcgatcctacccccaagcatctctcagatcgactgtcttttcccatctgtcaccgccctggttcagcccctcttcgtcgcctgcaccatgtccactgtggggtttatggtatcctcatcacaaccctgctcccactattgccaatttcaattgttttatctctacaaggccggctgcctccttgtctctgtactgagttcccatttctacttctcatcttcagcacaggctccatttaatactgtatcaacccccttctacggctcattatttttataatacagctcatttgtgagtctaacatatgctaatcatgcacagagggctgttgatatctctcacatatatatattaatcccctagcacaggcatcacacatgtccacattgaggctgaaaatgagtcagagcaatgggagaggtggtggagcacagcttggcctcctgcactcttttctccaccacaattctcgtatcacaccaagttgagatgctatcatcaacttctgaaagcccatgttacatcccccaaggatattaacaggaaataaaacttcactaccctgttatgtcaaccatgcctggtctgttcaagtaatagcatattttaaaatgttgcctctgcttatctgtgtttacagagtccagcctctgtacccacccaacttgtgaaataagcaagcttatcgaattttgcatctcaaggacgatgggaaatgggttaaaatacaaatttgttggtgactttgcaaacgaacagcacgatgctcttgaccatgagtgggaatgaatacctacatgggcaaccagagagtttatcaagggtggaataaggtccagagtcagtttacctctctacactacagtctgaaaaattataatatgatgatttaactgtggtgaaactcaacagaaatcttcactgagcaagaagtgttcagtagagaggaggcagcagaggcacgtttttagcaagaggacccccggatgcaagggtcttcggtgtaacagaggagagacacacctgaagaaattacagaggctcaaggaggctgggatgtaaacagtgatggtgggcatactacagagcaacgccagacatggatctgactttcagcctcagttacacactttggtctttattcgaacagtggcagaagtggagagggtggcaaagcaggaagatgtgttttacttagagaaacaagagcgtttcttcgaatgttcctcaatatctctgtgagttaggaggtgaagtcacttgagactgtgtgggatgtgtgtggtatgcagtcatgtatagttttttttatgtgtgtgtgtgtctgttgtgtatagttgatggtgtgtgtgaagtttgaagtgtatgtgtggggtggtgtatctggtgtgtatcgtttgtggtgcgtgtgcactgtgtgtagtgtgtgttctgtgcacagtctgtggtgtattcgtgcatgtgtgtgtgtgttatgtggaaagtctgatgatgggaaaaaaggtttagaaaaggatgtgatcttcagcgagggccaatgtgaaacacggcaaaaggccatttcagtacttcagagaccctgctgtgtttagcagagttggacgttgtcttcgatatatcttcctgtgctcttacaggaaatgctccttagaataatggagagaatttgttaagcctgctttggaaaactaaggattcttattccaagaacagtttataagaggctttacgcaaatatctgggtgcttttggagtttaattgcatttgcatgatttagagtaatttatctgagatgtgtaagactggctgtttgagcgtgatgactaaagattatttacaaaactaattcacagatgagttattatgctattgtttccttcatttatgaagcaatgacaccccatatcaaaggcatgtaatgattatattatagctataaacacatggtttaaaatactcagaaaatatcaaaggtccatttatttctccttttttaaagactctcaaatactccctgtaaccttctgacataatgttgaactaattcctaaaactaggtgagaaaatgcataacagcaaatgattattgatgtcattcttcacacctatattactttttattattttttatgttaggttatttttgtagtcacttgttctatctagtttaatcaatgtcagggtgtactttgcacacacaggccaattcaacaactttctgaagatgtgtggagattctgaaggttactttcaattcctagggtcagtttgatattaccgttaagtgcaagacccataattttaattaattcacaccaactaattattcagcttcttcagatacaatataattgcactgtctatttagcatgttattttataaaatgagatgagaagtttttttaggaaaaaaactaatcttttgttctgtagtcccttagagaagaccctcaaaagctttggaaatttgaaagaaattaaattcaaaatttttataattttaatattatgaaagacgagaaaaaataaatattaaatgcattttctctcatcaaatttctaaactaaaaggtaaatcctgtaacacagacaaagtataaatcataggctcacatcaagcagccaaactctcagttcatatgaaattccctaatagcactcccattttagtacaactcccttgggaaggggcatactgctactgaaattagaccgtatttgagcatatcaccttacacatttttttagattttactctagggattgtaacatacacaacacatacaaaataacctatcacagtctattgatattaacgttttactagatcaatgaagcatagaaacctcacctccatataggtcccttcgcccttacttcattttaaatatagctgtctgagtattttctctgcagacactgagcatcacttcagagggtcttacatgtgcttcaactatgaaatgtgatttaagaagctcattagaaacatgatagtcgattatagttacccctatttttacatagtgctttattttcacaccagactaaggagtttggaaaacacgctaaaaggtatgaaaagccttagaagacagagggtaatggaaagatgaagtatcaggaatgctaaggtctgcaattatcacctctcagagattcacttatctcccattcatccctgctcctagtaactgcttcacgtttctaacacccaggtattgcatcagaccataaagaaacaatggtaatctcctttccatctagtggaggattcaggaattagcaattaacttatcacacagaaaaatatgaagttagaactgttatcatggctgcttagagctgaaattcttatgggtgggtgtggaagggaaaaggcctccacactggaatgaatgggtatcttggtcaaagggttcacagacagtgtttctcacagcctacatgatgcccagtcatttaaacattttggtattcaacaaagataaattgtgcagaagtaggaaggatgaacagcatgcgttatcttttatctgctgtttattaatttgaaacttcttttcttccacattaaataaaatatctttggacacaataaaatctcaatacttgtatgacatttacatttttgaaagttttcatagctctcgatgatgttaaatcaacatggtatgttaggaaaaatgagtcagacacatttgaccgagactataaaatttaggggtggcaaaacaaagacacaacaaccatagaacctgcaagacacgcaagcattgtataccatggagagagtagctccagcatggagagggagactgtgtccatatacagccttaccaaaggaagaaattcacattagatctcacctttgcttatttcagcagcaagactatctcaaaagaaatgccttcttctcaaaagaaaacttacatgtggccaacaagcatatgaaaaaaagctcagtatcactaatcattagagaaatgcaaatcaaaacctcagtgagatactatctcctaccagtcggaatggctactgaaaagtacaaagataatagaaagtggcaaggatgtggagaaaagggaacacttatacaccactggtgggagtgtaaattagttcaactactgtggaaagcaatgtggcatatcttcaaagagctagaagctgaactgccactcaacccagcaataccgtgactggctgtaagcccagtggaatataaatcattccaccataaagacacatgcacgtgaatgttcattatagcaccgttcacaacagcaaaggcacggaatcaacctaaatgtccatcaatgacagattagataaagaaaatgtggcacatgtacaccatggaatactatgcagccataaaaaggaatgcgatcaagtcctttgcagcaacatggatggagctggaggccattattcttggcaaactaatgcaggaacagaaaaccaaatacatgtttcacttatgagtggaatctaagtctggacatcgtggctcacagctgtaatcccagcatttcagaaggccaagttgggcagatcacctgagatcaggagttcgagaccagcctgaccaatacggtgaaaccctgtctctactaaaaatataaaactgagccaggtgtggttgtgggcgcctgtagtcccagctacttgggaagcttagacaggagaattgcttgaacctgggaggcagaggctgcagtgagccgagattgtgccacagcactccagcctgggcaacaaagcaagactcagtctcaaaaaaaaaaaaaaaaaagtagaatctaaattatgagagttcatagaggggaacacatagaggggaacaacacacactagggcttagtggatggtggagagtgcgaaggagaggagcggaaaagatcactgttaggtactgggtataatacctgggtgatcaaataatacatgcaacgaacccccatgacacttatttacctgtgtaacaaaccttcacttgtatccctaaacctgaaacttagaaaacaaaataaaaattattcagcatataaaaaagaaatgcattgctatgaaattattatagtgtgttgaaatcattgtcatttctagctagtaaagaaatacgtagaatgtgtgtcaatttccaggagttaaaaaagttatcaataccccccttttaaaaatcaaaatatattatctttacacacgcttcctacgtgcatttagtcagaagacacaatgaacatacacactatctatatgcatgtgtagaatgcatagatagcgtaactgatcatattgcaatcctaatttattggcaaactttagcattgatgtatactcatataggtattttaacacacatgatcatacctacttttttaaaagcaatttaaactccaaaataagctaattacttttaatggaacaaatatatatatatatatacatacatatatatgcgtgtatatatatgcgcgtatatatatatgcgtatatatatacgtatatatatgcgcgtatatatatatatacacatatagaactctatgtttccagttttattatcaatgttacttattgagaatgatgaaattgaaagggctcacagtcgttctatttatgagcaacagatgtattaaagttgttggccaggcacagtgtctcacgcctgtaatcccaacactttgggaggccgaggtgagtggatcacctgaggtcaggagtttgagaccagcctggccaacctgacgaaaccccatttctactaacgaaaaaatgagccaggcgtggtggcagatacctgtaatcccagctactccggaggctgaagcaggataattgcttgaaccagggtggtggaggttgcagttagctgagatcgcgccaggcaaggcggtaagagtgaaaccccatctcaaaaacattaaaaaacaaaaagctttcatcacacgtggcaaaaacaataacactgattggcataaataatttggaagcccagaggaagagcccataatttgacctgcaaggtaagttttgcggggaaatgaagatggggaggtagaatttagagaatgattcacataaatttctatagaataaactacaaatgaatatagtcccatgatagccatagagctaatatagaaacacaacattcttatggtcccttattggtcccttagacagtgagcaagctggaactggtctttaatttctaatctactaaatgtacattttttaaacctagggaataataacaggaaaagcttaacaaccctgaaaaaacctagttggctaaattttcagtcactttcctctagtgccccaggaagagaatgcgaagaatctggttaatagctagctgagtccctagagagggaggaatccatcatgggggtagcagaccatcattgtcactatgcgtgacacacactctgcttttgagaatgcgtttagtgtgaagatgcctgacgggacccctgtgacatttaattctcctctgaaaatgttagcaatgcaggaacccgaagagctcccaaaggtcttacatgtcaaaatgaaaaaaaaaaaaaaaatcacgcgtaggtcacatcaggaggaaatacgtgttatgggagggaaagaagaatgttggaattaactgtcaatgtggactgtctgttttaaacatgcagatgccatttaaacatcaacacatgtaaattcactttagagagggaaaccaggagctctgaaagtttcagacatttactctaaggtcatatgacttaaaaaaagcagaactaggccgggcacagtggctcacacctgtaattccagcgttttgggaggccaaggcaggcggatcaaaaggtcaggagttcgagactagcctgaccaatatggtgaaacctcatctctactaaaaatacaaaaattagctaggcatggtggtgcacacctgtaatcccagctacttgggaggctgagtcaggagagtcacttgaacctgggaggcagaggttgcagcgagccgagactgcgcccctgcactccagcctgggcaacaaagtgagaatccgtctcaaaataataataataataataatgataataataataataattccagttaaacttgctttctttctgtgtcctggagatgggggattcaacactgataccaccatgtatccgacatgcagagactgtcaacacatccgaagtctaaaggcttaaaagcatctcattccttggttccctcattattttcaagactgcagtcacgttaatagttaagtcacaacacaatgccacatggaatacaacagcacaaactcttagttacaatcgacaaagtacataggattaaagaagaagaaaatacattcactagcccaacagccagtgcctccacctgccatagaacatttcctacatatttctgtcagggccagagttcacaggcaaactaacagaaataagtgttctatttcaggaagcagtatggggtgttttaaaatataagccaatttcaattgcatccgttccttgaatacctttctaagcagtctggactttgctaatgccttgggatttctcccgaaatactaaagatgattctaaactccagtccacaatcacttttacttatgctactggttgtattacattttcacacacacacacacacacacacaaaagcaatgtaatgtactattacattaccatttgtgagttaagtgttaggtcaaaatgcctttcaagtttttatgtgttcttacgtacacacatacatcctgttttctcatttacacatctgacccatgtcttctaatgatttatcctcagaaaagattcagcatttatgaataaagaccacaggaaaagggcaaaggattttgtaagaggagggagctgcgacaagctgggtgttagaaaacgcttcctgttggagtgaagaacataattgggctcctaaaaacacagagattataccacaggaaaagtggggttgacattctacatggtgggaggaggtttcaccttcccacatggctaatagtactgacagccccagcctgagaaaagaggtccctcttctaatcatgactgcgttggcttcccactgccccgaccatttgaatgggcatctcgagggagggaagaggacagggcttcttacaccatcgcaagagcaccactcattctctgccctcatccacacctaccggagacagatgacactttctgcccagcttccacacctaccagaggtggcactttctgctcaaaggaaagcccagctctggcttgaagaccagagtgaggtagggtttatgaaaactgagacagtatgcgaggagacccttttaccctaaggtccacagcgtcttctagctgctgttgctgcactgtgagccccaggtggcaggtaccagcctgcctcattcactaatatgtccccaagcaagggatgagtggcccatgttcagcaaatatttgtaaaataaatcagtgaatgcaaaaaaaatattccaaggcctgactcaagataaaggataaataaaaagtgaaccaataaagtagaaaattagatttctagaaattaactaaaaatcacacagtgcttaaggagaaccaatcttccatccagaactttgccagatattatgaataaagtaaacttggtttccaaagataaaatgattttattatagaatcaaggtttacatcagcataaatatgatgattataaaatagccattgaagtcatatttgtaggtatagattgagctgtgcaaaaaagaaactgaatgaaagcaactagctggtcatttcatttcaaaacatattttgcataaagtaattcaaactttttttctttattcttcagaagcgttttcaaaaatttgtttcatattatattctcagtcttcttagtaaaattttaaaaacaggttttataaagctaaagatgcactcaaatgtacaaaatgaaatataaccttctcttaactcctaaataaagaacgggaaattttgtgaatgtcatcttttattcttttttctttcctttaaatattcaggcattattgaaatttgaaaatatcccactgagaaatatatgaatccttgagtagaaaataaaatgggttattaaaagccaaccactcattattgttaaccctcttaaccattcaaaaaccttcaacaatccaaatactccctttcaattatgtagattagctaaatttcaagagagcaggaccccatattctaaaattttatgattttctaatggtcttccatttgtagtgatttttcatcctcgaatctgaatttgttgtgatctgtaagatatctcaaggaatgctgcagagaaaataatctgcatattttattccaagcggtttcttaggttatggtcttatactctgggctgccacagacctctgttaattcttggacttaccaagacaatttcttcatatattaggttgatgtgaaataactgtggttttcgccattactttcgatgctgaaaacctcaacgatttttgcaccaacctatacaaatagaactattattccataatagatttctggtaaaataattatatataattaataactttccactaatattccatcgagtcctaagacttggtgtagacatcagagacacccgtgacagaaggtgaacgacaatggggtacactgtgtcaagatgaaggactcaaatgcaaactaaggggggggcttcctttatgtgtttcaaaataatgggattttcagaacgatagttaaataagaaagtggtcgaacgcccccaaaacccttttcaaatccagaagtaaatctatattgtgcttccctcaaagtcagcactcggtaaacgcaaaataattggtagctgcttctattagtgatgttttgtggttatactccaaatcttggggtgggggaatcttcaaaggaatagaaaagccaggtactgaatgaaaatatgccacatgtcagattcatacgaaaactcaagagtaaatacaatcgactcttattgagcatgccaatacactgttggggcaaaaaactacacttgtaaacggcactgaaaacatacaagccctgtggaattaatcagctactagtgtttatcacaggcaagaggtttccaactggccaagcacatcatcatcatctaaggttgaataataatccccaaatcccttgtaaagttttacagtttataaagcagctcaatgggttatattttatttacataacaatctggtaaggtaggcagggaatttttcttttttttactatgtatgattttaaaagaaagctgaaagcactggtgtgatttgtataaatttcctgcttgctaacgtggggtgcagtgaaattagactcccacgtctgtgttataagctgtggctctttcattctaccctgctgtaaaactcaaatggttacaaaaccagttagtgtatctctgttgtcatataatgtaacagatgtctatacgctgccagtgtaaggcatgtacatgcacaatcactatgcctgctaaggtaagtgacttttcttggctgtttcttcattttccagagatagatttaaagtgtccaagttaagtgtcagtactcaagagagagagaggagagaggggagagagagagaaagagagagagagagagacaattttatttactgacaagcaggaagtttaaatcaatagttctttatagacttagaagtgaggtaacataaaagagaagcgatagctcagctgagtacatgtctgtaccatttaggttacttccacactgccccagaagttttcttttatatagtaaagtgcctgatacattgtaggcattcagtaattatttgtttaatgtatttttgaccaagttaaaccgaattttggcaggatgaaaatatgttctgtctttcagatgtgttggaaaggagaacaaaatgtcaagaatgatgtaatatgttgccgttccgaatttaaggtatttggtattttataatagttattgaataaatatttggatatacaattagaatccaggagtaattctattagcaatatataaaattgtgcgttcgttttttctcacgtaagtgtgacatttagtttagcctgtctgtaaagctgtacccattccaaaattttatgcaactacattgttatttatgaaataatatgaacattctaatattgttactatccttctatgggtttacatgtgaatgataattattacaactattagaacttttttgtcactgtagaaagaaatgacacttggtaacatttttccttaattaaagtttttactttctaatctttgcagacaaaatctaaaatctttaccattaggtcatccatccctcctctctctttttatgcacacatgtgcacactctcgtacacatctctatttgcgcattttagtttctgtgtgtgtgagaaagagtaatattgtgaaaattacattgagttaaaaggtcattagcaagtaatgaaacaaagcttgcattcaggacctactcaactggcgagaaaacttgagtaagtactgattaataaagttacgttaacaagagcttttacactaaaaagaataaaaaacatgttgattgaaatgtttacccttattgaattagtaattaaaagtgacacaccttctaaatttaagacgtcactgattgtttttgatatcactgatttttaactcaaaggcttaatattattttaaaatctcaaaaaaaaaaaaaagccactctctgtactggttgtacagatcaaccaatagataccatatattggcattgtatttacaagcaagttaattttaaactatttgaaagctaacatcctcccataaatcataaagcatcttacaagatagataacatcagagatctgtcctaaatgaacgtactttctgaaactttagtcagaagtgggtttttaattttactctctttattaaaaacaaaatgaaagcacaataatgacaatctatcatcttcatattaaacagcttgaggccttaagtctaacaaagcggcttgaaggtacaaactccttgtttgaccaaataaacatcttttacttcattagtagtcctcacatatacatgcacatagtaacaaagtaaggaggattttaaaagcagattaaatcaaaattgggaaaatacctgaaaatttaaactgttagtcaatttcccccagtaattccaattacagattttgatgaaaagtgaccctaaatcctgacagtcatttttcccttttgctttccttcaatttatcttagtaatgtcctttccttgcttttaaacagtttcttctaaatgaattaaaaagtcttagcatattatgattttcctcctttccttttgctgaatgtttctttgaaatactgagcctctggggcccataatcgatacgtgagccctaaccaatatacctacacttctttccaaaatccaaataatagctactccttcttaaggctttgctaggatagcagggaccagatttactctcagagcagaaaataaacaaacaaacaaacaaagtcacagaaataaaggaaacattaattgttggctgttgaataacaggaaatacagagtggtgattcctgagagaagaaaacaaaagggtgaattacttacccagttcactgcctggaaagagaggccagggaacagagaagggaagcaatccaagcagaatttggcagttcttggattagaggaaaaagaactgagacttgccggggggccaaaggctgctagagttgccgggcaaaataccagagagagaagagagcttcacaagagatgtgtagaggaccctcggggtcttcagctgagagctcacctgtatattatgcaggtaacagaggtacccaaggctgagctcaggctacagaaagatccaccggaaagcagtagggagtcatcttcagagcttgcacaaggccaatgtttggatttttacaggcagagtggaaaaatatcataaaataggagtattgggttaagtactcaaagtaccacctcaacaatgaaaaaaatgagtagtaaacaaaagacttcgttggttttacccaacaaacattacatgttcaaaaaaatccaaccctttgcaagtaatttaactgtgtaacagaacaaagcacaaaactttatttagagaaatgcaaaaatatccagcacttaacaaggtaaaatgtgtgatatctcgcatctaagcaaaaattaccaggcatgaaaagaaacaggaaaataagacccacaacaagtaggaaaataaaatgaatacaagagtgttcaccttataataccttcaggctatttgttttccttccacaagtcatcacacaaataaaccttttttattattattatactttaagttgtgagggtacatgtgtagaatgtgcaggtttgtgacataggtagacacgtgccatgatggttttctgcacctatcaacctgcgatctacattagatatttttcctaatgctattcctcccctagacccccaccccccaacaggccccagtgggtgatgttcccctccctgtgtccatgtgttctctttgttcaactcccacttatgagtgagaacatgcggtgtttggctttctgttcttgtgttactttgctgagaatgatggtttacagcttcatcgatgtcctgcaaaggacatgaactcatccttttttatggctgcatagtattccatggtgtgtatgtgccacattttatttacccagtctatcattgacgggcatttggattggtgattcctcaaggatctagaactagacctaccatttgacccaacaatcccattactataacccaaaggattataaatcattctactataaagacacaaacacacttatgtttgttttgtttttcacttatagtatcttcttctttgtatcctctcctcccagtgtgaggtcctagccactctgccaggtccagtttcagcattgcctccttataccagtttctctgtaaattatttatttcccatacacattcatattttcacattttgttttacacacagatctcttatgaagtcttgtcatacgcttatattgagtttttgtctagactctagtctaaatcaatcaaaggcaggaagagtgtcaaacctattttttatcctgtcacctcgcacagtgatcaaagtgtagggttcaacatgtgtgtccagtgcatgaacacgttcatgaggcgtgcctacagctagtccctgtggcccactgatcatcctcggtgtgttggtatgttcagagctgacccagtctcttgcctattgtttcctcctgaaatggccatacgtcttctctcctctcccgcgctggcagttaaagcataagaacggagcaatcagaagagtttttttcatcccaaacctgctgctcccacttattgacttgtgaccttgggaatcttaccttatcactctcttaattcctcagtgatgcaagttagacaaacaaacccacagcagagggatgtgttaaggattaaagggatgagtatctggtatatcacagatataacagacaataaatggtgtgagtatctggtatataacaggcaccaaataccttttcctcccctttctgctctacctctgcaaagtttaatagtggtaaagataaaagagctgttcaacattcctaagatagtgataggaatcaatgtctttgttgattaaagtttccaaattattactatacgattaagagtactttcaaaaaggatgctttgaaaatttacaattttttttctaaatttacaaagtactaaatatcttttttggtagtgtagttacactacttgacacgtaattcattcagaagaaatgaataaataatatatcatcattgtgatttattagacttttgccttttattacagtatatttttatttctgcattttttcacattatcactatgaaattaccagggtcatagacattgttaattatcttcaagaagaaaatcaaaaaagctattccattaatttagttcatattttaaatgcctaattcacagatacttttcatcatagactgaaatgaactctttaattacataaatacttaatataaaatattggatcattttatcctccgatttctttacatttgaaataacattgctaaaagtttcctattttaacaatttcctttcactctatggttccatatagataattcacatgtaattttatttgaaaacatactgtatttaaaatagtttaaacataagtgagacctgaattcaatttcatgttatctgcatatttgaagagagtacttttttttgcaacaatctgagcactggagagagtttaaagtggaattagaattcccccagttggcaaaagcatctcacctattagcaaggtgactacatatggcagaatattctatcataagagtaggaaaaacccatagctcttagggattaaaagagtgaaagctgtatgcagttgtgggttcagggaaggctgtataaaaacataacatttgaggtaggccctgaagagagtaagtaagattttgatgaaggaaaatttcaacataaaagacatgttgtagaagcagaaaaatgctggacatatttgagaaaaatctaagaataatcactgtctacagaatattgcttattttcaaagagatggtgacaaggttgaaaatgcagtaggggccaggcacggggctcgtgcctgtaataccagcactttggaaggcagaggtaggcggatcacttgacttcaggagtacaagaccagcctggccaacatggtgaaaccccaactctcctacaaacacacaaaaattagccaggcttttgtagtcccagctactcaggaggctgaggcaggagaatcgcttgaaccctggaggtggaggttgcagtgagcctagatcgtgcccctgcaacccagcctgggtgacagagcgagactccgtctcaaaaaactacactaaaatataaaataaaataaaatgcagcaggaatctgagaatagaaagattttgaccagcctacaaatagagagttaagcagcgaaggaatggaaaaatcatatgattttaatgagacattaattggtggttccaaagttgtttcctcatttgtacaatgacaagctttggttatacaattctaatttccagttctaaactcctatgcagacccatgtgattgtaagagaagttaggcattatgtataagcaattttgcttaaacggaagttctgtagcaggttcaacagacttatttcacacagtcttactctatatagtacttcaacccctaaaattcatgaaaagtgagaaatataaacttatgttctttcctgtacagcatggccttcctaatttcacagccttgttccatgtcttcttcacaggtcaccccatttgattcaaagtaaccattcacaacaaaccatacataatgggactagggctttctctgaaacctgttatcagaaatgttgcctggcataaggatcctgaccagtgtgggtgatctatattgggtcatatatctgctttccaaggtgtttgagtggctgatacccaaagtcaacagtgcgacagaaaccagaagacataaggagaaaaaacaaataaggggcagtggactctacaaacaagaattatataggaaatgtataaaatagaaggaagccgagagggtatgatttgggtatttcacatccgctcactcaaatatcccccccttcccctggccagacctgcctatcttgacttattgaaccataaaggatgggcagctcctaataacctcctccaggtgccttgtactgagagtttagcttaaggcaacttctatgaagaaactccacattttgagtcttggagttctgagcctgggggtggcaggtgtcccagcaacaggcattcagactactgggctgtcagtgcagcctgctgcctcaaggacttcactgtgatcctgggaatggcaggcacagccacacccttagcaggccagttcctctgtgtagttcaaatttacccgaggccaagcttagattttacaccttttaccttcccaatgacatcacctaaaaatctcctgccttaactgctgctgtgcaattatcaatgctgacaaacagtggaaatagtataaaaaatatagaacaaagtaaactgtgtcatcggaatgtatgatgcatctgcagagatttccctacaccaagaatgtgagttctgagaccttttcctcttcctcatcactaactgcgtattccattaactaaacagcaacctcgaaagaaatcaatactcggaaggtcctgtagtagcagccattccatggatgggacaccagaggtggggcaggagcaaggaggggttcctcaccctggcaggaaagctagaagcctagcctttgtcagtgaacacagcaaaccaagcttcttttctgaaatcttcttggaagcagatgaagtgcacacaaaagagggttcttctccacccccaggaggtgcattctggtggccaatgccagggaataatttcaaaggactgataaacctactaggaacaagacaggtcagtggccatttatgacctcccatacagaagaaaacaaacaaacactgctcctggaagatccagctcagaggatataagggcaaaatccaatttgccctgttttccataaggtgttgttatatatggatgaagggtttcagtttattttgtttcagccccataaacaaacatcgaaagtgtgtttacctagcgcctgcttcccatgtcttgctagagaacataagcaagacaaagaagaggagggactcccatcccagcacacctcagggtcctggatcctcaaggcactctgagtcctgagttgattctaggtatggggcctcttcacgggaaggaggcaattgtatttggaaaggatatcattatatcactgttgacacatcattgcattcctggtgtggtcactcattgagtgagtgctgcactgtggctccttaaaatggcttgtagttacgcatccagtggagccaggagggaaaaatcagacatcagtaacccacttgatgatactgcacattgtatgcaatcatgaatgctgacaagacacaggggaaagaggagaaaaataaatataacaaaggaaactgtcatgaaaacagatgatacatttccagggattcccctgaaccaggaatgtgcgactttcaagaccttcttctgttcctccccactaaccaagtattccattaattaaatggcaacctagcaagaaaccagtagttggaggtggagggttctcttgtctaggaagtcttagataatcccaagagacagacctccaaatcccactgtgatctgccttagaaggaactctacagaagccaggcaatacatggtatttacttcatgtaagaatcgtctactttcaagcgcttcctgtggctgaagtttgtctgctcatttttgcatactcactttgcatgaatatccatggcaaccaaaagcatgcctaccttgttagcttttccggtgaggtaagaattattatagtaggcagggcaacatgaaagcatctgaagattttttcccaaactacccaaattacacaacaaccatcatgctcatctctagggccagaaagcgagatgcaggataaaactcagtgattatagatggaatccaacactgagaaggcgtgaatgttattcctgttgcacccctctccacttcccattttaaatgctggcccatttaaaatgctgatgaccctgagaacgactgtagattaacaaaagcttattccacctgatggctggaattgagagttccgttctgtatatgcacatggtcagaatataatagagcagatttacatgctggctggggcacctttttctgttcacggtcatatcagtctacagtagcacaatttccttcacctggggtacgaactcagtaaagacgttggctcgctatttttaaagcaatatttgttgacctaacacgggattctccaacactagcattcatcagcattaccagaacggagtggtaaatcagagctcagggccctaccgtcagcgtttctgaaatattcagtttagagttgtgccagagaatttggctttctaacaagctccctggggatgccaatgctgccgatttgggaacactgctttgaaaaccattggtctaagatgaccaaagactgcagatcatcttcacatacggtgggagactcagacatagcaaggacagcggataagtcctttgaaaatacagggcttgcgatttcagacatggggcaacctgacgacgatcaccaatgtggcgagaggcactcagattttcagcgcagataaaaagatgggaaaaccaattaggcagctactgagcaagaggtaaagaatgcatatatgcttgacataaggaagtatcaagaggagataggaaaaaaggtccataaacgagaggtagtgcataatgagtaatcaaaggtgggcataaaggaaagtgaacgttagaagcaattccaaacttctttttctctcctacggagaaaacagtaagaaacctcagaacatataggataaaagcatctacccaacgtttcctcaaagaccaaaggaaaaggtctggactcaagaacatgaaacattccgtttgggtaacaccaaatggggacttgatggaatagtaatgcccatcttcagaagaagatgaggtacgcagaaatggaattcagctaagaaatcaccaagaaaactttggctttgagattcttctgaaaaaaaaaggtcacaggtgaagctttgggaaagatttaacttggactattttacatagaccatgtataggaggaaaagtaagttaggagccataatctcaaggaatgtctactttggaagtgcaggtgaaaaaataggttaatgaaggaacctgagaaggaaaacgaaagaattgggagaaccagaccacagaaggtcagtggtatggattccaactcagaagacgacttcaaataagagatgaggttgtagcatattcttgaacaggagaggggaatccagctgtaatatctgttatcattgacaaggtctactagacaacaaatgttagatacattattgtatatataatgcagaaataacacattacatatctttaaaaatgatatagcttagttttcattagtgtttaatacaaacgtccattttacagtcaattgctctttaagtatctcttttacatttttctcttccttcttttcaagagcaattttaagagagaatcagaataggcagagagttaaaagaaaggttaatgaaaatggggagactctgctaatgtatttccttgggcaaattgcagaacactggcacaatcagtcggattgtttgcagcctccaggttgctgcctgtaggtaactggggatgagccattctctgtgctgagtgcctttcttgcagtgtgatgtgtcaggctgttccagctccaatgttggctttcctgtggggcgctcatcactgtcactcatactacaaagatgttaccaagtcagaaaggggaaaaagcccccaaaaacaacaacaacaaaaaacaacaaaaagctccacgatgcatgtttctagaatgtattttgtttacacataggtattagaagtttaaaatgaataacaagagacctactgtccgaaaacattgttacatacattatttttatttaatcataaaaccaaatgtaacttttcttgctaaaatgtctcctgtaagtataaagtaaggtacatttttgtttgaaagatgacacattttgtaaaacaaaaaactttaaaatctttccttttgcttccaggtccctaattttccttgctcaccacataattggcacattttccactgtgatctagaagttgaatgaaattcttgttttaacatttaccagtaaactttattcatttgggaaatgataagaggtacttagcgtcagttattggtgatccaagtactaagctctgcactccataatttacatgatatgtaacagaaactatgcaaacaagtcactatgtccatttatgaatgaagaaatactcaaagatgttaaatgcctcattcgaggtcacattataagacagtaagtaagcttgtatttgacccaaattctacacacccaattacattgcactcaatacaatttttttttttttttttttttttgagaggaattctcttcttaactgtgaattaccacttccccacgactcagttaagtcaactgtgcggtctgagacttctctctttcttagtgcacataagctatggaggcatgatttctttttattacttctggtttctacttttgagtagttttaatttcttaatttatacaaatttcggttgtcacacataaggtaacagttaacaggggacttacaaaaattagaaatactcctcctgcttttttggtaataaagcatctcctgtactctataaatatacacactatgtacccacaacaatttaaaaaaatgaaaaaaaattaaaaatgaagtcattttgttttgaaatatttaccatgcttacttaccaagaataacatcactttttctctttgaaaggcatgtctacatattcaacctactaggaagtgctttattagctatactatggctatttctttactgttcttgttttatcaaaaaagttacatcgtttaagttagcaatctgacaaagtattctctttgaaataaacttccaaaaataacactgtggttttagaagcttaagcaattcttgctagaataattataactgaaactcataaaatgtcctcataacattcatttgtatatattggtagtgtgttgtttgcattcgctgtttttgcaatgcatttgcaagtttagcagagtatcactcttctgtgatatttatttttgtgtttactattcctcttgggcttccaacatcaatcttcctttgtaagtcaagccctggagaataatcacataataaataaaaattgcacaacaaataaatccaagccttgtattgcgtctacagactgtatggcttccaaacgtgtgttatctgtcttgaatgcacggttctcatcaagcccataatggagaataacaagtatagagatgtttccaatacaaattatttggaccttatcagtgttgacatatgcacagaatacaaacaaagacctattactaaaatgcttgaacaaaaaaatactcatttattttttgagatggagtcttgctatctcacccaggctggagtgcagtgatgcattctcagctcactttaacctctgtctcccaggtacaagtgattctcccaccgcagcctcccgggtagctgggactacaggcaggcgtcagcacactggctaatttttgtattttcaggatagacggcatttcaccacgttggccaggccagtctcaaactcctgacctcaagtgatttgtcttccttggcctcccaaattgcttggattaaaggtgtgagccaccgcacgttgccaaaaaatacttatttttctttatttactacttacatgtatgcccaaacctcagtgatatcgtttggatctgtatccccacccaaatctcatgttgagatgtgatacccagtgttggagatgaggtccggtgggaggtatctggactatgggagcagattcctcaagaatggcttgggccatccccttggtgatgagtgagcttttgctccaagttctcatgagatgtggtcaattaaaaaagtgtgtggcaccaccctgcttacacacacacacacacacacacacagacacacacactctttctctcttgttcctgctctggccatgtgaggtgtctgctccccttttgctttctgccatgactggaagctccctgaggtctccccaaaagccaagcagatgccagcaccatgcttcctgtacagcatgcagaactgtgagccaattaaacctcttttcttcataaattatgcagtctcatatatttctttagagcaatgcaagaacagtccaatatagtcagcatttgactacatttaagacttcacaatgagtagtatcccaacaaatatacaacaggaacagaggttcctgttatgaaatccacaatttctccataacacccgtcagatccacctgtcagatccacccgtcagatccagtaggactctgtctggttgtactcttctacaaagtaacactatattgtcaatttaatattttgggctgggcgtgctggctcacacctgtaatcccagtgctttaggaggactagtcaggcagatcacttgaggtcaggagttcagaccagcctgaccaacatgaagaaatcccacaccaaatatacaaaaatgaaccatgcatgttggcaggtgcctgtaaacccagctacttaggaggctgagacaggaggatcacttgaaccgaggaggcagaggttacagtaagccaagatcacaccacagcacttcagcctgggcaacagagtgaaaccctgtctcaaaaaaaaaaaaagtattttgtaatagctcataaatctaatcatattttatttgttttcacaacctcttatgcctttaagttttacactcctaggtgtttgctcaattttctgtaggttgaggataccccaatcaagttcgtgacttatctgcattcctgtctttcctgcggcatctcctccctacttatcatttctttccctatctatcttctgaagcactgttcattcttgcacatgcagctcatatcccaccttcccagattctacagctcagcaggaatgtcagtttctctcagaaagcttcattatgtatgcccagcaccctacattggattcacttttccccatgttcatttttataactaaatgcaagaccccccgacatatacagccgcctttgtgttactgtgccgtaagttcttagtgcattatcttacacatactgcagattcaataactatttcttcataatttttgtttcttattctccaatatgcaactacatataatagcaaaatgaaaatatatttcccgaaactaaactaccgaactatcctccccaaattatttgcctgataagaataaaccagaaaatcttcctcaaatagttgacaagattactgcctcccaggtgagtccctgtgggaacctctttcagagagaagccagggaactcggtgacacaaggtgctgaatggcagaagcatcatgctgcacggtgggtgcaaacgcagttttgagactaattttaccccgcccctcaaagcttcctgtcacgtgtgtttgttgcgaggtgtctacagtttttcatggttagttgtctttcagtgatttaaaaatacatcctggtttctggtaacgagagccttgccagccttcttttgggttttgggttttgtaattcaaacatgtttcagtgttgttgtatcccattctcatttgtgtaagcctggcagtatgaattaaatccacagctgggagactgcagacaatggggcaacatttatagtggcaactgtggctttcttctgtcatgaaagcctcagtcataatcaataaagctaaaaggtagccatcccagaggccccagttaggtcatttcaatgttccttgttttcctaaaggcttcacaatgacctttctaaatattaaccagcttcggtccatgtgccaagtcttcccaggagaggtttttgtatttgactcacagtatttttcctccaagcaaataattattactgtttcctcatagcacaatccatttgcttaaaaaaatacataatacatagctagagagtttaactatggaaaagcccacatcgtaatgatttttttacagtctccatgaccatggcattggaattcattttcatttttatgcaaagcacatctgaaatgaaaatgctgagtaatttactcaaacccacaaacaatgatggatgcttgtggtttttattttttatcttatcagtttggctccactgaatcatctatttttaattttgccaagaaaccacgcataattctaccccaaagttgtgatgaaaatgtcaagttgcttaggtcatggagcaaacacaactgtggacagaaataatgaggtttgtgagcaaacaggtgcggatccctcacgaagctaacgctagccattgccaccacatcttaatgccaaggagccaaagggctgtgctccaagcctctcttggagatgctctttcagtcctttctcatatgaggatcaccaaaacgctgaaaaaggaagacagcattgcactcaaattaacgattcctaccatgcggcaggaggatagtataaattctttctaggcacctgtgagtaagcactgagtaggtaaaaacagtgtgtactgtctctccaactgagcacctcacagataggagctcttcttctggtttttgctttttttccccagtaatacccttctgtcatgatatcacatacacacacacacacacacacacacacacacacacacacacacacacacacacacagagtcatatgcagagacattcagatacacagacatgcagctctcattactaccgttttgctagctggcacccctgggggaatattaaattacatgaaaaagtattaagtactttttcagtgtgagttaccattcttagacacatatgtaatggcatgtgatgaatgttcaaattcaaaatagttatgtgtggagacaggagaagttttcagggaaactttatttagctgatgaaatgttttttcccaatcatctacacaaaggaatgtttttgagaaaaacaacacaatgacttgaaaagggtactttactatcacatttttttcttataaaaatctaaaaaaaaaaaaactaagatttctgccttcagttttgaggtaaacgtcatatgaaagagcctagcaacaatgtatttctcatcccacacacagcaaccattttaaatgtcaagagcgtttcatagaaatactacttttttcaggatggaattgtgtttgaaaatttgaaaatagcaggtgaaatccagcaacacctgattgaacataagaattcctcaaaaaatccttcgcaagttgggatatcatgccactcacagttctgaacaaaacagaagtcacaccctgcctagtgaccctggacacaattctattaaagccaatcctgacgctaagtcctcacctgaaagaagcgtctcagatgctgttgaacatctagatccgagagagatgatacagaaagggcgagcgcagggttactagcacaggctccagggacggctgacaggggttgaatttctgtctcctcaactacctgttgcctatgcttgaaaaagttgtcttctctgagcctcagtttccttatcttggaaattatattagtatgattatgtgtacagcactactctcatttcataaagtgcttaaacagtgaaatcatcaggatatgcacaccatgacatgcaatatgcgttagttattattactcttgctgttgttactgatgcagatatatttaaggagagtgatctaaatctagacacactgagaacacatcattttataagtgcttttctacgataccatttaatgagaaagagttgtagaaaggactgcttacaatgacagattccaagatctagtccgctgcctgccacgggtaggtagccttgacctgggtctgcccctggaaacacattgcttgtgtgcaaatattctctatgcttctcattagctttatggtgtttcatctttaacatggggattctaatacaatttttcccctttatttctttttgttttgttttgagaaaagttctcactctgtcatccagactggagggcagtgacaccatcacggctcactgcagtcttaatgttctgcctcaagccatcctcccgcctcagactcctgagtacctgggaccacaggcacccaccacaacatcgtttcattaattatgatgatgatgatgatgatgatgattacagacagggttttactgtgttaaccaagctggtctcaaactcccgaactcaagatatcctctggcctcagcttcccaaagtgctgggattacaggtgtgagccaccatgcctggcccttaaaattctgtttgtatcatccaataacttaatgtgtatgataaggtgcttaaaagtatgccttacacgtgtttggtcaaacactattccaggtattcctgggaaggtatttgtggatgtgaatgacatttacacttaataaagcaggtgaccctcccttaggtggtgggcttcattcaatctgaggggaactttaagagcaaatactgaggttttccaaagagattctttctcaagactgcaacatcaaactcctgagtgttcatcctgccttatcgatttttgacttaccagtccctataaatgcatgagctaattccttaaaataaaactctccagatagtatgaaagattgatggatgacagagagacatctctatttttatttctctatctgtatttcctctggagaatgctgactaatacatagctttataccttctatggttagagaagctgtaaatcctcaaagcctatactgcccaattcttaccatgaaaaataatttttatttgcatagatacttgaacgatacgctcgactctactgtgtagttgaatgtaggcattttagtctgtttgggctgctatgacaaaatgccatatattcggaggtttttaaagaaaagacatttatttctcattgatctggaggctgggaagtccaagatcaaggtgatagatcaggtgtcagtgaggacccactttctacccccacagatgctgtatttttgctacatcctcacatgacagtaaaaccagtgtcctccaggcttgtctttaagctccgttgcctaagtgatcttgttttagcctccttagtagctgggaccacagatgcacaccaccatatctgactaatttttgtactttgtgtagagacagagccacacaatgttgcccagattgatcttcaacttctggactcaagtgattcaccctcctcacagcctcccaaggtgctgggattacaggtgtgagccaccatggctggcctgggctctcttttctatggatactgatcccatttgtgaacacttcacccttatgacctaaccacctcccaaatgccctatgtcctactaccataaccgggagggtgaggatttcaacctcggacttttgtggggaaaggcacaaacattcaatctataggaatctggatatacacatcttctgaatacattaacattgcaccatctctttctgaaacacaccagaaactcgttactagaatcatttatttaaatcagggaatttatatggactccagaatacaaatgtcctgaacaaacgaagtcatcacctgccatgtaagaacatcagcaccaacatctaaattagcttaaaacctgtcactatcagtcttagctaacttttccttaaaactactctatgattatcattgattcatgtatttattcaaatatttaataaaatgaaaagttgctgggagcatgaagtatattgtgcaaaattgttacagaatatagtgtttctcaaaaataacaaatagtgtaccttaatagggctcacggcaacaagatagagtcatcaatacctgaagaggaacataccacgttacctgtgatcccatggaagatacaacattactcagcccaggggttgattggggtatctaagctggggagaacagggggacgagaaagtggagaacctccagggcttcctgcaatatgatcaaaaatagtgagggagccccatattggaggataagcacagggaggctctcacagatacatgagactatagggtcagccccgctcactgtcaagttaagatttggtacacttacttctagatttccaaacttcctccctgtcttcaataatgattaagttccacaagacaatccactaattgatgagaaatagtgtaagtatttttcctgttctgtataaacttctcactttaagctctaccctgaataatcatactcctggtttgcggtcagcgctggttgactcagggaatgcaggtagtatgaatgcacctgtaggttcaagaccctttaaaggtcttgctcgtccaaaaatagacagtattttatgtcagaagctttacttttaatgccacgtagcctctgtagaaaggcacatttttagttaggaagcagggagcaactgggtcattaacaggcaactgtgcctgactaggcgtgacccatggccactcctgatggaatgaccctaaggcccccggtcagttaatgtcagcatctgtgctatgtgtagatgtttgagccttcagacacggaaacacagatacaactacatggtgcctggccaataacgtgttcgatgaatgtcatgctgcttgttttctagatggtttccagtggcctggtgaagcatgaatttattttacacacacaaagtgcatttgttgtgttgcacaaatgagcacatgagcatgcttcacttcacagctttcacatctgtgacatagtccttcgaagacaaagtagagatgaggctgtgtattctttctaggatccaattactctgagttacttggtgactggatccacaatgggcaaagctgggcccagagggagatgccgcctggatgaaaggcaggctctcagtaactagagatggaatgaagatggggttgagatttatttccaataatcaattctgttaaaaacatacgggaatgggattgcctaatttccataataaataataacaatacagaaattctgtaggctacaatgttgaaatggagcaaaccctcaggatttgccgtgttttcttcccagaatggctgactggcctgcttactaaatctgcaattataaactgaattttgcccacacattgcattctgcatctgtttcactgtcccagagggttgccaacgttgcggccacgtacaggagaccgaagcatttaagtgggatcttctgcccccaccttcattactactctatctatacctctgtttgcaacagtgttatctcaaaaggggagactttcaatctttacccaggaggcaaaaactccactgcctgataaaacatagcatcatggcaactaaatgcttaatttctgcttgacatttttctctgccatgaagatcaaaatttctcccagttaccccagcaaccgacattgttgcaaacttccacctaagtcatttctgcccttcttcagtaaacaggtattttgtttcagactgcttttctatcttagccttctctgttaaatctaaatgtctttgcaaaccacactgtgatgggatctctgctttgctttttcttatattctaaggataattaatactcagatcgtaacattatttttaaaaataaactcagcgatgaagtacatgtgaggcatatcaattcttcaaactcaaaattctgtggacagtaaatattttagacaagtgtcatgctgaactattccgttgacttacagcagattattctcacagacaattttttctttaagcatgccaacttttaaaagagtacactcaagtatttgccattgacatagaatggattagtagtacagcctttacattgggctggagttattttaatcacacagctctgataaatttttaatcagtagaataaatcaggtaattataaaacttcttgttccttcgtaaagactttaagagtaaaaataggcattttcttcagcttaagacaaaatgaccccatcactgaacaaatcgtttatcatttaatgatatcgcatttctcaacctttttaaatatcagttttgtcaactgtaaaatgtctgtattcccaaatagaggtgttctgagtggaaatgcaaagatttattccaagaatctgcttcaataaagccccatcatactctttttaatacatgcacttttatgtgtaactttggtgtacaattaatttgagaattactatgatttttattccaaagcatggtagtagagaattacaaaaatattggtactaatgcaagagttagattagagatgcatgtcatagttcttgcatatttctaatattaagttagaatagttgcaatattccatagttgagtaagtgcaagagttcaatgcagtagttgaatatagttagttacacatttacctcgtatgtgatctgttccagggctctcttaaggaaacatacaaaaatatcttatgtttgcaaattacgtaaaagtacatactagtgtggatgaatcaagacctcatcagagccatgcaaacaagaaacctggacgtttacacctggttaggttcatggcaaatctacctcgggatattgtactttgtaccttcaaagttcttcggctttttctagtttactctattttcaaaactaatttctgggtttgataacacctctgacatactcataatagaaacacagcaattaaatctttaaattaggtccataaatttagctgtcataaaatgtgctcacgggtgagtcagaaatagaagccacaattccatagttccggttctacaagtatttttttaactcagatttttttcgcctaattcataagcgaatattaaattctccttgaacccaaatgaatcatattgatattagtttaatgttgcaattactcttgtgttgccttaatattcagctttatattactttttgaaagaagaaattatggaaggtttagaagagaaccttttactagaactgacaacagaggcatgataaataaagttaaagtaagggtaagcgtatctgaacataggtctgggcatacagtcaatgatcagaaaatgctttgagattctgtgaaaagcaaggcttttctgtgaggctcaattgctgtagagcctcaaatctaccgggaactattgcttgggtagtagaggcatggattctgagtctagacaaaagagctcatctctgaggcagaaatatattccaactacaaatgctatcagctatgaaaataaattcttgagccaggctttatctccttcaaaggagatctgcaagtataccccaggcaataagccataggaaataatctagttatggtcttggccagagacaaaagtaggaagttgataactacttcaaaccctttcagttcttaccattttgtgatttaaattcacaagctatgctggcagattcatcagctggtcaaataatgaatctattttttatcttgtcatgccctgtgctaatctcagtccaggctctctttcatgtaaatgagaggctggtgtttgaatcagctgtacaaagctaccgcgaaatgagatactggagctgagtgacaaagagtttaaatttataagacttcaatttcagtcctacatttctaaagactactgaatctttcataaataactttcggttgtttatttcatcgtgcaaagaacaggtgggaaatcgctcaatgattacctgcccacataggaaaacattcatcagatgattcaatatgttatgtttggatggccaaacagtttccaggtttgagtgagtgagaagaaaatgaaagaggacggtatacgaagtagaaaaagctgagtgcaggggcttacaccaaaaatcctaatgctttgggagaatgaggtgggagaaccacttgaggccaggagtttaagatcagcctgggcaacaaagtaagacctcatctctacaaaaacttaaaaaaattattctggcatggtggcacgcaccagtagtcctggctcctaaggggcctgaggcaagaggatcacttgagttcataagttggaggttcagtgagcggtgatagcaacactgcagtccagcctggacaacagaaccaggcacttctagcgaaaattatgttgagcagcataccgtatgttttaggactgactctggtaacgtaagtattagagaaattagagttaaccttagaagttttgttaatctctcctctttcagggctctcatttaacatgttctattttcttgataccttttttttctgatccaaaaaactaatgacaccttcgccaagaagagcttgctatgccttctccccttttcctctcactgaagcctggaagatttgtcctttttccttgagactagtcatctgtgtttgcaaggcatctccatccaaacccttacattggctgggatgaggtttgaggggctgctacaccctagttaaaaatgtagaaaataacactcttgacatgagtttgctttaccattggccaaataaactcctcaattaagctgcgcattccttgaaggaattatgggtctgtctaggggtgatgaactcctcatggtcgagtccccaatgtcatggttagactttattatatgtcagatgaatcaaagcaggattgtccaagggcaattcagggacaaaacccaccctgctgatttcttcacagtactcttgcttggctgcgcctcctctgccaatgagccaagtggagcttggtcgtgaattatattaacctagagagtaggctggagtttattagaagtacattttaaacaaaatatcagcacgtggaacaaactgaaaatttattttcagcaaactctgcaaaactgtcaagcaaactcataatggttgcttctagagagttaactatgctgcttacccacttctagaatctcaattatttggttgctaattacactgtactatttttgatattaactattaatgaatattacctacaatttaaagtgggaactcaagcggagagatttctaggcctgagagaatgtagtctgtactctgcgggtttatttcaagctgatggatttaaaaattatcacagtcatcctattttttcagaaaattacatattcaactttagaatctatactctaaatcaacgtaaaaggtaaaacttgggaaagaatagtgagagaatagagatatctcatttccaatacatcgttgcctaggtaacaaggcctatccaagcattttgaattagtaggcgttgatcatctatatttggggattcaaatctgcaatgaaggcaagtttccatggtactagcaattacataactgttttccagtatttttcagaaggcagttgtatgtcatatgggcatatttcaggctcaaatatattaagcaatcaatcatatcactaggtaaaagtttttcacattgaattctgagattcatattcactatcgcaggaaataatttagtactgaagaaagccttgaactcaaaatgtagaggaaaatgtttgaagataagtttacctcattgtggttaagaagcagtattctctgtgatcaaaggacagactactctgcatatcatgaatgtggccctttctaggaagcaaacccatggaaacattatttttcctacagtgtgattttgagaagaaatactaacgttctgtggttccctgtttgtccagtgaaactgtaacttacggaaaaatgtttaggatatgctcttgtgttctaaaagcatctttcagcaaagcgacgcagtcaagataaatggaaacctaagattagtcaatatgttttttcaacaaattagaattaggcagttagggtgcattaataatggtcaataatattgtgcagatttcagtgcccattaatttgttcacatgacttaacgagcacatctgcataataacagaaggatgcttcacccagcagccacagctgatgttaaccttccacaccactaactttctgattactcattatctgtacttagaattagtactatgctttgtccaatggactgacacatattaccctggttcaagagacgaaagtggccttatttccaccatgcagtcattttaagacttggtctcaagatacaaattcttgatatgaatttggagcatcctgaagatcctgcagttcaagtagcgcaagccatctctatgtttccatggtaactccacaatctctaacaagacaagaagccaatctaagactgtctaccaagccacattcttacttcccttatgcaaacttggcagcagtgctgtgtctgtgtgtgtgtgtgtgtgtgtgtgtgtctgtgtgtgtgtgtgtgtctctgtatgtgtgtgtgtagagggatatttaaaccacaagccaagattcaaaggtgtgcaatgtatgtaaaacataggtattacacacacagaaaaatatgtgtatacattctacagctatcacatatgtttattatagtataaatgtgtgaataggttaatcactttctgaactgttgaaaactattctggctatcccaacagcagacaataaactggcagaaaaagcacaggactaaatcagccagggtaggtttcattccgaactctgacattttcctgatgtatgacatttgcccagtaagtgatcctctcagatggacacttccccataaggttactgggaaaaaaaagatggtaatatgattcacatgcagacattctttatttattttcatcacatgtgatgctaaacatgaactggctgcccagcgatagagccaatgattcccaggaggttagcaaagggagaacattccgcagtagacaggcttgcagaagacgtgttaaaaagaaaaataatacaagctcaagggacttggaaaggtggttcgttcctgccacaacatcgcaaagaaaaagcaggaagtgagtcaccctagatacaccaaaggccacccatgtgacatatcaggagaagcaaaggacttatgttttagagaattccaagatatgctgcacactgatctgtaagtttcagactctgacaggtagatgtcaggtagagaattccaagctgtagcgtagattgcagtgcacctgacttgtgcctcctccaaccctcatattcaacatttcaacattttaagttgccttcaacatcacatggtatctcagtgaccaagggatatggggtattttataactctccaaaacataaaaacagatgccacatgaaatgggcaatgtatttggtaaaatacaaggagtgcttcagcttgctttgttagagcataaaaagcacatatgataatcaaatacaaagacacagacaggaggatggaggttgccagtggttgtggggaagtgaatatagagagatattggccaaagggtacaaaattttagtaagagaatgaatacattccggagatctaatatagaacagtgtgactgaatttaatattctcttgctaagagagctgaccttaagtgttgtaaccataaaaaaattattaaaaatggtcactatgtgtggtgatgaatatgttacttagcttgatcatggtgatgtacatgcgtacatgattcacaatgcatatcaaatatcaaattgtacaagttatatacaatgttacttgtcaattatatatcaatagagctggaataaagtatatttttatctaatagaaactaacccaaaaagcagactatgtgcactagagcatgtggtcatctcctaggagacaaagtctgtgtctggtgatctgacctttgcagctttttcttttcaccaggggagcttcgactaggtccataaggaaatatcatcttgatgtgtgcactggggctcatctttctcatcctacacgttccgtattagaaatatgtggaacagttctgatgagacactaccacttcaatttgtttttctcgtacatctcctgtagcatatggccctggtcaactcaataactaatttttaaggcttatttacttttaaatactgccaagagaagtgttttaaaaattataataagtattttcatatatacaataaattctagtaaagccattgccaataataccacaagcactgtggttgtgaaattgtgaatgtatacaaataggtgtgtgtatgtgcgtgtgcgcacacacatactctggcttaacacggtataccagcacctcgagtaaaaggcctattcaaaaacacactgatcattagcaactgagaaatgccttgttaatctgctttttcatatattttcagatttctctgtaaccgtctccatggagactttcctctgttttcccaaaggtgcctctgacacaatcatctttacacgtgttcattcaattgttcattctgtcatgtgtctagtttaacaaaacatttcagacgtggccttcaaatcagctttacatctttcaggtttggtacattatttttcatactcccatacgctcaagctcagagagtacctactatcttctgttgagcaaaggcaggaatattttaaaactgaactgctcaaagatgcattcttttacaaatgtctacctctatctctcaatctattttttcattttcataaaaatgattgtcagaaatatatataaataaataggtatataagaatataaatatatacatatataagtatatatatgacaatgactcgctgggttatgagttacactaccgctatgctcaaaggaaggtttgtttaaaagcactcaagaattgaatcaataaacacaaagatattaaaaatgtttcctaaaaataaaaaggcatatccatcattgagcaaaagaatataaaagttgccattcacatttcaccgttgtagataaaaacatgtttaccagcaagaaatatacattagcatatgatatatagcagctgatctttaaaaaggatctttgagaacctttaaaaatatttacctagcgataaggacaactcaaatacgtcatggacaagaacaggcactatgcaacaggttgtggtcagctggtctctgttccaatgtgcaaagattaaggaattttcggactgaagaaaacaaatggctagccaatgtttcattctttctaaggcagcatcacaccataacatcaagctcagaattctgtgattaagtcagtctgtggttggggcttagaaagaggagaaatgatggggcagccaaggggagctaaacctgtcagtaatttcggattcaagaagcagaaaacagtggaaacagatttccacttacatgcaagacatcgcattgatgaccaacgctaacatatattagcagctattgcggtttggaggtgaaatggacatgaaaattagataggaacttatgctttctatgaggattaacgatgtttgaacaccctagaaggtaacatataaatcttttccttgcttggtttccaattttgttatttttgacatgtaattatacacacttatgcaatagagtattttcatacatggatacaatgtatagtgatcaaatcaggataaagaagagaaaaaatagataactggaattacatcaaactacaaagcttttatatagcaaaggaaacagtgacaaagtgaagagacaacatgcagaatgggggaaatatatgcaaatcactcatcggacaaagcactaatatctaaaatatatgaggaaatcacagaaaacaaaaacaaaaagtaccaaaataattactgaaacacggttcaaatgactggaagagacctttctcaagatatgaaatggccatgtaatttttttaaaaaggctcaacgtcatgaattatcaagaaaatgcaaatcagaactataatgtgctatcatctcaaccccgttaaaatgctaattcttccacaaaaccagtctgtgccttcacagggaggtcatcccgagcagcgacctacattggagtgttctgaggttacatgcactgacaggcagacaggtgatgagtctgtgtattcagtcaagacgtaacaagggaggggcttttcttcctcagtgttttcaaactacgctcttcatactgactagatatcatttggaatttcagtagttcacattagtataaaataacggaatattacattcttattatcatatccagattgttcatggtccatgtgctggcatgtgtgaatacgaaagtactacaactagaaatcttcagcattagaaaggacctggaggtttttctactccaaactctccatgctggtcaactatggttaacaatcaaatatggcctgctaatttatctggacagctcatttgctaagaatgatttttatattttgaaatgactaaatatacatccaaagaataataatatttcatagcacatgaaagatacacataatttaaatttcagtgaccataaatccagttttactggaaagcagccatgcccatctatttccatacgatctgcggctgcttacctgaccccacagccgagttgaacagttacatcagggagtatgacccacacagtatctggccctttaaagcaaggcttgccgatccttgatataatccatccctgctctgatagcctcatgacattattgtctaaactgaattaaaatccagttacagaaaactttcagtctttgggcttgagcgtgcttttcgttattgttcttgactgatttcatttcaatcttcagcaggaatcaaatttaaaagaaaaaaatggtaagtgaaatcttcattgcaattttgaattttttttctaatttgcctcgtatgagtgctagtcagaaatgtcgtattatttataattatattttagatataaaaataaattaacagaattcttatcaaaattcaaaggagacaagtcagtggtaagctctggatacaatgtcccgctgtagaaatccaaggggattgagactgagggcctgaggccatctccacctctctcaacatgtcattctggctggattgtaaaacctggctggacctcaatcttttcctcaaatactaatttgaaagtgagtttagttaggtaacattcaactctcttgtaatggagggtgcttgtggctgaggacaagggctccaggatacttaaagttttcattttattatttcctctaattatctagaccagagacacctttgaccatttttctcctattctttgacccctcagaagttactttttctccaaggcaggaaagatgaatgattttagcacttggtgtgacaactgggatcggtgttcaagttttagctttactcctaacttattaatcttgagttagaaatacttggaaattacatcatgcttaaaatgaaacagacatccacgatttggggtaatctcaccttggccctctctaaacagcagcagcagcaactataaaattattcagtctatagcataggacaaaactacataatataatcgatactctctgctctttgatttcttgggacatctaagacattatcatttaaaataggtaacattacttaaatattttagccaaacacacacaagagcttataccacatctatgaagaagaaggaaattgcaagactaaaggagactaaattataatttaccaatgacattacaggataaggctgtctcaacagaaatacttccctgttgcctattattaaagttcgccaaagagaatgtagatattggccatctgctctgagtcttctagtgcaaaagcaatgaaaggaggagtgtaatttcacatcagtatgcaattgcaatgactcctattactacaaacatcccttctatctcctgtagcacgtaactcaattctgagtgcctagcaagcatgtattgccaagttgtattggataaagttttagtaactctaaataaaatctataatcacttaaacagatattatatcttctctcgttcaaagaaacaaaaaaaaacagatcagaggtaatttccaaagttaatccatgataagaaaaaaataaaaagttaaataaacaaggataaaataggagcacaaaaataaaatggaggcacagaagaatttatacacgggaagcactacactggcaaacatgcgtcacttattttactatatgcataaagaggaaaaaaacagattagttacaacatactccaaaatacaccaggcaaaaacaaaccagtggcccaggaaaagtgaatgcttggctaactaccagttagaagtattaaagagagaagaccttttcggtttttaaaacatatttactgcatatgatctctggatatggcattgtgctgggaaaatgtatataagaaattcacaatgcatactaagtgctcttgactatctcttcatgtctaaggggaaggtagatataaccaggagcaaaggcatgttctgtggatgcctttgtaagagtgtgaggccacagcagcgaagtcatggaatccacccaagtgtactacgctacaagtgtttaaagaacgttgcaggtcacagaactgtaagtgattctgtatttttaaaaatcagaatattaggcctttctgatcatttgctgaagtatcttcatatttctttccacaaaaaggtagcttaataagttgtatctgcaaagattttgagagttgtatcacaaataaaagtgtgtgtgtgcacatgtgtgcatctgtgtgtgtgtatgcatgtgtgtgtgcgtgggtgtgttgggggtgggggagggaggggagagggggagagggagggggagagagagagagagagagagactcttttgcgtacatatccgcttaagtgaattttataccaggagaatttgatcttcgtctttaggaagaccgtgagttaaaattgtagaaaataaactacgaatgtgactttctttcaatcccttaacccatttattcttccaagacccagttaaatcaataagcttttaaggtacgaacatgctcttagttcatctacatgtctgttgctctgattgagtcataagcctttctccctgtgatatcacagctattgttccttaaccagacagtgccctcagaatactcttgaattgcaccatatgcaaaaacaggacaaactgaaaaattgaaaatccaactgtccacacaagccgaaatcttacattcttgctaatttagttagaaattattaacatgactcatgaaatgctcaaattacaaaatgagctgaagtttgaagataagtaaaattcagtctgaatccgaatacagagcttgcatatgtgcttttggtgtaatttcatcagagaactaagtgaagattttaatcagaatgactataagaagggcttgtttgctaattgtcttgtggtatttggtacagaccagtggttttcaaaaacaatttttgcagcagtggaaagctatttttctacactctaagacctccacagaattgagtataagatgtaggtgttatcgtattttacatttttcttaaagcatccttttgtggtaggcagaggaaatattatcacctctactttaatgatagagaaaagtcagatttacaactagtgatatgtctcaggttatataggtagaaaatggagagctctatctagaatctaccttctttttccctttcaacagcctttctactctataccatgcttttttatattaggtgacatagaaggcttcaacatttagcaaccaaattgtcttagaaagctgttacgtctccctgaaatttcacaattgcataccttcataatatttggctaaatggtaaattttgaaatgtggccaatttctatcatacctataaatacaatcatcagttacaagatcatttatttgacatttttcaaatgcccaaatgaatctttcctccattaagatatttatttgtctcaattgcttaaaattaaaatatgatatgaccttttttttttttttttaagtttaggttactttttaactatgtaatgttacctttaagaaaagacagggagccaaaatatattagcaaaaaggttgtgctatgacctttatactgccaaactttaacaaaacaaatgtatgctgtagacttaagggatccaaagtaatagctttggtccctgagccctggaatcttgtcttttccttgactaaagaggcttagttttagcttatttcaaataagaatctctcagccctgaaacatgacttatgagccaccactggctgctacgtcagattcatcccaaacttcagtccaaatcatcaaatcttgatggtccttattgttacaagccttctcttctttttgctgtacaattgcaaggctctgtcaagcgtccaggcacctgcctgaagcctaagtctcaacaactggaagcctcactctaggggacgccaactgcaggtgactgtgctgtctacttgaggtctaacaggctgacacacctgaggggcacacaaactgtgaaccaagaaatggagaaaaatcaaaatagtgttataaatgaaatgcacagctatgatatgctctgatttactatatctcatcaaccaaccttgattcaccaaaccacatgatactctttgcctgctacaaaccacacataaaggtaagatcaccgcagcagtgagctctcagcctgaaggaggtaggaatggaggctaatgtcctgattccacatttattcaattaacacttccacgcttacaatgagaaaaagcagaacaaaactgacctgggcaatgggctagagaattgcgagttgactcatgaaatttactagaacaaaggtgtatttttcatcactgatgtcaaggttgtccacttctcctgctgaccaaaagtcacatttgctcttctctaaatccagtggcagctgattgaatttaagtaggttatttttaaattcccagcatctagttactttagcaagatgactttgctttccttagctgtggagacactatctgccagtggctctagttccggtggatggaggggaaaggatgtgcattctaaggtgggccgtgcttacaggaccgccttccttgacacatacttgctttctgcaagtcatcgtttaaagcttcttttaataattttgcctctctgcttaatcgaaattaaagttctgtcttggctacctctatcaaagaacaaatctgcctggctcagaccagtaattccagaacttcaggagtctgaagccagaggatcgcctgagcccaggggttcgagaccagtccgggcaacatagcaaggtcccatctctaaaaaaaaaaaaaattagggaaagaacaaatgacttctaggagttaataaaatgtaccaagtttcacctgatacctaaagctccatctacatcctgtctttctaagaagtaaacattagaacgtatctttcctaacaagagatttttcaatgctaaatgtttctccagctatataaaaacattcaatgaaaatttgaggcatctccttattcgtcttgttctcctctcttctcgtctcatagcccatgctggctgttataccaagtaaggtaagaagagttacttaaaataatgtctaaaaagcagagttccatagctattactgtgccaaatttatagattaggaagaaaattgacagaacttaaattgtgagattcatggaggtagaaagtggccggtcagtttggctttaaaatgcatgttttatgcaaaaatcctgaaagagacttcaacttgttgtgggagtgagaaaggagatgagggaggtttataggaaaggcttcccaggcaagatgtcttccaagaggagacttgaatccttaggaggaattagccagacatggaaaagaaaaaggccttctaggttgagcaagacccacttgagaagatgtgaaattgccacttattttgtgcacttggaatccagcatctcaaaaggagcagagcaacacaccaggccaaggagatgtccaggaccctggtcattatatacgacaggacttgtatgtggattacgcactacagaaaccaaactgtagaaacactgacattcaaggtaacattgcctttatgctatttttttttttttttcagaaaaaaaaatgagtggcttgaaacacgggtatggaattgactaatgcaatgctgatcgtttaagttcattgtgtcccagtgtggtctacaattattcagtgttagccactctccttctactgctggaatactttgtaaattagagaatgaggtggactggcctgtggccccaactcagaatatcatttttatattaagtccacttaggttctcattgcctgggatgaataagcaagccccacttagagctaatgcaattgtaagcaccaacataaggttctaaatggaaatgaactcacctgctcatgagggttcttccaggtgatttagaaaatagaactatctatgccatcataaaaattaaaattcaacatttagaatgttctcagataattcacaaacagcaataaatatgtctgtagatccacagaaaatgagaacaccagtataaatatttccttttcaactcaaaaaaatctttaaagaatagaaagtggaaatattctccagaacatattttcagtgaatcaagtttgaagaaacatgaaattttccagttgcaaaagaatgcagacatcatctatgtcatcctttcattttccatgtaacttcattttgcaagtagctaagtttgagaaaagtcatttgccccgagtgacaccgaggagcttaacagcatactatttcccctatgaaggtcatttataaaaacgtatgcattttaagttttactttcaagaacacaaataagaaccctctgttctgagatttaagagtcatttgatggaaaccatggcagacaaatctactgttggaatgtggacatggctgttgccgtccatttcaagatggttcaaacgaactcaaacaagattggacctgtttctctttgttttgtattgatcgtcagccataattacctcagaaaatgacactagaaagatttaggcaaaatatttataagtaaatacgagcttgtagggctaattatggtaaattctaccaagcctttgaatgcaacattaaaatgactaattatttcctctggatactatttcctgagtcttaatatattagattgtagaaagagtaaaatcagatattgtcaacttcacttattttttacctgaagtaatataacattcggtttatgttctctgatatggtttggctgtgtccccacacaactgtcaccttgaattgtaataatccccacgtgtcaagtgtggagccaggtggagacaagtgaatcatgacgacggtttcccccagactgttcttctggtagtaagtctcaggagatctgatggttttataaaggggagtttccttcacaagctctcttccctgccaccatgtaagatgtgactttgctcctcctttgccttccaccatgattgtgaggcctccccagccgtgtggaactgtgagtccactaaacctctttcctttataaattacctattctcgagtatgtctttattagcagtgtgagaaaagaataatacattctttaattaaaattggtcaaatgaatccactgcatatgatctcaatataaaaatcagacctttcctaggaaatatactagatcacgaataaagcccaaagtagcatatcctgaagcacatgcataaggcaactaaagagcagagtcacgcccaacgggacaggctaaaccttctcaatctgcctttactcatttctctcagaattcacaatcaggcataagaaaaatcttctttgtgaaccacagtttttgttggggttcatggagatttctttttttgcccttcacacatttgatttacttatttgctggcttataaatggctcgatcattaaaaccagtgttcttctctcctcagtgacccgcacttaattatggctcatctggtttacagcaatagtgccagggaaaagagcatgttcagcaagctgtttttacacaatgttcatttgaggtatattagggaacttcatcagccctctatgatgatatattgtttcactttttcctaacacctgcgtggttgttcagcacattcttcaggctttttcctctccataccagtgtctatgcagctatatatcatttcagaaatctgcatggcaatattgcttccatattctcgttaacttgcccaagaacgcgcctgaaagtaaattttaaaaatttaaatgtaaaaattatagcatattcccaaacaacatgtccacaagcacatcttcagagattaccaccctgagccttccgatatttccaccttaccaacaacattgtagatcacggtgttattttatgacaaagtaaccaagttactcagtattattaaggcgatgaaacatttcaactgtataatctcttttgaggttgggaaaccattctaatattcacaaacctggtcatttcgtaactattaaaatacaccgttccccaacagaactgaaatagcatgctaggagagaacaccaaacatctgcgttagctaaaattataatacatggggtggaatgtcagagagaaaatcagagtcatgaatgtttaatcacttgatgttgtggaaaagctggtggctgcattagcactaaacatagatggcagacttcaccgtgactcaaccttaccaccttctccttgaacgtataagaacgtgtctactcaaaaaataaacacatgaacatctatgcagaatttaaaatttttgtaacatttgtatattgtcaccgtgtatatttttgaaacacttgtatttataatgtaagtgatgcaggtgtttgaattccttttatagatttcccccctcccagaaaaatgaaagcaaaaagtttatcaaacttagtattatacctggtttctgagctctcactagagggcaggtaaatgaggaaaatgtagtgtgtgtgtgtgtgtgtgtgtgtgtgtgtgtgtgtgtgtgtgttaaatatttgagtattttcaggttgaaagaaaccaccgaattccacccaaacccatgtttagatcttttgtggccaggcacggtggctcacgcctgtaatcccagcactttgggaggccgaggcgggcggatgacgaggtcaggagatcgagaccatcctggctaacatggtgaaaccccgtctctactaaaaagacaaaaaattagccgggcgtggtggcgggcgcctgcagtcccagctactcaggaggctgaggcaggagaatggcgtgaacctgggaggcggagcttgcaatgatccgagatcgcgccactgcactccagcctgggtaagaaactccatttcaaataaataaataaatataccttttgtggacacaggaacaaaccacttcatacacacacacacacacacgcacacacacacacgtatatatgatatatatacacacacacaaaactctacaaaaatgacgcgttaagagtgttcttaacagaagtagcgaattcaggtatcttctttatgtgtttgcatgtaggaaagcataaatagctcaaactcatttttattaaaagtagagtgaatgaaagggaacattcagtagtttagtaaaggaagttctccttcagtacataagtgaagaaataacaactgcaacaaaacttggtgagggaccagagtgttcagacagaagaataactgagttaaatattgcttacagaaatcattcaagaaaagcaagcatgctataaaacctccaaagcctacagagtttcctaccaatcccactccaagttaagggtccagcaatgcatctttattcattttccccctgcatgaagctctgtttctccagtgtcattcatgggtaacatgtgctactaacctggctgctgtttggaagtgaagatttctagattccaggccgaaagtagaggagctttggaggatgggaaccaggccttgccatttaaacagcgcaggtgagtctcatgatttgaatcagctgtttttttgttttgttttgtttgtagaattgcatttttttatggatgttctttcttattttttcatgatattggggtacatgtggcatttggttacttaagttactggtgtttgggagatcctggtgcactcatcacctgagcagtgtacactgcaccatatatgttgtcttttatccctcacacacctcctagtcttcccctcaagttcccaaagtccattgtatctttcttatgcctttgcatccttatagcttaactgccacaaatcagtgggaagatacaatgtttggttttccattcctgagttacttcacttagaacaattgtctccaatctcatcccggtcactgcaaatgctgttcattcattcattccttattatggctaagtagtattcatcatatgtaatacacacacacacacacacaccagtttctttatccacttgttgatttatggacatttgggttggttctacgattttgcaattgtcaattgtgctactataaacatgcatgtacaagtatccttttcgtgtaatgacttcttttcctctgagtagatacctgggagtgggattgctggatcaaatgttgttcttttgttgaagtcttagagtattttaaatatgtttcattttaaatgtctgtttcagtccatttttacctctatcctgtaagcatcttggctgttttcactgtgtctgctttattctggtcctgcgaaggtagttcacatacacctgttagtgagggcttctttccatgtgttttgtccttctcaccgtgctctccaatggagaggtacagtgagggcaccttctccggccgtgaatgactggaaccgagttcttctctcaaagcagtcttgcaggcccagcccctgaccgacttgacaatggcgcacattcctagttgttcagctatctctgccctttcctctaaaatctagaggctgaaactataatgaatttagccctttaaatctgaataaacatattactttttaaatgtcaatatgtgaaatataatagcaactgaaagactttgcagctatgtgaatatgtgaatatatgaagataaacgaatttcaattgctataaaattcttacattgtatgcagttattaaaatgtatctttactgaaggaagaataatatgaataatactgtgttatgtattacaactctgaattggtcatcaaaaccccaattcactttggtatatgatctcaaataaaatatggtacgcaaatgctcacacatgtagtgtgttcttaagtagctaagggttttcagttgaaagagcctcttacgtgctagaattagaggttcagggactaaaaagtaaccttatagatctcatctggccattgtgctttctcacatttcctcctgatatcatgcctgttgcgtaagctattcacaacaggatcgtagagctgagcccactgtatttcatcaaataatttaaatatcaaatatttactccaaggccagaaatattaagagtttatattttatcacctccaagatacttctctcctaccatcgccctcaccaacatggcattactttatccacagttcctctgcactaccatctctaagtaagttggaaatgcacagttggaaaaaaaaaatctgtcattctccatggtctgcttagtattagtcctttaggatacaaataaatagcatgcttaaataaatacaatatctacaggtttcctataactttaaagttttcttcatggtaggacttcaaaaacttaacaaataatcagaattaatttgagatcaagagatactcaagccaaaattttaaaggtatattgtaaaagaaaaatgaaaagaataaggaggatggggagacagaggaggagaaataccaaaatagtattacaaaatttaaaagtgtgagtaatatcacttaaaatttatcatattttaatgctaaaatcatagacgtataattgtagtatttataaaaaatagagaatatacttaattaaaagcccattgctagtggtgtaatgcctgaatgagactcagtttaagatgtataataaacatctccctccccttcccatggaacttctgtcctgaggaatacacagtagctgctgctgatttacatgtatacttacgtatatatgtatatatgtatacatacatatgctatgatcagccaatttaatttattctcaaaatttattctcaaaatttccatgcatgcaaaattatgatgacgttcactttattcagggatgaatgtcttctggggtgttataattttatgtaccaaatgaatgtcactgtggggcttgttgaacttttgctttaccagtgggtgtggagcgcggccatgggccagatccagctggtgccatctgacagctgcctagttttgtaaggcccatgagcttagaatgattttacactttttaatggttgaaaagaaaaagaaggggactgtttcgtgacacgtgaaaatatatgaaattcaaatttcagtgtccacacagtcggcctggggggagctgccactggctcctttccacaaggtgtatgtctccttttgcgataccagcagagctccgcagatgcagaggtgacgatatggcctacaaaacttaaaatatttactatctggccatttaaagaaaaagtgtgctgaaagtaatagtctaacagggtataactatatcatgcaataatttatgaattccttttagtgctaacttggtattttgcatactttttctaagagtagaaaccaggtatttgtagcttaatcattaaaatatctctcaagataagtgtatatgatttcaaaaagcaattaggttgcaataaagctttgtcagccaaggcaagggtaaacaagttataaatcacgtaagagtgccttggtttcagtgctcaaataacttttaaacacggttttaccaataatcaccataaacctaaaactacaggacagtgaacctttattaaaaaaactgaataattagtacattcagtactacacttccagagtcttgtgcacacacacacacacacatttaagttgacatatataggcatataatatatacatatatgcctatatatgtggcaaaatcaatatacatgtgatacgaatgaagtattccagttacacatagtatattaataaatgcaggaatactagggtagaaatttagaaggcagagttgtagcccagttcggtcactaataagttacttggttatcagcaatttcacaaaagtcccagagcatgagttgcattatctgtagagaggggtgtccctccttctgagattacttcactcttcaagaatatttaattcaatagatatattctgtgtatatatggctgcagtgcattattgtgcaggggccaaataggtacaacatatctaaacactataattatctacagaaattatcaatagggtttaaactcacaataacatattaactagagaagctttgtttttcttcctattttctcgagcaatttaaagctaagccattctttaaaaacaagattgaatccttcctctttgtctcttatagacttccccaaccttgcaaatagagatgtctccttccaatcctcttgcgcagaagagccctgtgttccttggagattacatggtgttctaaaagactgaattaactcaagagtcaatgaacctgtgtttgagtcatgctccccttgcaaatgtgtgtggttgattctgggtatgaatcctcagccctctgggttttagtgtgtttgtctatagacaggagcactgtggcctggcccacttctacattcattccaagggtccacgtcaaggagttggtaaagaacgcacaatgagtacaggctagttgcaggaacccaccatctctcctactgtcggaagcaagactcagtgcaagtccagagacaacactactaaattctaaacagcccctaccttttaaccacagtttaaaacatcaacgttcagtgaaagaatgcttccctactggagatcttccacatggttaggatgctcaattagccaaatgccactgccatcccagttgtggagttccagctctcttccctgtccccatctgagcatacagttcctctcgtctctgaccgcctgggatctcggacaagttacttaacatatctgtatgtctggtttcctctctgcaggtttggctgtgaggatgatctgagaggatgaactacacgtgagagtgactgtcaccgagtaaacgcgtggcatttgtcaccattttagggggtaacccttctcatctaatgttgatttcctgatgaacacacatctacctccctgaatttgcttttacttaatagtggtccccaaatgcatccagctccatgggaagtgcaaatcctcctcttatctgttgcatgattaacacatgcctctttaccctaattgtaagttactgcaaactccatctataaaacagtatttgtggaattaattaactgtgttttaagtcatagaagagcccgttatcataacctcttttttcttgcacatacttcctgttcctcccaggttctttgagatggagtctggctctgtcgcccaggctggagggcagtggcgcgatctcggctcactgcaagctccgcctcccaggttcacgtcattctcctgcctcagcctccagagtagctgagactacaggctgcccgccaccacacctggctaattttttttttgttttttagtggacacagggtttcaacatcttagccaggatggtctccgatctcctgacctcgtgatccgcctacctcggcctccaaaagtgctgggactacaggtgtgagccactgcacccggcccctcggggttcgtaatctcacagttcctgacacaattaatcacggagcttctggtctcctttatctatctttaatattggtaaagcactgacaggtcccctgaaagtagaattaggcttctgatagcaggtgaatttctttttaatcatttcatgggacttgaggaatacttgactgacagtagatatttgactaatatttgaagacattttaaaataaaatatttcttaaaattaatgctatattgaaaagaaaaactggatttttcgtgcccaacagatgttttgtcagttctcatgctacacactgtgtggatgctgaaatagtcactgaatctctgagctgaagctttatcatttgtagaatgggctaaattagacttattaagctgtgaggcttaaattagacaactggttttcagtggaatacctaagttactcaaaaagcaggaaggaaaaggcgtaaaagaaaatattactacttactcataaataatacaagataaagaaacttatttttaaaatattagataatgatatatctgatatctgcagtcatctgtgatttttaattgatttaatgtagcctcatgaagggctaactgtgtctcaggcactgcttctaagtaatctgaaaaactaactcattttatcttcattacagcctaataaggtcgacattattgcatttccactttacagattagaagacggaggcctgcaagatcaggtaacgaccacggtcctacaaagttaaaaagtcgtagagttcaagtttgttcctctgtgaaacgcagttgccctattttatactcccaactctctgctttgctgtcccttttgttttgtttttccttaaagaagtttcctatcagcagccaggtgcgacggcttggctcacgcctgtaatcccaacactttgggaggccgaagtgggcggatcacgaggtcaggagatcgagaccatcctggctaacacggtgaaaccccatctctactaaaaatacaaaaaactagccaggcgtggtgcggggcgcctgtactcccagctatttgggaggctaaggcagaagaattgcttgaacccgggaggcggagcttgcagtgaggcgagttcactccactgcacgccaaggccctccagcctgggcaacacagcaagactccatctcaaaataaataaataaataaataaataaagtttcctatccttagattaagaaaaagcaagacaaggattagaggtaggatacataaggaacctgtgaaaataaaggctgagataatttaattgatatacaaatgagaacagaattacaaatccaagtactttataaaaatagaattatgacagagggtaattcaatttacatgagtacagtgaagaaaaagtccattacatctgtattttccaaaggatcctgggagattttaacaaaagacttgttttttccatgagaggggatttcaaccagaacacaagcagtggactcctcctccttcaggtggactccttggccctggggttgtaactgaaccttgagaccccaagctcatctgtctgccccctgcactcatagtggtccagcagagcctggggacagagtctcaggtccgagggattagatgtaactttggacaagaagagttttgttaaaggtcccttgctgataagattacggctttcttcagagaactcttcctcatttgtctgcttaatttgtgcaatagatagaacaggatctttaatttattgtgggaagtggataatatagccccgtgaagtgtagcacaaaatagctgctcaataaacattcttttctcttttcaccagtttgctaccccctctactggcctcaagaaggaaaggacagtgaaataaaagaaattatgggatgactgataagatttgtaagagaaaaggactttctttacattgttgtgtaatcagtttttacttactgagcaatttagtttttaagttaaatttaaaaatgaaagggaattattattgtagtttgattttataatatgggatagttgttccccattggttatcagggtctctataaattcatggctcatctgagttataaaagtaatttaattaaatgtaaaagattatttcttaaactgttaggacaagtctatgtaatttaagccaaatatctaaaaactgctatcaacaaacatctcagtagcagtctttgaatagattttgaattttcagtatttacttctgctactacggaagggagaaaattgaattttctcttcagagcagccaggtcacagtggatcataatatcagagacttcatcagacactttcaacagagtaaataataggtgagagacagtttcaaacatacctaaacaggcttaaacaggaaatgccaccattttgtatttggtggatcttccatgatgaccaaggtcagtgtttctcaattttctttttccattatcaccccttaaaggagccttttcaaagtttttccctcctgcccgtcatgaaattctatactacaggtaccctgcataactgttttaggtactcgtatgtgtatgcatgtgcgtgcatgctttatacgtaagagggataaaaaaatgttctggcctccaggattttattcctgctcccctcatttagggtctttccagctctatcttccccaccaccccctctctggaggaggaaaagcatacttttattgtttgcaaagctaagaaagaagagcaataactccctccctactacagattgtaggaaacaggagcgccatctgcctggaggacccatttcaaagagacaacatcaacgtccctgggaaggacggtgccaggacatacaactggcaggcagcctttaaaaagcattacatcgctctgtgcctggttatttcacttaacaaagtgacttctagttccacccatgttgttgcaaaagacaggatctcatttttcatggctgaatagtactccactatgtatatgtatctcattttctttataaattcatcacatgttctcacttatttgtgggatctgaaaatcaaaacaatagaactcatggacatagagagtaaaggacggttaccagagtctagaaagggtgtagggcaggggggagatgaaaatggttaacaagtacaaaaaagaaagaatgagtaagacctactttttgctagcataacaggttgactgactgtagtcaataatttaattgtacttatttcaataactaagactataattgaattgtctgtaacagaaaagttaagtgcttgagggaatagctaccccattccccatcatgtctttattatgcattgcatgcctgtatcaaaatctctcttgtacttcataaatatatatacctactaaatgcccacaaaaatttaaaaaataagttattgtaaaaataagtagttaattaacattaaaaatgctttacatctcaaaggggcagaaaggattacaactttctttaagccaaggggaacattaaggtcctcttgataagactagggcccttaaaataaagagaaatcttacctaagaaaacagctttcccctcttcagttcctgtttactgttatagcttccattattgccctagtccatacaagattcatttgtttttcatgttttttccaaagtaatctatttttagtaatacaatttcctctcttgctttctagaagactctacattgtcagttaaaacattttttaaaaagataatcaatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgcgcgacagagcgagactccttctcaaaaaaaaaaaaaaaaaaaaaaaaaaaaaaaaaaaaaaaaaaaaaaaagataatcaatataatacactgcctgttactaaaatcataaccaaatattgaacctaaatcaaagcacccgacaaaaacgtgcaagggatttaatatgtttaaattttactcgaaaacatttatattctaatggaactcagatgatattttatgaaatatgttctctttcaattgtgaggacattttccatattcatcagttgtaatggcaagtttacaagaaaaagtttaaatactttaagtgtgtagacatatagtgaactaatatacagcatatcatatttttattttgaatttggtagttttgctcacaataaatatttgcaccttgtctatatataaaaaaagagttttgttaatgcttaagtagtttggaatgtaattttactttcttaaagaaaaactgtaagtgtaaataaatttaggattacacctgattctgaaaactgtacaactaattgaaatgctaagattatcaaaatcatgcatcattttttcacatttctgtattttaggtgttctttttaaatgttaattttgcctaacctctggggaaaaataaaagacaacatttctttttagattgtctgttctttttctccaagtctactggccttagggcagtgctacgaatccaggcgttgtgattaaattccctgtgatatcagagacagttacttatgattgtgcctcttattgatgatatcaagcagatactctggtttctgtctttgtacttgatttgtttactctgaacactaacggtgaattttaacagttgcttcctgtggttaaaacctaaggcaaactccagcctctgatccagcctgagactttctgccacgtgctttaggctgagcttccagatttgaatagctgactccggtgaccgaatttatagtcaagtcctgattactcttggcattaccctccagaggttttgatcttttgacttttctagattccaccaaggaaacatcactaaaaatctacttaaagagtaattttcttttgatatcaaaatatttcatctttaaagttttattatttttttcttttttgaaaatgtttttaggttcagggtatccacgtacaggtttgttcatggggaaactgtgtgttgttgaggcttgatttaggaatgagcctgtcgcccaggtagtgagcacagtacctgacagatagccttccaatccatgagcctctcctaccctccccactcaggtagtacccggcacctgttgttccctactttgtgtcactgtcttcagtgtttcactcccgtttatgagaacatgcagcatttggttttctgtctctgcattgcttcacttaggataatggtcttcaactgcatccatgtagctgcaaaagacgtgattcttttttttttctgttttatggctgcatagtgtctcactttgcatatgtaccacattttctttagccagttcaccattggtgaacatcgtggctgattccacgtgtttaccattgagaatagcactgcaatgaacatatgcatgcacgtgtctttttgacagaatgatttatttccttttgggtaatcccaaaggtgggactgctggtttaaatagtagtcctgttttaagttcttcgataaaactccacagttttccacagtagcttaattaatttgcattccactcacagcatataaaaacgttacttttttttctgcaaattcaccagcatctgttgttttttttgctttttattaacagcaattttgactcatgagagatggtatctcatcgtggttttgatttgcatgtctctaatagttactgatgagcgttttttctttttcttttattttattattattattagactttaagttttagggtacatgtgaacaacgtgcacgttagttacatacatatacatgtgccatgctgctgtgctgcacccattaactcgtcatttggtttgctggctgcttgtttatcttcttttgagaagtgcctgttcatgtccttgcccatttttttaatagggttgtttttcgtttgctgatttgtctaagttccctacagattcttgatattacacctttgttggatgtgtactctgcaaatattttctcccattctggaggttgtctgcttactctgttgataacttcttttgctgtgcagaagcttcttagtttaataggtcccacttgtcaatttttatttttattgcaattgcttttagagacttattcataaattgtttaccaaggccaatgttcagaatggtatttcttaggttgttttctatgattttaattgtgttagagcttgcattgaatcctttaatccatctggagttattttttgtatgtggtgtaaggaaggggtccagtctcataagtccagccgggccagactgcatgagtctagacagttttcccagctccattttttaaatagggagtcctttccccattgtctgatattgtcaactttgtcaaagatcacgtgattgtaggtgtatggctttatttctgggtcctctctcatttttcattggtctatgtgtctatttctgtaccagtaccatgatgttttgattaatgtagtcctgcagtacagtttgaaatcgggtagtgtgatacctccagctttgttccttttgctcaggactgctttagctaatgtggggctctttgggctccatataaattttagaatggtttttctttttctaattctgtaaaaaatgacattggtactttgatattaatattgaatctgtaaattgctttgggtggtatgatgattttcacaatattgagtcttcctgaccatgagcactgaatggttttcatctgtttctgtcatctctgatttctttcagcagtgttttgtaattcttgctgtggaaatatttttcattgttggtaagttatatccctaggtattttattctttgtgctatttttaaataggattgtgttcttaattcggctttgagcttcgatagggtatagaaatgctactaattttcgtacattattttgtatcctgaaacattactgaagttgtttatcagttctagaagccttctggcaggctttatggggtgttctaggtatagagttacattgtcagtgaagtgagacaccttttcttggctgattgctctggctagaacttccagtactatgttgaatagtggtcaaagtgcgcatccttgtctcattcctgttctcaaggggagtgcttctagctttttctcattcagtatggtgttcatagatgatcatttttttgagatatattccttcaatgcctaatttgttgagggtttttaacatgaatgtgtgctgaatttatcagaggcattttctgtgtctactgagatgatcttgtggcttttttgttctgtgtatatggtgaatcacatttattgatatgtgtatgttaaaccaactttagatcacaggtatacagcctactttattgtggtgaattagctttttcatctgctgctggattcagtttgctggtattttctacgttcatcaggaatatttgccagaagattcatttttctgttgtgtctctaccagggttttaatatcagaatgatgctggtttcataaagtgacttagagagaagtccctctttctcaaatttttgggaatcattttagtaagataggtactagctcttttttgtacatctggtaaaattcggctttgaatacatttggtccaggacttttggttggtaggctttttattaccgattcaattttggaacttattggtctgttcaggattttaatttcttcctggcttaatatgagatgttgtgtatttctaggaatttatctagtctcctaggttttctagtttgtgtatacagaggtgctcataatactctcaggattttttgtatttctgttggataggttgtaatgtcagctttgtcatttctaagtgtctttatttgggtcttcttaaaattaatctatctcacagtctatcaatcttatttaatccttcaaatcatcaacttttggttttattgatctcttatatggattttagcagttcaatttcattcagttcagctctgattttggttattttctgctatgtttggggatggtttgctctggtttttctagttcctctaggtttgatgttaggttgctaatttaagatctttttgacttcttgatatagacattaagtgctaaaaactttcctcttaacactgatttagctgtttcccagagattctggtattttgtgtctccattttcactggtttcaaaaactttttttgatttctgacttaatttcattctttacctaaaagtcatttggtgtcaagttcaacttccatgtaattgtatggctctgatgggtctttctgatacgacttcatttttgtttgtgctgttttatttgtggttgttatgaattgaatttttttttaaatttattgagacttgctttaaggccaagcatgtggttgatcttagactgtgtgccatgtgcaggtaagaagaaagtatattctatcactgttgggtggagtgttttatagatgtctctgacgtataattagtcaagtgtcaaggttaagttcaaaatatctgttagttttctgccacaatgatttgtctaacaccgtcagtgcagtattgaagtctcccagtattattgagtggttgtctaagtctgtctgtagatctctatgaacttgttttatgactatgagtgctcccacgttgagtgacttaactacttaaaatagttgtcttcttgttgagttgagccctttatcattacgtaatgcccttgtctttttttattgttgttggtttaaagatcgttttctctaatatagaattagctactcctgtttgttcattttctgtttgcctgatagatctttatccatccctttacttcgagactatgggtgttgttacttgtaagacgagtatctggaagacagcagagagttgggtcttgcttctttacccaactttccatttgggtaaaatgtattttatgcatttaaagttagacatttaacccatttacattctgggtcaatactgacacgtgagaattgtatctatcatcttgctgtaagctggttcttatgtagacttagttgtatagttgatttataatgtcaatgaggtatgtgcttcagtgtgtttttcggtggtagtcattctttcatttccatatttagcatgccttttagatagtctggtaaggcaggtcgagtttcaacaaattaccttagctttggctttcctgaaaagaatttcatttctcctttgcttatgaaggttagtttggtgagatacgaaattcttgtttggaattactttttaaggatattcaatacaggctcccagtctttcccagtttgtaaggtttgtgctgaaatgtctgctgttagcctgatgggggtccctttgtaagtgacctgctccttctctctagctgctttcaagattttttctttctcacagaccttggaaaatctgatgatattgtcttggaaagggtcatcttgtataatatctcatggagattctctgaatttcttgcatttgcatggcaactgtcctaatgggactggaaggatttccatggactatatgttcaaatgtgtttctcaagtttcttgctctctttctcttgctggaataacaatgagttgtgtttggtctctttgcataatctcatatttttggaagttttgtccatttttaaaaattcatttttaatttttgtatgctcacgttgcttcaaaggagtggtgttcaagacctgagattctttcctcagctcggtctgttatacagttaatgtcaccagttgtgtttcgaaattcctgtggcaaatttaattcacaagatccagtttggttctttcttaaaatggttatgttggcttccaactcttagatcattttattgttttccttggattctgtttcaacctcctcttgtatcttgatgagctccattgccatccagattctgaagtctatgtctgacacacttcagccatttcagtctggtttgaatccattgctggcgagctagtgtgattgtttggaggcaagaagacacactgacctttagtgttactagggtcttggagtggttcattctcttttgtgaaggctaatcatcatttccctttgaagttactgttctttagatggggcattttgtttttatggtctttattgcccttgagagtttcacagtagaacaagttgggtatagctgaatgactttatttctggatactttaggggtcaaggctcagctccacactgctgggctacatgctctcaccgtgggggattaggaccaggtcagcagtttggcttctagtcccttgaggatgcgcctctgctgggctggagaggccaagatactcacagactactggcaacaggcaagttaaagttttaaatgcagggttttgagagaaacttcctgttatattttgtattaaacatatttttattctgtttaattcaagtaagcattaggtttttaaggaggaaatggagcagagggcatgtctggggatagaaaatataataaacctaaggcttcaatattagatatgggatattcccttatgcaaagagacaatatcgttataaattttttaaagcaatgtattattttttcattcatggattcaaaatgctgatttctctgcttcataaaaattcatcttactgcacaaattcacttattttctttcttacgtcttaaagttcttatatcttaaagttagtagaatgttagctatataatcattactttgtatgtatgtatgtttttatgtatttttcaaacgcctaaggtctttacggttacataatagacaaatattgttttttaattcatgttgttggactgccaagcaattgtagtggaggaacagggtcaagtaaactgaattgatcaaaataaatatttacgattgtggactgtggaggccatgcaagttaagaagggaagtgtggatttcacaagagtaatgatgacgaaaagtggtagctccgctaatataaactcattgccgtgatggaaatgttatgactgaagacataagagttcaaaggttcagcacgatatagctacaggtcatggcaaggtctggggtgaacatggcagtaggtggctgaggtggaagaaaagccctttctatctcagtgcaaagtccatttactgaatattagcatttttctatgtgcatttctctaaccttctacttgtccaaaaagagatatttttttgtcagtattagccattaaggtataagctaaagcaggaaaaagtaaaactttatatgaagtaaagatacataacgtcggctctccatttcattttattaagtctgtgggttaaatgacatcatgagaacagactgtggtagcattaaaagtgaaggaggaacgcttagtgtttccttccacatgctgttttccattgctgctgtcaaaaggtaatcatttcatctgtatttgacatatatttttgtataccatgaattagtgaactcaattcaagggcaatagttaagtgtcacttaaaacaacaacaacaaaaaacagaaaaaaagtcctctaatacctcatccaataaaatgattcaaagccttttggaggaatggctgtttctaggtttgaggtacacttaaaacaaggtgagcgtttttactgtcagaaagtaaggaagtgttaaaaaaaaaaaaaaaaatcacaaacaaaaagccacattgatgcaggcctgtcaaaggactcaatagctaactgaaagagttctcactgtccaaacctagaaaatggaggcaaaagaaaaaaaaaaagtagcattggataacccaaagtgtacaataaatatacttgagtgcatactgataaaaataaaataggaagaaagcccaatttccagtgcagaagactacaaaattatttacatggaaatatagccctcaagaaggcaaagtgtaactccccatcccttaagcatgagtagcacatagtgatttgcttccgaagagtgcagtgtggcaagaggaaaatataaagtgacttcacactggacagccctcagctagcatcagcagtgatgattcgggctcacagtgtataaccctgatttgatgtgatgagaagacagtttacctgtgtggtctgtctcccaaaaccccaaactccagtctcatcatgagaaaaacatcagacacctccctagggaggagcaacccatgataccccttgaccggtgctgctccaaactgtcaaagtcatcacaaacaagaggagtctgagaaactaccccagccaagaggagcctacgaaggtatgataagtaaatgtcaagtgtgatccagggacagaaagggaacattaggtaataaccaaagaaagtatgcgacataggatttttagttaataacgtgtcactgttggtttattaactgcaacaaatgtgccaccagaatataaaatgttaacaacagaggagacagagtgtggagtatttgaaaacactgcaatatctctgaaatgttcccataaatctaaaactgtcctaaaaaagtttatttagcaaaaaactttcagaactactgcattattcctctcacttctattacgtactcaactcttatcatttaatttcatcttatttaattttcctatgtgcgatggtgattcatgaacataactgaaatttcttttctaaaaatattatggaagttatgatagtttaatgaaacgtttcactttaatttaattagaaggaaacatttctatactgtcatctttccctccggggaaggaacactgtgccatcttattatcaggttctccctggggcactttttctctttgataaatttgttatagtcgtcaaagcctggaagacagtactagccaaaggagcttttctatgtatatgtataattctttcttttgctttaacgcagaagctgttagtgaggtattaaaatgaaaatttcccctttctctctatacctagaagactttagtgtctctactgagtagacttgatatataccattaacggaaaagccagtatgaactatgacagaaattaagacagaattctcagtaaaaatacgtgatcaaattgaacttaaataatataatcaataatgaagtgtatcatatgtgaccgaagcatggttttcacacctgccattttattgacccatcagctggataagtacgtccttaccctccccttttagatcccccctctgagttccagtccagggttagctttgaggaaggattaacagcagtccccacaacatcatcaccatcactaacgtgtgagttaattttttttaatacagcctacctactgttatgctgtattagagtacaatataattacagtacaatgtaatctttttctttattttcagaatctgattataggtgtcaggggatatcagtaataataaaaagaaagtcataggggctgaaggcacctgaaaaaactttttgtagaaggaatggaactttatctgtcctacggagtgaaaggaagacagcttgctactggcaggagtgaggagagaatgcccacagcagatctagagagaagaggctggtcagtcccactcaagcgactcacactgtccaggaatgagccatgggaagacaagggaagcagctaagaaatggtcctgaaagccaggagcatgaagttgttttttagctggatgttttctgagtagacggctagattataaaggtggcatttaggaaaataagcagctgcatccgtgtctggagcagactaagcatgagcagcagagacgtccaagtggttcttgtctaatgaatggccacctgctctaggatggcccaggagaggatggcaggaaaacggcctgctgagcaaagtctagagtgaatttaaagaacctaggggctaattaaacacaggacatgaagctgaagaagagccaatgatctgttccaggtttctaatcagagtcttagaaaacaatgattaaacagacaaaggtggggtggggggggggggcgatagtgggggtacgggcaaggagcaatagtggggacagggcagggagctagagcaatttgtgaagattaagaggctgttataggtagaaaaggagtgatgaatatttccaggcatgttcattggcagacctgaagaacgaagtcaaaaatggcaactgtagataggtgaaaatacagtgttagggtaaaataacgaaagcaagaaatatggagtgttttcaagtctttgcccacggggatagatagtttggatggtcttagaatacataaaacatgcagttgtccataaacagacttcaggaaaagacacaaaaaagtgtcatatctccaaaagcacctttcttcctggtctgtcaggagggtgatcatcctattcaccatccacacaggggcacttttgagaggaaaacagggcattatattttggaataatgagcacaagcatcttgtactaccccaggaaaccagagctgtcctcacccgtttgtagttttacagtccatcttatggagtctccttgatgggcaagtgacatcagaagaatttttttttcctccttaacattttagcccacttcttactaacattagcatttcaactgaagactcctactgaggaagaaggctcactggctaacagccacgtggaattgtggctgtgggatggtcgcggctggtggaaggataagggaggaatgcccacagagtgagaggggtaattaaaggtctgcatgactgttttcttcctcctcacttcccgactgcctgcaccatgccctgccctgtctttgtacagtgatttccccctcttcaaaccatcctcatacattttttaagagttcaatgtttttaagccaaaacagacttcacagtcatctaaataaaagatgtacacaactcccatcaaacacaggcaaatgccttcaggatacggccaccacctcctgctcttagatgtgcagagagtttcctggcaacctccaggccttgccaatgctgcttatcccactgtttctgagagcagccaagggattgtctatggtggaaaatgcccgtctttaagtcttgatatctatactgaagctagagaagaaaatttccataatttaatatatcataactaagtaggactcagcttatcaaaagatatggaaatgcactgcaaactttatgctctaacatcaagtgtgcttaacaactgtatcaaaagaatttattttctgctggctctgtttgtcaataatcgtttttgacgttttcctatttgacaatactgatagcattttctctgatggtaagaatgacctgtggccattgtagaaaatttagaaagtcaggacattttcaagaagagaataaaagttacctataatctcaactcttagaaatacttactgtgagtaaccatatgtaacccgtgctgtgattctcttgtgcatatttttttctttacgtttcaaaatattttcggcttattctgtagaaacatcatttagaaagaaaacctccatttttatatgaatagaccattattttccccacagtatatttaatcaatttttaatttaattttatctcatatatttgcctgtttgttgttgttacaacattgagttagtctgacaatttttaggggggaattaaataatatttcttttcagaagggttgcattctatagccgtgctcatatcacaccgttgttaacgctgaatattaattctttaatctttgcaaactgattgcattttaacttgcactgctttattcacccagctgcaatatttttcagcctgtttgataaccaactctattttctgttgtccgacctctactttcatgttcctcacccctgtgattttgtcttatttgtaagtgcttctctgttatgcatttttacaggtatttgacttggattttgtattttggacacactactgtactgcaattttatggaacgggggtaatgttcactcctccactcaccgcacaggtgctgagcaccagcatggcagaagctgtgccccgggacacaggtacagtggcaagtgggatggcctcgtcggtttcagattgttctcctggatcattgcttctgttgctttcatacatttcattcctctttcttctaaattttcatatagagccatttctcctttatttttcatttttatgtgttttaaacagtgggattatagtgcatggaattgattacacatcttttggaagggctgagagcgcaaaagaggaaaataattaaccgagattagtaattaaacaaagcaactatcacccctgggacagagagagcaaaagggaggaggagaagtcaccacagcccaaaaccttggtcgggggaggcttagagcttactaatttggcttttaatggtttgcttccttttcttttagtcgttatatctaaactacttaaatctattcagttttcaatgcgaagtgagaggttaaattgattttttcccccttaaattactaacaagtcaatttgactatattttaaaggttctccaaagatcacttttggacccaggagaactaatatatactcaaagttgagtcagtaaaggtgctggactttgcgaagaagccaagtaaattctcaaagcctcaattttatgatgtgcaaaactagaggttcaatgaaatcatttataaggttctttttagcaaagtatatatttctattaagcttttaaaaatttcatctgtggcatacttttgatttaaaatacttcttactctgcccataacaactattaggctatcaggaaaaaagaatttttggcacctttaaatatccaagcgttgtacaattgtttagctttgtgtataaatatttttgccccaattagtatacttctgtaactgtgattactgccgaaatgaattgaattagtatggattactttgtatagtacttaaattgggaggtacttaacaaatggccctcataatattgattatagcaaatgatagaattgtagtgctgtcaacaacatttaaatatatttgtaattcctttatttgtattccctctaatatacaggtaagtgtaacacccactactcattcaattacagactccgaaggtgaagtagatgcaaaacacagaagccaaattttacgggtggcatggagtgtacatgcttcaatatttccattattcacttatactctagatattgcgactctaatcggcgtccaacgaattagtcgtgttatgtactgatgagatttccttaaaattacttttctattaacatttgtcaatacattgtccctgttatataatccatgcaaagtaactattaaattgttataaattgctgtttttgaactttgacatttaatgaatgtaggtggaacataatcatgagaaattagctcactcgtttgcacgcaagttggcttaaaacagaagagcatgatatcaattgtaaaaatctcaaaaattattctctgtctagcactctgtctccctagtttttatcccctttatctctctctctctctttctctctgttcatattcgctgaagtcaccgtgtgaccattcttccttttagctttgcactggtcttcaataagtttcaaataccttgagtcaaaaaggatgctaaaacaagagtttgaagacaaaaagaataggtggatagcagctgctggtttaatcatccccttcctgtccctgctcaaatgttgaaacctaatattcagtgtggtggtcttagaaggtgaggcctttgggagattatgaggttatgagagctctgctctcatgaatgggattactgcccttgtaagacgtcaagggagctttttccccttctgccatgtgaggacacatagaaggcataatctatgaaacagagagtcagccctttctctagttgctgaatccgcaatgcttgggtcttggacttcccagcccctggaattgtgataaattcctattatttataagccttccagtttatgatattttgtaatcacagctcagatggattaagaaagtagcaaagtatcttcttcaaaatatccattaactgcagaggaaaaaaaaggaattttatagtggagatattcagcctacaccaccttaccaagtaattaatgttaacatcataagtgaaataacagatatatcagcccctgtaatttgagacactggaaatggctgatttattctgtagtattctgcccccaagttcataaattcaaccaaattatgggaaaatatcagaaagcctcaacatgtgggactttttaaaaaataggtgaccagaaatcttcaaaactgtcaaggtcaagaaagacaaggaaagactaattagctgtcacaaattggaggagattcaggagacaggaggaataaatagaatgtagaattttggaacagaaaagtgacagtggcaaacctggtgagttccagtaaagcctgcagtttagttaataatgctgtgtcaacattaatgtcttcagttttgacaattgcattctggttaatgttagcactggaaggcaagtgggtgaagtatatataggatgtctgtattatttttgcaattttgtggtgtctaaaattatttcaaagtaaaaactgaaaaatgtttgcaaggtaagccatgagatttattaacaccaaaatgagtctgctggactttttttgaaattagttcttacaggggaagagggcaatgaagcaacaatggcgggaagagggcaatgaagcaacagtggcagaaagtatgataaatgagaaaaatctatggcccacactttaggtccaagtcctccagtcaaaatgttgacaattctatgaggtaagtactgtttgctgaaaaagtgatccctgctaggagacagtgatgttcacatgctggcatgctgatggaagccgtgttccacacactggacgtgaactccatgagcgcggccagcatacactctggagatggaagagtcgccactttgtagaaaacacatggaatagcatcagtattgcagagaggactgctgaaactcaatgtgggtagcccaaggtataaattaaatatccatcaatccatatgaagataaatgattgggataaaaagtaaatgggagaaaaataaaacaaattccttgtgttgaattctaaatagtttctacatatctgccctcagaaggtggcatgtaactcccttaggagggctcccagttacttctttccagactacagtatggaaaaaggacaccagagtaaccttgcagtggacaagcctgacaaacacctctgccaggtgactaaggtcagcatctgcagtgctgagccacagtgatagcacaccctccttacattgtcatgggaatgacacttcacctctagttttcctcccaaaaatctatagctccagtcaacacatgaggaaaacatcagaaacatcacaatcaagagaatttccacagaatggtttaccagtcggcctccaatctgtcgaggtcatcaaagacaaggaaaacctgagaaaccgtcacagccaaggggagcccaaggagacgtgacgactaaatgccacatgaggtttgggatgggacccgtggatggaatgagaacattaggtgaaaactcagaacattcaatgcggtacggactgtagtcattaaagtgtcaatatcagttcattaattgtggcaaatggaccatactaacataagacattaataacagaggattgtggatgttgtatctatgggagcacttcatactgtcctcacgacttctctgtaaaagtgctgaaacaaaaagtatatttaaaaaactaaatcttgggagcaaggcacattaatttagaatgtttctgtgtttaatatctcattattttattagtatattactatactttttatattttaggtagtaataatattattgttttatacattttgagatattctatccacaactgataacctgtggttattgttaacccatttcccatttgggaaaagaaaaagcgtatctcactgccagaactcatttctcagggcaaatgggaaatgggttaaggaatatgtgagtattgtgggttatattaggttggttcaaaagtaattgtggttttagccattacttttgcaccaacctaataaaatgtcagtgacttcagaactaaagaagtcaatttttaaaaatatgtattacagttctctacggtactgataaaatttgctgcacggatttaaaatgctgtcccagtgagattaggggagcatctgagtgaggaataaaggcgtcaaaacagccttccagaggttggggaaaccactgggtggggaattgcactggctattcattcccaacacaatggatgaggcatctggtgaccctatgaccctgtggctgtaagagtaagcaggggtggaaaacccatgaatatttcctgacgtaaaacccattgaaaagggggtgggggctggtgccgacgtgtgctaaagatcattgtcttccaactggcaggcctataatttggacaaaacaaggtcattatattgaggttggtagggaggaggtatttttggagatatgattgcaattctgcccaaaagcaatgaccacttccccttggttcccgccctgaacacccactgatccctccaccccttgtaggcaaccatcccccaaccctcattccccagtgttgtgtgggagaagcagatgcgtcaacatctccaaagttcacgctgccgtggatggactttaggcttcgatgctatgtttttttgttttgtttttgtttttttcctttttctagttgacctttttctgctgatgacttagtttcatcttttctatctcctgcttcaccaaagctcagcatcacctaggctctctttgcggacctttttggttccctgctatacagtgatcaagacacttgcccactgcagggaaaacaaatttaagtatgtgtagaataactgcactaagtggacactctctgtggtaaaatgaccggaccaagatccctgaaaaaggaaatggtatagctggggtctgaatttctgttatgcgacaccagaactgggactctcagccatgactttcctcttcttgacacatagcactgtaattaatatagaatgcacttcaataaaggacatctttgacaaagcaaagcatgcattcttcatgggatgttattatataattaggaagaataaaatatccccttcaaatggaaactcaatttcattaaacaaccattaccaaagccataaagatcattgacctgacagcactggggcttattgagttctttatccagaaaaaagagaggagttatatgtgcactttctcaccagtgctcatgactggtcgaccaatgacacacatttcccagataattccggagaggagcgcatggtcaatgaatgaagcaaattagctgtcctattgtagtatagtctggccttgttactttataatatagaccattaactctacattccaaccacctaaactctctgttcaccgctcttcttttaaactgtattgcaaaaaggattataaaaaaccctctgagtataagcattcctttaaaggaaagttaaaagacttgagtatccattaaatcttaaaggtcatacatataattgcatctaagtttaggaaaacaagtcttcacatcaggtcttagcataaataatgtaaattaagatacatttgaatttactggcttctttgtttttaacgctttgcattgttaggtccataaacattctgtgtctaaaagaaacacaaaataataatgatggcccctcagtgtcagatgcattaaaccaatatcattacattgtgacaacgaccttacacattttgcctacaaggagctcaaggcgcagtaagattaaataaattgttcaagaatacctagttaataagtgggaaggtgtacattcattttatcacctaagctgcatatacaggggatgacaaagaactgagaggtcgcaccatcgtctgtatatcagcgccttcagtaagaattggtggaatattctggtctctgtcagcattaggattcgggagtaatagctgctccatgattaagcaatgctatcatcctctattatgggctttcctgtgtattaaactaagcaacttgatgatttgtttcaaaatttctcaccttagctccagatgacattcagaagtatataactctgagtactgacccagtatgttaatggtggttttggaagtagattctgagcagcattgtctagtacagtttgtattcctttccaagggcaagataagaatgttaggcggtgggcatggggggatctctgagtcaaagaagattttatgatgagagagttttcttttgcttatggaaatgtttacttgggggctacatttactacatgccttgcctcatttccgttaagtccagccagataccatgaatttcacagtagttcctaatacttcatacacagtgatctgtcgtctgtaattttattccaggacaccaacaagccctggctattgcagacaggttgtggtaccagaagcatttataaacctcaaatctgattacagggccctgaaacatggaagtgtttaataaagacgtgctgattaaactgagaatcaactatgtacttcagtgttcagagaaatattccaaagaaagaaaccaaaatattacagtgtgggaaacctaataaaaaccctgtcccatgagaaattccacatgtgcagataaaaaaaatttccttttctatcagcatcaccattttttcaagtgtcaaatgctacatatataataccaaattattgtgaaagtggaacttgaaaataataacatggaaataaacagaattttaaagaagaaaatatcttaaaatatattttagatactcataaatgtttataaatatgataccgtgaagaaaaatgcgttctcttttatggaaacagctctctcaacagcataccctttaagtagcacttggacaagaaggatccagggaccaccccccgcctcataacagatgtttggtcttgttcagtgttgttttttttgcaccgtctcagatggaatggtgttcctgtcacacctaaagcatcaacacaggcttcagcttttatcatacttgagcctcctcccttgggaatgccaggattctctaagaaagacatcctgctcaagattagaatcaccacactcctatgatttcaaacaagacagaagtgataaattacagacttttttttttgccattgccaacatggtaaagccttagccaattaagatccataaagggcagttccgaaatctacctcatggcaacgcacacaccacaatgcaacgcatctgaggcccatcactatgaagctacaaaatattaaatacttttggaaaatatacaacaaaggaaaactaatacattctaaacacttgctggttttttcaaataaagcttcttctatctactatctatgaatttgttgatcaaatagttgatactgtgacaaatactttattcaatactttatgaagtcctacccctgtatcagtgctgtaagcaatgctacttagaaaaggcatacatttctggaagaaaaataaaatagaagatttttttttgttattcaacaacctgctatttcatattccctccaacattaagtagcaacagacacgagtgggcctttcccagggccaaggcacgtgcacacactctatggagcaatgttgtgccacttcacatcagcaattcctaccggtcgggcttcccgacttcactaatcagtcctacagaacatcaaaattatgctacctaatttgagtagagaaagaggctactgtttgatcttaacaaatacaactgctctaatttctggtgactatcaacagagtggctggatggcttccagatcaaggtaatcatcttcacatcaggaaatttcctctgtcacccaggatggagtgcaatggcgcaatctcgatctcggctcaatgcaacctccgtccccctggttcaagggattctcctgcctcagcctcccgaagagctgtgattacaggtgccttccagcacacccagctaatttttgtatttttagaagagacggtgtttcaccatgttggccaggctggtcttgaactcctgacctcaggtgatcctccccgtctcggcgtcttaaagtgatgtgattacaggcatgagccactgcacccggccacattaaaaaagttcttaaataggtgtttgatgtttattcatcaggctttcaaaatactatctgttcatgttaaacaatgatgtagtctgacaggcagtcacctaaaacgggcccttcactgccacaaataaccgacgtggccccagccttaacatttgttctgaagggcaaatgcatgcacttgctacagcactgatttcacttagtacatgtttcttttcttagttttatttttaaattcatatttaaaatagatatttggagcttagtactaccgtattagtagtcttaagaatattaatctcctttcatttttttggactgcacattactacagtgtattgtttttaaggagtaagaatgttattaattgctgatttaatgtatttatgaatcagtaacagatgcaaagacaattggcatcatcctgtaggcattatccaaagcacatgctaaaaatagtaatatagtatttttatagagaaaattcaacccatacgttgaaaattataaaaatctaaagaggaattcatgtcgattgtaatggttgtttgtatttgtagagtgttaatgtctcatagcttaaaaattattttgtgtttctgggaaactgttaaaatctggatatttaaaaatatatgcttaaaaattaatgccagaattttctcagaaccagttctccaggaattccagagtttctcacccctcaacattcagatacccaacccagagcatcagcatctttcctttaagttcatttcctctgtttcattttaactttccctttttttatcactacgatttctccagtctgtgccatcctgtcttctctgtgataccttcttgtgtttgctcttctctcgctgtacccagaatcttgacttttacccgggaatttcaaaccttccgtccctggttatgacttccatcccactcaaacaatacacactatcagacattctcctaccttccatccctggttatgacttccatccaactcaagcaatacacactatcagacattctcctaccttccatccccggttatgacttccatcccactcaaacaaaacacactatcagacattctcctaccttccgtcctcggttatgacttccatcccactcaaacaatatacactatcagacattctcctaagttccatccccggttatgacttccatcccactcaaacaatacacactatcagacattctcctctctttacatgtccatcaaaaccaccttatctcccagtctccaatagagaatctcaatcccattgcttgtctaactctaaagaggaacttaaagcaagcctaaaataagtaagacctataagagagaaaggcctgttacggcagggcatgcagtttatatttaatcagagagaccctggcaagccatgggagttatctcagcctttcaggaagattacctgatgagcccttgcagaatgtattgcagacaaggatccagatggtaagggatagctggcagagaagtgctaatgatgactttaattaggggtagaaacagttggtttcagttgaagagatacaataaaaaaatattctgggctcttgggattaatgtaaagcggaaataagaccacagcagcaaatgttgaatccctcgtggatgactgaaaaaggtatagtatcatgaatagttaaaaggaaacttcgaggcagataatactattgatagaaaaatcatgaagtgtaatatgttacgattatctattgtatgaatgaaaggacagtaatcggcttcatttgaaagggactgagtttgagatacatgggggatatccagattaaaaaacataaaacggatgcacagaatttcaaaagccaattaatagagttaggataaatggaaagtttctgtaaaacggaatgaaggaaatttcttaatttggaaaatgagttaacacaatgccatcttgtggctaggaggtatctgagtgtcactcactttgtctaaacaaatgtaaatattttatgcttcaattatcattttcttaagctataggagcagactttttaaattaagtcactctacttttagatagtaattcctgaaacaatttaccgtaagtgacaaatgagcctacactcagaagtgcaaatttcttcttatgtgttaaataatcatggaaaatattttaaaagaattaagtaatgactcaaagcattatgtcaagatatgcttggtctccataatcaggaagttgagtgtactttcatatcatacttgcataattgttcataaatactatttctgtgggagcttatcttttacaacacgcagaagagatgcataaatccaaactggcaaaaaaaaaaaaaaaaaaaaaagagttgaatgtttggaagtatttttaagaatttaatatgaaaccatttacaataattaaaaatgaaaaactacatcaattaagggcttttacaaagagacagccttgaggcaatagtactttattttagctaaaatagacatatttctacaacatattcaaaaatcctatctgaaggcttatgagaattaacaagacggattttgaatatgcacttcaaaccgtgtaggtttcttttcatagccacaaatgacagctgtcaacaaatattctttaatgtccttattccaaatcgtatctgccaagattatataaagaaaaaaatatgactatcgagtaacaacaaaggatttcatgtctggtaatttaaaattttactctcagaagacacaatcatgttaaacacataattgaatccatttacaccaagcatctattttaccacattcctgatgaatgaatgtccacctcatttggactaatgtcagaagtaaaccaggactaaagatacagctgtctctgcccagctaaatgtaattatttaaaaacttacttctaccaacagtcccactaatgggcatctacccagaggaaaagaagtcattatacgaaaaagatatttgcacatgcgtgtttacagtggaattcacaattgcaaaatcatggaatgaacccaaatatccatcaaacaagtggataaagaaactgtgatacacacacacacacacagacacacacacacacacacacacacgaacacatgatggactgctactcagccataaaaatgcatgaattaatggcatttgcagagacctggatgacattggagactatttttctaagtgaagtaactcaggaatgaaaaacaaacatcatatgttctcactgatatgtgggaggtaagttgtgagcatacaaagggcataagaaggatacagtggattttggggactgagggggaagggtgggggggtgatggataaaagactgcaaatagggtacagtgtatactgctcaggtggtgggtgcaccaaaatcttgcaaatcaccattaaaaaacttacctatgtaaccaaataccacttgaactccaatagctcatggaaaaaacaaaaaataaaatgtacttgtttatacttggcagaaaaaagtaaaaataaaataaaacctgtctttctgtgtattcagtccttgatcctcccagtacctctggacccagcactgaataatcctgccttccctttgatttaaaaaccatttaaaactttgaaatcagctgaaacgtctcctcttcatcttctctcatccagctatttgttcaaagttactaatgctttgaaaacctgttgccatctctacgtctcttacctcacacacttgtaacataacatgttctttgtaattgttcaggtgtgacctaaccagcattaagtaagcatgcagttagtctggtcttattttacatttgcttttctcttactctacattataggaatgtttccagtgaaagtctgtacagaatgataaatattaagtgtatctgttctaaagcttttcattaatttaaaacacaaaataacatcaactggcctgttactttttctggagggagtgggctacttctagcaatactttctctcctctttgggtcatatattaagcataaatgaagaatacagaaccaggagaattagaaaatgcgatcatataactatgtaatccttgtcatccttctcttggtgagtgtaaagagctgatatgtggagggagtacttggaaattactattaatgaggtccccagaattagaccatagaaacatacgaaaatctcacataaacaaaacaaagaaacaaacaaacataatttggttagtgcttttttttctcagaaatgtaaaagaaaaatacaaaggataatatatcagtcatatactcagcagaagacactaaaatgttaatttatcaaaagaacaagagatgtttaagaaataaaacatttcaagtgaagtcaaacttctctacaaatccctccacaaatcgtagtatccacttccctccctaaactccacctttatttttaatttggggtaaacacattctaagatttttttattttcctgtatattttaaaattggcatgagtagttacacaaatatattgtttgcttctttatttttgaaacctattaaaaatgtaaagccttacaactactttatttaaagtactctaaagcataatgtctacatgaatattacaaactttatatatctcccgccctactaacaaacatgtgggttgtttccagttttccactgttataattctaggatgaatagctctgtgtatgtcctatgatatgcatgcatgatgtacttgctcatcatttaggaatattttttaactttcctagatattaccaatttgcttttcacaaattgctatactaatttacattttctagagcaatttgagaattaccacttctatgcattctcctaaacatttggtattccataatttttaatgctcagcaattggactttaattcattgtcatcccattgtgttttaatttgcatttcctgagtctggctggtataaacatgtttttgaccagtcaggtttcctcttttgtgccttcttcttggggaaaaagaaaaaccaactacttttttaaaactgtcacgaggagcaatcaagttatctcttattgaagttaattgggaaaagaaggaaaagagaaataaccataataataccacattccaagcctgggagatctaaaatgttgtcaatgtaacaggagaaataaaacatcgtatagagatatgataaatgacatattggatgtgttttatcaccaacatagttaagaaaactgttacccacagaagcgtccatttttatttatttatttatttatttatttattttttgagatggagtcttgctctgttgcccaggctggagtgcagtggtgcgatctcagctccctgcaagctccgcctcccggactcacgccattctcctgcctcagcctcccaaggagctgggacgacaggcaccccccaccacgcccggctaattttttgtattttcagtagagacggggtttcaccatgttagccaggatggtctcgatcttctgacctcgtcaggatggtctcaatcttctgacctcgtgatccacctgcctcagcctcccaaagtgctgggattacagacatgagccaccatgcccggccaaaagtatccaattttaaggtgtacctcacatgtttcatatgttgtccttagtcccccaaaatgtagaaaggtagttatcagtagaaaaccactgctaatccaaagacacacaaatacttaaaacagattctgtaactttctaccatatgtgtgtttgtacttcaggaattcattttatcctaagaatcatctgggatcctgtttaaaccccagagcactagggtcgttgtctagatcctggaatgaggacataaactgaaggcagccacaaatctgtgtttctctagggacccagataatgcctgtgctcaggcaagtatggcaagaactattcttcatcaagctgtttcctgaaaagttgcatttcatgcagtaagaagcactgtgtgcaaagacagccaccataactcccccactcactgctttcactcatctttgccattaactctaccctttcttctcttaagacatggtgtgtttccttctcatcccttgactgagctgagctatggacttgcttttccactacaatgcagaaaaagtgatgtaagactttgaagactaggctttcagagccttagtgattgagagaaggaacataaacagctaattatcagagtacatatgaacatagaactctgacccacaccctctgctgtgaccagtgcaggagaccaagccacaaccactgcatcaaccagctcagagtaggtaagacttggccagtgactttcagctaccctatttttgcccccgcttttgactccagaccaagcagaggaagtgaaatacactgctgggttgactggtgagaagtgggaagacggcttacttccacttagctcttcgccaccaccagcttccccatgtgaaaaacctccaagtgcaatgtgcctgaagccttcccctcttccaccatagggctttccctctcccctgagtttgagcggctgctaagctcaaatcatggcagctgccttgcttgttctggcaaacctgagtcaatagcctctgttctcatctgggtatgtccaccagcttctgccgagagcttcttttcagatgtcttagaaccctgaggctcccatgaagaatactgagatagtctccttgagcagaaagcacattaaaagagagacctagtcaacaccaagcatcaatcctaaacttgtgagtgggtaagtgagtcccagggttttgggggcaatgcgaccctgtgggacaccatgggtctgcagctgcatgagtgtccaaggaaagaccagcagaatctgtacagctgagtcaagtccagattgctgaccactgaaactgtcatgggcatttttgtttcaacgtgctaagtcttgaggttgctttttacacagcagatcgttctaacatttttcaatttacttgtgaggatataaactgaagagttatttgcatgtagctgataatatatcctggaataaaacacaagcggcaggttttaccatggggaccacggatatgtagggaaggtcacatgaggaggagcagtaaagagaaaatagagattaaaatcagagacacaaaattattcaaatccctcccaaaaatatgaagccaaagaacgtaaacttttaaaagaattatcagtccattggcatcaaacactcctgagccaaagaaaaggtaaagaatcacggtttgtgtgtggagatgggagtgtcattggtcactaggaaacttaaatataaaaacttgtgtaaatggctttcatctgaatttgctatgaattgaataggatatgagaaaagagcaggggttttttgggggggagggttattattattattattatttttttttgagatggactgtgggctgggcacagtggctgacacctgtaataccagcactttgggaggctgaggcgggcggatcacgaggtcaagagattgagaacatcctggccaacatggtgaaaccccatctctagtaaaaatacaaatattagccgggtgtggtggcaggcacctgtaatcccagctacccagggaggctaaggcaggagaattgcttgaacccaggagacggagcttgcagtgagcggagatcctgccactgcactccagactgggcaacacggtgggacactgtgtcaaaaataaaaaacaaacaaaaaagagagatggagtgtcactctgtcatccaggctggagtgcagtgacatgacctaggctcactgtaccctccgcctccggggttcaagcgattctcgtgcctcaatctcccgagtagctgggattacaggcgtgtgccaccacgcccgactaatttttgtatttttagtagagacgaagtttcaccatgttgcccaggatggtctcaaactcctcagctaaattgatctacccacatcagcctcccaaagtgctgggattacaggcgtgagccaccccacctggcctacaaagcagtttttaattaggtgctttagaaataaaaggaatatcacaaagttgaggcagcagaaaaatcattttctaaattgccaaggccaagaaactgaaggagaaattcagttatggttgtgaaatcatttaatagggaaaatacatagaacccaaaatgcagttttatgaatatcacatgcatgattatgttgagatggcagcagccactatgtagatttaaacatatctcatacatcctaggcccagtttcacttggcaacagctagataagcatgcagcaagagaaaggccttctgactctcgtttccaattaatgagtttggtaaagtgtcattgattaaattatcaatgttgaaaagacgtgagcactagcccagtcaccttcacactcctatactataattaaccaagaacctggaactccaggagcagaccttgaaaatctctgatccatttgccttcagacattcattgccttaaaaacagaaaaagctgcaatccttaactgatcatctttatatgccatattttcctatgtttctgtatcttttccaaagttctaggaatgtacacacatggagcacacggaacaaccatgagacatatgaaatatacctttccatcttaaatccgttagctagattgtaagatattgcctgtgtttcaggtattaacgcagaatatgccatttgccaatttgctacgtaatagagcaacacatatatagcatggctgccttcaaagaacacctcagtgaagggctaatacttctcagttactcatatctgaaacaaactcctcaatcctctcagagcactaacgattaattttccagattatcttctaagtattattattgagagcttattcatttgaactatcatccaacatacatctgtgtgttgtatacttctgagacaagtgcctaggtcttagaaaaacagtaattattttattctttcataagaaaacaaatataaaaattgacatatataatgaagttgagtaaaaatgtttaccctcctatgtttcaataatttaatggagaatgtagttattctcttgggttctaaatgtcctgtttccatcatgagctccactagaaatggttttcttagaacacaatcaatatttcgtcctattcaatatgcgatttttagtactgagtctttgaagaaaactgctcaggttctctcccttctgaaatacctctgggtgtgaatgagtgagatgaggcgctcattcagcctaaactcattgctttggagcaaatggactttggttcaacccatgtctgtggatgcccccagtagctgcaggaaggtgagatgttgtcattagggctgggaactcctgtgatagtagtagaatttctcctttctttccctattcccttgggcgtcttgctggccctgactggcttatctgttgcccagatcaaagagtgacattttctcttttcctgatcttaatcagatccatctgcaccttcctgttgatgcagcctcaccttagttttcagctgactttaaatttctggattttttcatggtcctttgtgcttctctgggctagagagtccgatacaaccttgtctacacgtctgttttcaccacagtgttcctctacagcaggtgcactgaatctcaactcacagctcaagaagttaagaaagggaagagttaattcacagttaagaaagggaagaggcacagcagaggaggtagaccctttccctctgcgtggcatatcccatatccctttcccgtgctggacagctccagggtgtcctggcacctcctgcacccacatgaacctccgctgggagacccagagagtggagctgaagccctttgtccctgctgtcctctgacactcccttagaacaacccctcctcttttagccagagatgagagaacatcagacatctggctggttttctcctcccaactgtttatcttcttttatcttctctcttactccagaactaccacaaagaagggcttttgctaattcttcataacttcagccccttcgctattcttagtatctgagagcattgtttgcattaagactaggggagtagtcccaatatctggtccagctagccaggctccagaagcgctaaagaatcataaaaaaaacaagaaaagcagtctctcatcaagaatagcagcaagattactgtttcgatgaagaatacaaatctccacccctcactccctacaccagttccccacctactgttttttttttgcctgtcgtggagctataactatctgaaagaaaggccaagaggaggatagatttcaggataaaattattaatattgcccccattatactaatacttctatctaaatgttttgataagactctgttccaaaagctagggagacataaacacaaacatgtatgatgaagagtctttgtaaaattagcagctacaaatgtttctgctgtgtaagcatttgtaaaaaaaaatgctaagtggaagaagagaatacaattcaattatgcatgtgaaccctcaaagtagatacacattaacttagaaaatgatagcatgaaaaccattacagtctttaattcggtagtgtatctagaaacacatataagtgtaattgtaagtctgacagtttttgtaaccgttgaaatattccccatttatgccattaactttagataaatatattctgttacttttaaaaatggaatgttttataatcattttgttctaattctatagaaggagtagctagctataatgttggcatgcatcacccatttctgtcttataccatctccatttgtgtttagtatttttaagttttactactgtaatgggaatgtatgctaaatatagaagtaattatttgcaaagcaagaataacatttccagttgggcacaatgactcacgccaatcccagcactttgggagaccaaggtaggcagatcgcttgagcccaggtgtttgagaccagcttggggaatacagtgagacatcatctcttaaaagtaaaaaaaaaaaaaaatagccaggcatggtagcatgcacctgtactcccagctactcaggaagctgaggcaggaggattgcttgagcctgggaggcagaggtttcagtgaaccaagactgcaccactgaactctagcctggtgggctacagagtgacagccagtctcactctgcaatgggaattgcactggatttatcgattgccaaaagcatacgaagaagatacttgcacagttaagtttatagcagcaaaattcgcaactgcaaccagcctaaatgcccatcaagcaatgagtgcataaggaaaatgtgatacacacacacacacacacacacacataaatatctatatatctccccatacacacacacacccaatggaataccgatcagccataaaatggaatgaaatcatggcatttgcagcaacctggatggaaatggagacaattactctaagtgaagtacctcaggaatagaaaaccaaacatcgtatgttctcacttataagaagtgggagctaagctatgagcatgaaaaggcataagaatgatacaacaactttcaggactagggggaaagggtgggaggcagatgggaaacaaaagactacaccttgggtacaaggtacactgcctgggtgatgagtgcaccaaagtctcagaaatcactaaaggacctattcatgtaaccaaacaccatctgttccctaaaaatctaatgaaattaaaaaaaaaataaagaaaaattattacccttctcaaattatgcacacttccccatctctcttttccctaagaagagtatataaccatctgcacgccatcacatggtcgagcaatcactctcatttctacgtccatgcatgatgatcaacatgtatgtgtttgatcctattttaaaaaaaacaagaacagctcccttctgtttatttagcgtgtgagcatgcgttttttcataaaaactgagcattagttacctaagcagaacattgttttctaattttaaatgtataagcatattcaactgaagattatctttccatgaaagaggaagtcgaaaaagatataatcttaagtggaaaagagaagttacttcattcaaaataagaaatcattaggaacatggaaatgaagaaagcttcgggagatacgtgatctgttgcagggttttcatgaaacttctgtgtgcccatgagcaatgtcaacaagcctgagactctttttttttttttttttttttttttttttgagacggaatcttgctcttttgcccaggccacagtgcagcacctgagattcacttttatttgctaatgaaacagacaatatgcatcacttgttctaagattctgctttaaattgcggcagtaagatgaagaaatagatattaataagatttcaaattaactagatttgaatctcaaaatacaaatatgtttgaataacaaagacatgaagggaaaaaccttaatactgacatgtatctcaatattacatgctaattatacaatatttataatcggaaaataatgtaatgtcaggatacatctttctaattaaaacaattttcttccaatgttctaatggctccaattgtcacaattttaagcttgttctttaaaacattctagagtaggaaaaaatgggttgtcatacacctgctactgaaaagacttagatgatttttaaatacctttgtctaggtcatacatactggtatcaatttctaacttggtatctctctagaaatatcaaatagctagtattactttatcagtcaaggaagagatatgccatcttttatgttgctaatgccacatctggcaaagtgtttagagcaggtggttctacaatgacaagtttcctgacaacagaactccaagtagctgagaatgtagaaggatgatctgtagtatgtggtgggcctcactccaaggaggctgttgtaatattgtggtgtggttatttctacttcggggtggacaatcgtctctactcttagtatgagttttaaatattcgttaggactgatagctttaaaagtttttaattatcctctttttaaattgtcttgctgcaacttcttttttttttttttttttttgtgagatagagtctcactctgtcaccccaggctggagcgcagtggtgcgatctcggctcactgcaacctcctctcctgggttcacgccattctcctagcctcagcctcccgagtaggtgggactacaggcgcccgccaccatgcccggccaaatttttttgtatttttagtagagacggggtttcaccgtgttagccaggattgtctcgatctcctgacctcctgatctgcccctcttggcctcccaaagtgctgggattacaggcatgagccatcacacccggccactctgcaacatttagctacagctttcaaacaaatgctaacagatttatcaattagtttctcatttatcaaaattattgatcagcactgttctttcacctatgaatgaccctatcttgtgtggtattttcttttcaaggtctttttatgtctaattgaaacttttaaaccataaaataactgacattctcaataaaaaataaaagtctctaattcacaaatccatttaagatgctccagaatatattcttgagaatgttttttaaaagcttcttccaggaaacagtcaaaattatttactgagcacctaatatgtacacagctttgtaaataagtatgagacaagtgttctgtaagaatctcagtcgtaacattcactagctggtgacttttagccatgtaaatgcttagagctttaagagttttgtgtttaaaatgggaataatgataaaactttgtgtgatcagcatacagattaataaataaagatgatcctagcctggaatttactatgtgtttaaatatatgacaaaccgtatttccccttgtgtgtaattcctccccacaaaaacagcaacaaaggaccatcattagtaatgagggagcttcaattctacatgtgaaaacaatttaaacaatacaccatatagtgaagtactaaattacagaataaaataattagaatagagtttcaaacataggcaagggctaaagaggttaacgtcatatgtgagaaattgatgagcctttcaaagaatgggtatgattttactggcttttcctcatgttcacgcttaagttcaatgtccttagcttaacattcaagaaactttcctctctgaatcctggccacctaactggcataatcccccttttttgtctttataccacccctggatcttgccatatttgtagttgtaacaccatcctagatgtcaacaatgtgaatttcaatcagcacatattgtagtctgcagctgaatttattagtacagaaactccttttgaaaaaagcagttttaccttgaatctaatgaagacttttgttttatacatcaggctcctgaattttcctcatgtgagtctatttctaaaagatgcatctgcttttaggaagctattaaaataagttttctaagccattaaggtgagagaaagatcccagattaaaagtgtaccaaagtagtaaatatcatcattttaagctctcatgagaagtaaaaggttggcttttttctccagacctcatctagggctctctggaccaatgtattagcaccaggttgataagcctttctttccaagtgaattcccacaccatctagtggaggtagacagacacacacataattaacttatggacagtatcagcatgccaaaagagagatctaaatacgagtacattaaaatagtgtatactctctgctctatagtaatttgtatttgggaaaatatagctgtggttagggaagtaattactgattaaatacaagccatagagaaagcagcttgaagcaagcttggaagttgcaaacttatggacatggaagaagttctggctctctggtttaatgaattaaaataagtaagatactagcaaatgggatttcgcagttcctggtcccataggaaactgttttgtgtgtgttataaattgtcaaagcttccaaatgcttttcatttatatatccatcctgtgtttgccgttccaggagcatatgtttgtacatgtgcacatgcatgtatgcagacatcgagattcattcatttgctccacgcaaattcttgtgttcagcaacatcacgagttctaaaaaagtcaataaaaattgccctctatgcctttcgtgcaaggcacagggccagccacatcagccattactttcattagagctgctggagtttgaaataggatggctgggatccagactgacctgcaatcttgaagtctttaaatttaatacaacccatattttaggccgttcaggctaatttgccttttttttcagattttttaatggacactttgtttctaagagtttctctctaatagagtgcatacagatcagtttttttttttttttcctttttaaaaaactattgatgagctcatgcttttaaaggattattagggcatttgaagaacattttttatttaatagcagaaaaattgaactcaacatggatttaccaggtgccaatcttttgtatattgcaatgactcagtacaataccaacttcacaactttattttagataatattatgtcttatattccctaagtattttaacaggtgtttcttaacatgaaactgagtccatttaaaatctgaaagttaatatacgctgagcatgcaatatgatatacttgattttaagaaaatgagtttttacaaagaaaattgaagataaccttcttcagctccacataaagcttctgtttgaagctgggagtcgaggattcatcaaaacaggggttccatccaaattaagagaaaaactcttcaaacggtttctgaaataacttaatgaatttcagcattgtatgcttatttaaaatattagatatatgtcttgaaacctgtaatcaagtcaaagtgcttttataatatttctacaggaataaaattaagtgtgctccaatcaaacccacacgtattgttattacattttattcaccaaagaggtgtatcagatgttagttgtttatgaccacaactattttatattatttggacatgttttaaaaacataggtaatttcaagcttccagtggcccaagcagcaccatcccctcacccagagaggagaacctcccaggtcagcttctaccctcccagcagtagctcccctgtctgatgtttgctttgagcctgtctagaccaatccatcatgtcctccatccctgtcacctcggtcaccacaagaatcccggattctgtgtcgtacccgaccctccatctcattttattctcatcccaaataccggaaaaactcacctcccatctaatcctccttctttgagaattcccttaacattccacctgaagctggcgtcccctctcttgaacatagtccccgcagccctgtccagcagtgcttcctctctcactcacccctccgttccctgggattggctgctcatcatcatttcctgactttccccccaaattcccagctttgactcttctgtcttcaggttactcacatgtagatcctcttattgaagccatccatcccaccctgctctcccgtgcatttgatacactggctccttgaaaatttcagcaccggactccctgccacattcctgctgctaccactgttataattcgtggtgacttcactatcctgctaaatggtccttctaaccccatggcttcctttgttctcaacctcctccccttccgatgaacttgtcttccattctctttcattaattagtcatatggtcagagaccagccctaataccaaccacatctacttctccaaaattgcgactttctgacatcccatgctcttatctctgttttgggggctcattccctccaggaacatcataaactgcaaatccaattatcattccccacggtctttgccccttctctcctctttccctccttcaaatctatacttcatcatcacactccttcccctgactgcaccctcaattcccttgttcctctctggctctgacctctccgctagccttattactgctgcgttcctgcagctgagagtgactggaagatagcatggagctaagcttcctggtctctctgtatgttcatgaccactcctctcccaagcatccatatagcagccccaaaattatgctcaattctcacagcctctttattcttccactcttgaagggagacttttatagaagatgctttgaatattacattactgctccccattctttaatcttgcaagacctatccctcatcacattttcattaatgaatttgcccattacttcatggagaaaatagaagcaatgtgaaaacagccgtcatatccttctctcacctcattcaactacctctttgcatctgtactgaatgcccttgatgctgtgagtataatgtcctcacttttttcttttttttttttttttttttcttttttttttttttttggagacagagccttgctctgttgccaggctggagtgcagcggcgcaatctgggctcactgccagctccgcctcctgggttcatgccattctcctgtcttagcctcctgagtagctgggactacaggtacctgccaccatgcctggctaattttcttttgttgttgttgtttttttagtggagacggggtttcaccacgttggccaggatggtctcaatctcctgacctcgtgatccgctcgcctcagcctcccaaagtgctgggattacaggcgtgagccactgcccccggccaaaatgtcctcactttttaaagcttccacttttacataagacattagtctgattactgaaagatattactcaaccaattttcttttccttatgagaatataaagatcatttctcctacgttaaaggcaaaacagtcaacaatgaacataactcttctcttcattccccctttctacaactattccatttccttacatttcattttagaacaaaactccttataaggaagtctctacttgacctctctaacttctctcatctaattctcttttgaaccacagaagtaagagtttcacacctgccattcgactcaaaatgtccttatcagggtcaccaatgacctacttatggtgaaatccagtgaaaaatcacctctcctcatcagtcatgacttagtatcattcgccagggctgatcacctcttccttcctgaaaggcttgagttgacttctaggacagtacacactcctaagaactcccccttttcaccatctggtctacttagtcggtgtttatttgttttcatctctctagagtctaacccctagagtaaccaaaatactcttttgacctcttcatgtcactctcttcttgcctgctgatgacctcatcttactgctagcaactccacttacgtttccatcttgatcctctctcctggacttcagcttacatttctagctgctcaaatggcatctgccattgggtgtctgattgggaatttacatttaacttgcctaaaaatgaactcctgattctcacatcccctacccacacccgcattaactccaatcttcgccttttgaagtgtcctctttcaaaacctttggcatcacccctaaaactctcctttctcaggtcaaccaatcaattagcaaactcgattggtattaaagttaaaatacatccagacttatccaaaaacactctacgccagagctttttacgtgcttttactgctttagggaatggtatttctccagaattccacgcgagtgtttatctttttctcagcgtagagctttccggaacactctatttaatattgaaactcaacctatagcctgacaatccgtatgccacttccctactattttatattatctgtcaccttgtgataggctatatatttatgtcatctatcaccttatgatatgctgtatatttcaatcatgtatttgtttatgatgtggctttctccactggaattaagacccatgagcgcagggattttgtgctgttttgttcaacgctgtatatgtaatctctagaaattgtttcagttaatcatcaataaatatttgtcaagcaacgaaagtaatttttgcaaagccaaactatgtttgaggcatattgagtgatacaaagatgagcagtggggggcaaaaaataagtttcatgaaggtgatgtttaatattaaatatgaacatttttaaaactcacttaaattttagctagtaatggcaaaaatggcaatttcttttgcaccaacctaagtaatgtgaatttatattaaatccattaatatttatcttacactatattaaacttatgtttataatattaatatttaaattttacttatattttcctatttatgtttaaatttatttggatggcacatataaatgaaagttgaatagccataagcaagacttgaactaaatatgttctatgggtacacagtaagtgaggcaataacaacaacaggcccttacactctaccagccacacttccatgcacttcacatttatttcgctcattgaatttttccaaaaagcctatgatgtcagtcatccgatatgattatcctcttttggaaatatggaaaccgaggcacaagaggattagtcattttctcaaggctaaaagctaagtaataaaactgaggtttaaactagcatgtcgtgactatgctggacactttctcaaatcaatgctgcatccatggtacagcgttcagaagagattttcagactattgccttagcattggttatttcacataggagaagtactcttacttcctggaatccaccataaatcctttgtcaacacaatgtattttactcaaaggagactaacccgtggttttgcatcaatggaaatgcttagcttggaaaagagaagtcaaaaaaggaaaatgatattatcatagcatattgaaataacttccacttagtttttttctcattttttttttcttctcaatttcctaagaatagaaatggtttagattctggcacaaactacttgttacctgcgtgaacataagcgagtttcttaacctcagttgtcaattgtaaaatgaagattttaacgcccatctatagttgtgtttgaaagagtgaagtgaagtcaatgtgcaacacccagcacagcggcttaacaaaaaattatagtaagtgccatgaaaccatcaccatggattcagaaatacactatacaaaacgtgagtttgtttgttgacaatcaaaaaagaaaaaaagaaaaacaaggttttgcttggcattgcattatcctcgcatgagacacatcactcatcgctaagctccataaaacaggatgtgtctattgcttcttatgaaaccatctttgaagttagtgcaccaccagacaccccagaaacagtttaagctgtatttgagtttgttgagtgattttagacacatgccctgggcggagcagtgcgtgcctccaagacacagcttagaagtgatccactcaccactttagaaatgcatgtggttatttttggtcaatcctaatatttgctccaaggagcatctcgtttcctttaattagtatcctgagtaatgccttctgttctgctcgcctgtcctgtaacagacatggctgtgacgagtgagagggcaattcattcagactggcttgtgttagaactggctgctggaaacaatgccagcaactttatttttggtctattagtaaaatgacagcactaattcatttcacagcggaaccaaacagctgtcagatggcagtgagcataatcgtgcacacattagaatttagatatgctgagtaggatttttccactggcaccgcattctactgtaatgtgctccaaagtccccccaaatggtgcaagtggctctcctggtgcatttgccctcagatagtgcaattcaaacaaaacaaaccctttgcaattgggcttccagttgtgaattcaacacactcaaaatgacagaatttagggaaagagagatgacaattagatgattcatgaaactcaacttttacttccccaacctcataaaaatgataccccaagagccacaaatttcaaatttctgataaatctactcatcatcctctgggcattaattagatgggaacaaggaatttgactagttgatattacttttcattctaagaagtttgaggagcacagagtcctgccttctgtaggcatatgagcttctgagacagataagacacccacaccaaggaaagtgaccggaggctgggactggccacacaacaggaagcatgggcactcctcctggccatgccttacacaaaaactacacaaagaaaactttcaacaagcttgtgatgtccaaatgataccagagaatgtattgtttgccaacaaagaaaaaaataatttactagaactcctgagtcatctggtgtttgatgaaggtgactaacaaagttgtcttgtcagttacagcaaaactattaaaatgtccactgtaaatacagctcgtattgagggccatttactttctctattgtgcattgagaaagtgggttaaataacaagaccaagctgacttaaaagggaagagtatcttgtttcctaaacgaggaaaatgttctagctttagggttgggattccacaccatagctacgggtcccctgtcttggtaaataaagatttattgaaacacggccaaggtcactcaagtattgtctatggcgctttcatactgtagcagcagagttgggtagttaccacagacaccagatgagctgcaaagccaaaagagtaactctggccctttaccaaagaagtttgccagtcctctttagagtgatcacccctgaattccagctcttctatgccacaggatgtcaatggaatgtttaaaaaatgaccttaacttttggagtaatttcataggaataaaatcactgctataatatataagggatgaaatgaaaacatatacaataacttttttaaaactcaatttttactatgactcttgtttaacaggctagaaggcaacttgtgtttaggttgctgcaaattcaaacaattgaattaaatgtgattaaatcaaaagtatgttgtaaaacgtaattttgtatataataaatttcattgtactctgttgtatttttacagtgtttaaattcagagtacagatatcttgtgctaatttcatatagtaatgtataaatgaaatgatacctcacttaaatttctaggaatttcagtgttaaatatattggaattcattgtaaatacaagttaattagtgcctttgtctttgtgaacttcatacaaatttaaatttgttatcacgatattcataaatagctgtagtttttccatgattcatgcatgtaagcattcctttaaaaacagtcaagtaaatacagaaattttgatacacatgtcagtattgtggcatatgagaaggttttgaacaagtgtgaaagtcttaaaaaatgaaaaatcagatgtggaatgttgaaagctcatatttatgagttaagatggataacacatccaaagctgaaacgtgttcagcatcttattcctgcacaaaatctcccatttgttatcctcctacacccggcaaaaatcacaggagaaaactgcaagtccccacacaccagctgtccacttactcaccctcctcccctccccaaatgtagctttccattccattattctaatatttaaaagcatgcttcacaaaaagtttatgcctgaatggaaaaacaaaatggaaacttcgagtacacatgtgatttaaatgactaccaaagcttagtcagatgtatacaaatcagtgttgcaagttgacaggccccaggccattcctccttccttattggtggtgtttctctctcctcagaggatatgaaagaatataaggttatattatgaaagaaccagtgtcaaaaacgtcttcaagtaagctacttaaaacaaactgggaagctgtctggaaagggcgtatcatcctctactgtcaaaaaagaggcattttaccctatgaaaggattctccattgatcaggttttaaagaaaagaattgggagaatacaaataactgcatgaattattgactgtttttaatagcttaattttacttctttatctcaagcttctaaacaattcttggacataaagattttcctatttagatttatattactctgatttgcaccaatgaatgaaaagtgaaggaagcaattaagaaatgtctgataatggaaaatgtactctatatgacaccatttcaagttgatcaattaaatcaatagttcattttcttgaaaccaagaataagcccatagttgaccagctctcagaatatgaaccttgtagaggtcaacagagtatctattgtgcaggtgaggccatcagctgccatttttctggctccatttaaagaaaaaaaatagcacaataaagggggaaaccttttagactaacatatcctttgaaaaatatacttacgtttagaaacacagatccttgtttgatagtaaaccatcaactttaggtagcaagaacatcagaaatcataaatttacatgttgcattcaaattcagaaagggaaatgaactgtgaattctttgccgactgatttaagaactctgaagacaaaacaaatatctgtatcactttgtcatttgggtgcacattcggcattgaatttattggatagcagactgtgaagccttttttaaagtttagcatctgcatatggctataaattatatttaatgtactatacctgtattttacaaaatgaccttcaaatgggagatttttaaaaaattatctacaaaatggaaatgaatttgattgatgaaattcgaatgcatttttaccttaacttacatacttcctacttatttccagtgttctcggctttgtgttaagtcaatatatgtgttttttcttctcttaatccaaatctatgtcattctctcacatcttctcctcgaattgcctcagactaacaaaagataatttaccctttctcagtgattttcaccccatattcttgtcattttagaataaaaacaaatcaacaacaaaaaacagcaagaatgcctatctacctaagttgatatttgagaacaataaaaatgtaaccctaaccaaaatatgtaactaggcagctcattgttaattcagaacatgccactcaacacttcagcagggatgaatttgttctgtgtactctgacttagaagagtatagattcatcattatttgactttttttcttttttttttttttttttttaacacataaaccagataaagagacaaagcacagagaaggagaaggtggacacaggcttcccaagatggcaaaggaacattagcacagggcataactgttccaggagaatgtaatatcatacataatttggaagaaataacaataccgtacttttagtttgtttgtctttgagacagagtctcactctgttgcccaggctggagtgtaatggtgcaatcttggctcactgcaacctccgcctcctgggttcaaatgattctcctgcctcagcttcccaagtagctgggattacaggcacccgccactacgcccagcaaatttttgtatttttagtagagatgggatttcaccatgttggccaagatggtatcaaactcttgaccttgtgatccacacctgccgtggcctcccaaagtgctgggattacagccatgagccaccgtacccggtcccatactttataatctttgaagccatcttctaggctaatctaggccaaatggaaggagaaattaaaagttttctataccagatactgaaccaaacagtttaggtaactaattctgtaagcctcatgccaactctctaaggtaggtaccatttatttttcatttcacaagggaaaacaaattgaggtaatgagcgcttagtcaccagcacaatggtcacactcatagtgactgggaaactgcatggaacccacacctcagaattcatgtgcttatccacatgtaaatatttaaattaattttccctaacactttgcatttctagcgtccagatagtatatagccaatatttgatggtgtttaaatagaaagtcatctgatttctagttactgtataagagagacagaaagagactattagacatcatccactctcatttttgcttattgaagttcattttaaataatgaccaatttttgtttttcatttatctgaaattatgtattaccaaatgtaatgtatatgcatgtaaacatggagaaatttgcccctgacacaagagtatactggaaaaaaattaataaaaaaatcttgggagagaagtatgtacagaagataaaattatgattaagatgaaaaatattaagaaatgaaagtataacaactcatgagttgagactcccctctgcaatggtttgaatatggtttgtctccaccaaaacatgttgaaatttaactgtcagtgtaataagtttggaaggaggagggcttagaggttataagttcaataagatcaatgaatgtctttctcttcagactagatttgttctagtgggactaggttagttattgaaacagtggattgttatacagtgaggttgcccctgtgtcttacctcttttgcattcatgcttcccgttttgctggtccaccatgtgataccactccacccgtttatgaggaaacccaaggccccctccacgtgtggccacctgatcttcaatctcccaacctccataaccatgagatacatctctttcctttataaattacccagtctcaggtaacacagcaacataaaatgaactaggaaacccatcaagtacaaatattaattaatacatattttgttactgaaaattgattatgaaatgggctctatggagttaacttgccctttactatattccttttagacaagtaactatttctgtgagtggatttctatcaagagcaccttgatttcttacattaaaaaaaaatcagccacagtgctggtcttagaattcattaaccatttgaaaaaatacacagcaaaggacttttaattacttggttctatttttcattcaaattccaattaagagccagagatccacttaacaatattcattcccacattatcatcagacatttcttaactctatagtattcattaattaattttttctgtgctcattgcaatgagctaaataacagttatacggagaaaaatacagcaatccttccacctgctcattccattcttctcaaacctaatttattttcacaattcacattttctcctacacgtttctgaatgctcacgaaagcatatatatatgtgtgctatgtatttgtacatatagacgttcacatacctatccaagtactttatcttttcaccaaaatggaatcacgtggcatatgcattcacatagctatgcaaatacttttatttatatttttaccaaaatggaattatgttgcattttttttcactttaatgtaccatgcacatcttctgaggtcaatacacataggactaaaaggaattatttttaatagtactagaacttacgatttttgatgaaaagtacacagcaacatagctaagggtgtgtgtgtgtgtgtgtgtgtgtgtgtagccagggcaaatgattagctaaatatctcaatgtgcctctgatatagttcagatatttctcaacgtgcaagagtgcgtgcgtgtgtgtgcatgtgtgtttagccagggcaaatgattagctaaatatctcaatgtgcctctgatatagttcggatatctgtcaacgtgcaaacctcatgttaaattgtaacccccagtattggaggtagggcctggtaggaggtgactagatcatggtggggcagatttctcatgaatagtttaccaccatcctctcggttgctctcctggacacagcgcaaaagattcaccaaaattgaactgaaaagtgtgtggcacctctcactcctccccttgcttccgcatttgccatgtgttgcgctggctcctcctttgccttctaccatgattggaagcttcccgaggcctcaacagaagccgggcagatgccagtaccacggttcctgtccagcctgcagaactgtgaaccaattacacctattttatcggaaaattacccagtctccggtatttctttatactaatacaagaatggactaatacagcctcacaagtggaatttctcttaatgaagttgcaatggtctattccaacggaatcagaaactagattttctgatgctaagattttcagggttaaatgtatattaagttcacgtaaccaacatataaagacatagtgaaaagttaataaattacagcttataggaattagactacttacattgatacctatactgatatgacagttttattatttttatttaactcactctaggcctgtatgtgaaaccaaattgtaatggaagaatgcctgctcaaacaaggaattcagaacaagaaaaagaaagacataagataactgacaacaatcagataaaagaaaagttgacgcctcaggttaacagaacttgtatcatcaatggacagaagccatctttatcttttcagtagttatgagatttttgacaacttgaagtctatacaatgttctttccagaaaaatagacttacaaaattacgcatataatttcacagcttcatggaaagagatatttcatggccctcaaattaagaaagatggatatatagaatatggacagtctcacagtggaccagaataatcagagttaacaccttaaattcacaaacatcccagggagggttgctcagttgactgcaaccatcagggtgcaactgtgagctggctaagctttcctttccttgaggctgatcctcaatgacacagcttctccttgggctctgtgcttttaactacgctcgtggggctgcccaaaccaattctatcattcattcttttatccgacacattagaagtcacaggtagcacataagcctcgctagattagctaaatttgtttctttagggcagttcagcgtctctcttctaatgacttgattgtcttaaagctgtactttcagaaggcaattatatctctgctatatccctacttttagaaaatgttagtgttcatgtactgacagcactaattcttttaaaaaattattttatcatagcaagaacgcttattatgagatctacccttataacgaatattcagttgcacaagacagcactgttgactatacacgcaatggtgtaccgcggatcccaagaacttacccagtgagtattttccaatgtcatttaacattgattaggggttctaatacagctagtgttcaaaacccctgcaaatggaggacaaacgagagatttcggtagcttctggcaactaagcctagagataactaaggtgaggaccctacttctacttgttatgaaatgaggaaggaatgtgtttacaggaaggatacctgggtttaccagtctaagttacctaattagcccagaggaaagtaattattgaaattttgcatttgtttcaagctctataattgttataaatctacaacaatgttacactatgggctaatggagagccagctgctcttcttgtgctagcacgttcttgaaaaggaaacatttctatcctgccaggtgcatcatgcatgctccatgctttaattcaggtggagtttgggttatcacttcaagggagaaataaatcagtgctgacattctaaataaagctttgagcttgaagagtaataatctagctgctctttctaaatccagatccacaggtgttaaagaaaatcatgcttgagggatgtgtcagagggaaatgccacacatattcagccaacagagtgacaccctggtaagaggaagccccgcccatcctaaatcacttcctgaaacccgaagaaaaggtctctctagcagcccagattcacttttctctggtgaaaattcaaggactgtatagaactgtaggccattttctttcataaaataaatgttcaatggattaataaatactgatccctcattttctgtttgtgaggattaaatttcatatcctatactgagcaatatttttaagaggatctgcttatgcatagtttataagtaataaactacgatccatactatagatcatataatctctttatctttaaatcaattcagtgattttttttaaacttctgcatgcgtgggtgtgttcactagaaagaaaatcaaattcaaatttttcaataccaatacttactggcagtttttctttcaggttttgaggaaatatgaactactagaaaaagttaagttgtggttgagttcagatttttatccaaaaatatttttgagtatgtatcatgtgccaagtgtcaaggattcaaattttccttagagttagttattgccctcaagggtacaaagagtaatggccagagagtaggcatatgaggtgccatctactggcttccattaagtgctctgggaattcagaattcatttaatccatgttctgtcttctccctgcatttattttgggacaatataactatcacttaaaagccaaaatgtgataaattgtcacatagaagcataggcaagcaaaaatgctatccttcgtttcatagtccagtgaaagtaattcagctttttttgcaaaggatctcacggagtaagttttctattgcaaggatgaaataacgtaaactcaattttctacccttcagatagggcagaaaggctcagctccaggctctctgagctccagagaacccaggctcaggatcatccgcctccgctccccactgaactcagcctccatcaactccgcctcacttctgcaccccctcctcctgtaaaccacattgctaagcattctcaaagacaggcatctgtttttctctatgcttctgcagggattcctccttactcaggaagatccttctgttgtctctcttccttgagaccttctattccgggtttgacacaaagtaggcatttagcgcacgtgctttaataacacgctcttcaggtcgtggcctgagcccactctgtgatggcctctacatggcccacgtagacctgctctttcccttgctcttccgccctgttttataaagccggaatgactattgagtcacaccaattacaccagtgttctgtttgattgtttcattctccttcactagtcactgacaataagcagtattcatttcatctttgtattcctgtaacttaactcagtattgtgtctctggtagaggccccgtgaatgctgattaaataaatgagagaagaaatgaatgagcaaatctgtgtatccacttacacttgtgcacgtataagtatggatagcaatgtgtatgagcacacgtgtttacatgtatgtgcatttttgagtatgtatttgtgtatgtgtgtatacgtaaataaacgtaatatatacaagaggaaacagtgagtgtataaggattgcaacttctgtagatgtacagacatgtggataatttctgctttcattccctagcagccatgggatctcgggaaactaaagtactgcagttaactacttcactttctctacgtgataataatagatcaccttatttcacttagacaatttccgtgaagatttcctaagaaaagacatgaataaagtctttgccaattgttatgaaaaattgtgtcctatctgtacaattgccttacactatggagaaaagttctatacaaagcaagtagtgattctagttaataaataccggagtcactgttttgattcagagctgctgctttctatccaaagaaaggttggattatgtacaaaacttctattttccgaaagctactggatcataaagaatacaattaacttccgaaaaaccttgttttacttataaaatgaactaaaaagtcaacctaaattattgcatataattcataaaagctagattttaaaaatataaccaatatttaaattattgaagtccatgtatgatttcccaaatattttagaaaacatttgaaattatattcataataaacacgtgcattaaaattgatatttagactttagaaccaaaataatgaacattttgagtctaagagttttgataatagatgcacgcatttccaacatttagcttacgtttttactaataagggcaactattataaaatagaagaattcctttttaaaatctaaagagaaaaatatataaagtacatcagagagagaggctctttggggaacaatttttagatgaccgtgtatcacccagtccgtatattttcttcaatgtcctcaagtctaatatgtgtcagcctttgtctcatgtcaattttctgacttcctagatgtttttcttaaaacataggtcagcttgatgacaaagtaatattttttaatacttgagattttgataaaagaagaaacattacacaaataaaatttatagacatagtacttcaaaactgggcatatctaggaattttaatagtaatcttattataaactatgtgtaatcctaatagtttctgttattaatttgtcaaagacagctatgcaactatgttggttcacaattaagactaatgtccaagtatagaactagcaagtaaaatcttacaacactgaattaagttactaccttcaattttattctatatttagcagttaaaatgtgttaatttgaatatatacacttaattgctgagacttgctgaggtctatattcagaaagtcaaatactgtaaataatcaatgttagtataaaatttatcagtgttcccactggatttccagagttaaattcaatgactgaacacgttgattacactattttaatttgtttctattctcattatgtagcttaatagttccatgtgtgaataatagtttatgtaaataaagcctattccaaagtactgccagacaacagttgagtttggtgtccggattatgtttattcccaaggttatcatgtttacatagatcttagaactttggaagattcttctcctttcaagccaatacatttcaattaaaattttatgcagcagtctgttaatactaccacaattccatgttttagttaaataaaaaaacatgaatttattataatatgaaagttcattttatatctaaatccagttgcctttatacgtcttggattatacatcagtattttattctattatttgactcataccaattacttggtgggtcaaataacaggatccgtgggcagtctctccaaaataaaaactaatgggaaaagaggaaatctgaggtatcagaaagagaattttgtgactctaaatcaacttgaaacatttttctaattattatcattaattctacttcatatacatatatatacatgtacaaattggtgtatttgcttattttatgcactcttaataaattctgaccttttcccatgacatttccttggaaagtaatagttgtctaaagtttatgtgtaaagtatttggtacttgcaataaatattgctataaaagctctcttctactctagattatcttaccttactcttccacttaagactataattgataatttttctccaaataacgcacactcatttttgcaggagacctggaagctaactgataaatagatttaaacacacacatactaaatactagatacaattttggtttagccaacaaagcacctttttgacaggtttttttcttttaaatagaggtttgtcttcacttgtcaacatcagactataatatcaccatttcaaatcgaaataccacaaaatcattttctacatagccacattaaaaaataaatccaagttactcaacttatggccctattccattttctagaaagtttttcagttgatcttttggagtaacaaagaaatatttttccaacatagacaatcttgccctattttcttcattataccatcatgaccaccagtaaacccagaaatagcccagaaatatttgatagaattattcatatagtgatttctcaacagcgatggagttttcacaacattaattttgggaatctaacaagaccaccttttcagctatcaacttcatcaggaggggagaaaaaaatgccaagttttctaaaatgtggaagcattatctattttctgaacaaatattgtatgttaacaggacaaaatatgcctggcatatagctggtatggattgctttagagatgcttttgtaatattctgcaaaaaatgaaatgatgtgaatttagagtttatatgaagtggtacattgatatcatcaatgatacaatcaaaactgaaagctaataacatccactgatcttcaattagcctgctgctttccaaagattaacttattccttgatagtaacgtacttaaaggtgatagaccctttccagccactgacgctggcttatgcacaaatgcggtggcatgaaagacattagaggcagaatcgcagaccattctcagcattattccacacgtaactttaagcaaaaggataagtcggtccattcctatgtctctgcaaagagaaccttctacactgtaattttctgctaatttcactacagccacccatttgcacaaaccacgtgtatattttaacttcccacaaaatacgatttttgcctaaatgcagagtattcccagtaagaatatataatttgtgacttagtagcaaatgacatcccaagtaaacagtgtgtgttgtaaataggaattggtttacacccctaacgatagattgctttttaaatttacagactccagagtttctgttacagacagtagctcttgtattacgtgtaaaaggcaatttaaaatctccatccaaaacaaaagtagacacacatcggcctttaaagtattaactagttcaatttcttaaaacctaatacttgaaatgataatttccttttccaaagttctatctctgcatttaaaaaaaatttctgccaaaagccgttttaataatgatagcaatacctcaaaggtatctaggcacaaaatctgaagacatgaaaacaaataagtctctatgccttgcatgatcaaacaacagtaaaagcaaattaattttctctcttaaaaatttcagctttgacaacaaaagttcatttaatgaaatttcctttactcaagcactatcagtataattgtccaaccaaaaatttaatgaaactcttctgcattaaaaatgaactctttaccacgtaagagggctattagtttatagtcaaatttctcaaaacttattcgctacaaattaaccaaaacaaaaccccaagaagaaaagttctagtgataagaagaaaattgtgaacacgttttgggctggaaagtttggcgattataacagtgttaccaaatgccattgcattacacagaagccaaatgtctacaccacggaacgacctgcgacatagcagcctagtttgtcattattaatccagtgtagcatgtattagatcatttggacagtgaatgcatgtgcaaaacacaaccaatctcctaccttcatataatgctttgaaaccttgggcactcacagcgaagtctgtcgtgaaccacagagtgaggatagatcctgtactcactatagaggagggcagctgaaatcccgataatctaaatttaaaagacaagacacaaagagagttaaaagcatgaatttgtcaaaaaaagcttatttgatgaagtcactgaataacttgaacagtggtatattcacttgaaatatggcattaaacacttagataatccatacacatagctttggttgttaagtatttgaaattaaacattttcaagtatgagaatatgtttatttaaataacttgagagaatttcttcttgaaaatacttacttatataatatgccattgtcttaaatgctcctcgtttttggatggcaattatctactgccaacttttttttttatttgaatttttaagttatagggtacatgtgcaatatgtgcaggtttattaggtaggtgaaggtgcgtcatggtggtttgctgcacctctcaacccatcacgtcggtatgaagcccagcatgcattatctatttttcctaattcactatttttaatttttttctaataaaaaatatgacaggtaaagcatgtgaatgtgtgtataaacatttgtgcactcaaacatgaaagtattgcaaaaccactgagttggtcgtgaaacaatctgtgtttcagttggattccaagctgtgctcttaggaaaagtgagtgagatggtcaggatagcaaaggccccgtgcaataggctgtgagccgtctagagggcaaaccaatgctgacacagctctgtgatccacaataggactcccaacataagaatgctgagaatacccacattctggtaagtagcttattttttatgttataaaatccacaaactcctgtgctgtgaagcctggtctgtcctctttcaccctcctaggagccctcctccctccctgtcttttggtttatcacctttcttatctggtacaattcacggggatcttcaactctcaaattgtattcatctttgtaaactgcagtatctgctgtctgcttttattttttaattcagtccccttaaagagactcatttgttcattttttcccattggatgccaatccaaacaactttcagacagtgcattcacatgaaggagtaaatgactgatgaatggaaaaagaaaccattgtcataccagaagacactgctttgtactttatgtgttagcgaacgcaatacagaagacaagtcagtgaagcaaacgttgctttaagaaaggaaaaacaaaaaacaaaaaacagtgagtttaaattctcctgtgactgaagaccagcaagaatacagaactcatcaaccctatataacagtatttaatcaatatttatagtacactttacccagcaagaacagagtacacatttctttcaggtgcccacagaacatataccaagataaaccatattcgaggccataaaacaaacctcaaactatataaaataactgaaatcatatagcgtgtgttctctgaccacacagtggaatcaaattagaaatcagtaagataaaaatgacagaaaaatatctaattacttggaaaataaacaacacacttctaaataatccaggggccaaagagaaagtctcaaggaaaataaaaatacagataaactgaatgaaaatataaaatacaacatattaaactttgtaagactcagctaagcagtgctgagaaggtaattagtcgcactaaaaacacagcttagaaaaactcccaaatccctaatccaaattcttattgcaagaactataaaagaaaaaaacaaaaaaaactaaagcaaacagaaagcaaaaaacaagaaaagtacagaaatcaataaaattgaaagaaaaaagaacaaataatgaaagagccagttctttgggaaaataaaattgaaaaagactgactaaataattgggagtttcagaaggtacaaagagtcactgtcattaaacatcaaatattactatgaactcagaattcatcataaagataataaaagttactacagaaactacatatgtaaaattggcaactaagacaatatgggtcactaactcaaacaaatgaactattacaactaaccaatgaaaaaatacataatatgaattatcctatagctattaaaactttccccaaatttccagttccaaatgttcccactggagaattctacatttaaataattaacaccagtcgtacacactttaaagaattaacactaattctacacagtctcttccagaaagtgtaagtggatagaatgcttttgtagtaattttgtggcattgacactaccctttcccttatgggctgaattatgctcctcccaccaattcatatactgaagccccaacccccaacataactagatttggaaatggggctttacagaggtaattatagttaaatgatgtcaaataattcggactctgatcccatagggtaagcatacggtaaaaataagaaaagagaaggattcctttctccctggacacatactgagaaaagaccatgtgagcatggaacaggaaggatgctgtctacaagtcaggaagagagccctcaccaggaactgactattctggaccctgatctcagactttcagactccagaactgtgaaaaaataaacctgtatttcttaatccctggaacttatagtagtttgttatggcagcctaaagagactaagacactctaatatcaaaaccagataaacacagaaaaaagaaaaataaaataatgtctctcatgcatatagatgcaaaaatccttaaccaagtaagagaaaatagaaataggcaagatacgaattatacacgatgatcaaatggtgtttattagaggaatgttagaaaggtccaatctttgaaaattaatccatataatctgcaatattaatgggctaacaaagtaaaatcacaagatcatagtaatctatgtagaaaaaaacatttgacaataataatcattgaacatgagaaaagttctcagtaacatatgattggaaggaatcttctccaacttgacaaagaatatctctacaaaaataaaaaaaatttaaaaaagcctaaagataacattttgcttagtggttgaagactgaatgcttctgcctaagactggaaacaagtcaagaaatttgaacaagtcaagaatgctttgaacattcttattcaatatcgtgctggaatatcctgcaaatacaataatacaagaaaagaaaatatatgcgtatgggtcagataggaataaataaaattactactatttgaagttggcatgatgatctttatagaaaatgccaaggaatctacaagaaaatttgtagagctaatacttgatatcatcaaacgtgcaaggcacataatgaacatacaaaaatctattgtagttctacatactagcaatgaacacgttgacatcaaaatctgaaatacatcaatcacaacagctcaaagaaaagcttctgtataaatacaataagataagcccaacagtgtatacagaaaagtacacaacactgaagaaaaagttcaaagaaatgctaaataaatggacagatataccatgttaatagtatggaagatggaagactcaataatgtaaagatataggttacttccaaactgatacacaggttttacacaatttccaccaaaatcccagcaagaatttttgggtatatagcaagatctttctaaaatttatgtgggaaggcaaacaaacaaaaaaaaatagaatagctcaaacattttgcgagagaagaataaagcaggagaaacagttcacctgatttcaagacttattttatatctacaacggttaagactatttggtatcggcagattggcaaagacataaacccgtatgtcaatggatcagaacaaagaacccaaaaataaacctgaacaaatatctccaatttattttcaacagattcaaaagaaattgcatagaataaaccaacaaattatgatggatcaattggatgtccatagcaaatagtaagtttaacaccttatataaaaattacctcaatgtggattacaaatataaatgtaaaatgtaaagcaattagactcttaggaaaaaaataggggaaaggcttttgagtctagggctagacagagtttctatgcttgacaccaaaattacaaaccagaaaaagataagttaataaattggatttcataaaaattaaaaactttggctgcaaaagaccgcattaagagaataaaagtgtatgctgcagactgggaaaacacattcgcaagccaaatatctgacaaaagacaagtatctagaatataccatgaactctccagactcaacaacaaaaggcaaacaatccaattagaaaataggcaacaagcagaaaagtcaggtgacctaaaggacatccagacggcaaataagcccacgaatatttactctacatcaatagacatcagaggaatgcaaattaaaaccacagagaaataccgcacatgatatttcagccaatcagaatagctgaaataaaaataaataatgacaacatcacatgctggctagaacgtggagaaaattggttgctcttatactgctggtggaaatataaaatggtacagccattttctgtagaaaacagaaaacttccgaagaagtttgacatttcctttaaaaacgaaacacgtaactgccatctgaccaaacaattgttcttctctgcatttgccctagaaatgctcatgatgggaaactgtccctatcttcaccataatgcatcaatattcggttgtgtaattattataccatagttttgccggtggtttccacttgagaaactggtatacagtacacagaaactctttgtataatttcttttaactacatgtgaatctataatgatctcacattaaataattaaatacattggaaaggttgagactgagaggtactcaagaacatattaagattaaaataatctagtaaccaaaataatgctatttaataacaaaacattaaattctaaaagtaagttgaacaaaaactattgaggataatttagtaattgcccatcttgaagttttacatatatattcgcctaagttaggtacaaaataatgtgatagcacttaattaaatacaatttcatgtccctttaaattattaagttttataaaaaattgtgattacgaaggggtgtggtcaaatgatattagttcaggaagtaggaacaagatactaagggatttttaaaacgagtgtcataagactactgttcagaggtttggggtaatttaatatggacgtatgtagggaaaatatatgcatgtgatctgatttcaaatagctgcaatgaaatggattcattcttatttgtgtgccaaaaaaaaaaaaaaaaaatagagtccaacattagttgacagggatgcggaaggatgagtggatccaattgatcataaagagctttcaagagctaaatttgtgattaaatgtttatagccatttactccacactggctgcgagtaaggaatcttataaggagctggcaagactcactccttggtggctcacaaatgtgctcctgaagacatgaaagtacttctgtgagtatcctttccatgagggcccttgcgatacattttattcttgtctgcctcactttgaggaatccctgcttcttataagcaactggcttattttcaacacatagtaaattacgaaacattttgaagtaaaatggattttgaagtaaatcccaataatccacacaggtgtcttgcagtagcaagtcttccttctgtcattcatatttgatggtccagggtagtacgggaatattttagtatatgcaacgttactgataaactttgaatatttcaacaaaatatgacatatgttactccctatcgtaattttttagtgttttacaaaaaatacaagcatgctaaagtatcttcattttagagaggtagacatagcccaaaattaaagaggtatacattaaacattttaaaatgtgttttccaaatctccaagggattatgaaattttactgaagaaaactggccataaataaaaggaattattttgaaaaaaaaaaaaatcttatcgcctatggatgtgacagagagactgacattaatttccagacagcatatacagaggctaggtaatcaggaaatagactggaatctgtgaattaagaagccttttatctatagttaccggacaagttttccagtaaaataacttattttttataagttattccaatttctgttctagaattcatccaaaatttgttgtagatataaaaagtttttttaattatgtagtatatagcatataattttgaaaatcctttttatatattttgtatgtagtatatatagtaaacctttttatatactatatatacaatatcataaacatatactatatagagcatatatagtaaacatacagactacagtttatatatatgacatatatagtaaagtttttatatattttataaagactgtagtattttatactgtataatatataggatatttactatagtatagtatatatacacagtatgtgcagtatagtatatatactataaattatattgtttactatataatatagtaatattttgttattcatattttatagtaatattttattatataatatagtaatatttttattatataatgcagtaatattttattactatatacatttattatacaatatagtaatatagtaatattttatattacaatacagatgatattatataatatagaaatatagtatgtaatattacatgatacatagtatactatattatgtactatattatagcagaattcaaaagtgggaaggggtattagtatcagatgtcaggtgtttcagctttttattttatatagaagagaaattatggtagaagtattcggtcactggataagactggcctggtctagggatggggacaatttagatatcaagaagtgatcagtgatcatgtccccacgagaactggtgtagacggaacagccccagagagcttgggagatcaaagagcacaggtggctgtggctcctgggaggtcaccatccttatagaaagcctctcctgccaggtaggggtggtgaggacagaatctacacaatgggtaagtccagatgggtgtgcagggaccatctaacgattcctgagcccaagagaggcacacgccgtgccctgaatggtcctcagtccaagagatcacttgagttatgtggccttggtgagcaggtcttggtactgttgacaaaatactggatgcagtgagttacatgtcaaactgtgtcaggacacggcagagggtgatctggaaccaggtgctttatcaacccctaggtaccttggggtcatagaactctcttggacttagataccatccggggaagatgcaatcaagcaggcaaagttcagaagagacttaatcaaatacacacacacacacacacacacacatgcacactcaaacacacacagtgaatcatgtgagtatatatacatcttaccagattaaaatgtccgccatcatttggagagagactcgaagtaaaaattattgtaaattccatgtaataattacattatttttatacgttaacttttggcctcagaaaatagtacctattacatttatgtatttttctgttctattcagcatatcactaatttgaaactattaatataaagtatataaatctctcaatagaaacttcaattacagatttttatcacaatgtataacccatacaaatatatgcatgtttaacctattgaataattctttttcttaaaaccctgttgaattttaaagtcagggatcactacttaatataatgtctctagggcacagactgccctttatttaaggcactttatttaaagttatgttttcaaatgtttttctgactccttgctgtgacacctcattggcccagtagtaaagatattccaagtagctactgtacttgaagcctttcattgctattgttaagacatgaaggttacatgtctcgttttcatatcagacaatatcaagagtgaatgggatacatctctgatgcctgttttcctcctctccaaagcacccaccacatctatgtgaatctggcttcacttaaaaggaaaacaaacccatgttcacttgtactgtgtccactgaaccacacattctaaacacaagacaactaggagactatcaacttgatacaaggaaaatcaggacagcttgtaccaagacaactacttcacatctaacgagtcccaacacctttctctatcatctagtacctactagggattaaaagtaattctaggtagcttgttatcttccttgtaagctgtagttcaataggaatacctaaatgatttgctaatgcaatatggaaatggtttttcacattaatttctggagtaaaaaggctgcatgcctggcatatgtgtatctctctctacatgtcagagcaggtatacacacagaagtatgttaacatgtattttcctacaataaacttgcaacttaccttatgacactttcagtaatactagatgtgctcaagttcctttaggaaacacggaaactacagaacttttagggcttattaaaatagctgataatgtcatattaataatccagggttcattttaaatttggttattttgtgtattatttatttatttattgagaaggagtctagctttgtcgcccaggctggagtgcagtggcgtgatcttggctcactgcaacctccacctcccaggttgaaggattctcctgcctcagcctcctgagtatctgggattacaggcaccaccacgtccagctaatttttgcatttttaacagagacagggtttcaccatttggccaggctggtctcagattcctgacttgaagtgatccacctgcctcatcctcccaaagtgctgggaatataggcataaggcactgcacgtcggccttatcttaggtatttttttaataagagttttacatacttacagtgtacaatacaatgtctcagtatatatgtccatcataaaatgattactactggtaatcagtttttttctatgaaaactgatatataattggattattatatataatatatatttatataattggatagaattctaaaaggatcatgcctgccttacacgaatatctggttatgttttaaaaacatcatgagatttcaacagtcctatcacttcttgttgaagagaataatttctcatcaattttgcttcactgctcttcaagagctttacatgtgtatatgtgtgtatacatagatatacacacattttacacacacacatctacatatacaaactatatcggacaaagaaaaagcatcctcctttcacacaatgttttgtgaacagtggctcagtttggttctttggcaactcctcctgtcaattgggaaacagattagcttatataatttgtagaattcaagttggatcagaaaattgcaaaagcgtgagactcattacagaaggatttggtccatactgatttaggaggcaaagaaagtcaaagtttagagactattccagagagagaaacgaatgcacagaggagggcccttcatgctgggtaccccaagagatggaccccaataccccaaaagaacaggagctccatgagggcagaagtgggtctcctgtaacccacagccgtatgctgagattctagaagtgctccacccgtatttgttgaaatataccggcaatcccctcccatcatacccaggatctcattggctcgggaagaaatccacgcccattcagttaagttctatgaaatgagggaatcctctcctccatttttggccaagacttggggattcaatcagtggtcacccatcagggaatgaaaaagacaagaggcaaaggggagaatccactggaagctgagctggaagatgaggtctccttaagtgccttcccactgaaatgaaatcgactgcctgagttttcagaatcaaccaggaagtataaaagcagaaacaaaacttaatgtttaaatcccagaagtgaggtttataaataaagctaaatgtgctgattccacaaagcaaatctatgtcagaatctatcctacgtgtgctttcctaagcaaggtgcccctttatctcaggagttaggccccagctttctcatgccatgaatactgggtcggagaagaaattttctaaaatcacatcttatgttttggtgctgaaaaaatattgcagttaaaccactgcatattgctttaactgatagttttccttcctaaaaggcttacatcattaaaggcttatcagtttattcaaatatatcattgtttacctcatggttatgacatagtctaccttctcccgggaccctgagaggaatttcatttggttatggtgatttaatagacatggtatatcataatttgcactaaacaaaaatttcctcctaagaaattacactctgatagacactactctctaataaaagttactctggggaagaaaataaattttccccaaattgcattctagacaagtttgtcaagaattcaactgatcctcttttttttaatcaatgcaccaagttattttgggcaagttataattacagtgtctgtaatagactatcggaaacaaaaaatctaaagagattttgcccccaagcatgaaacagcatccacataatgtatgtttatgacaatcaaaccatttacaaatgacattaaaacagtaacagcgtttttcctgtcaattgtcactgcaaatacttcactccagtgttgtcccctccactctttgccttctgtgtgatcagcaccagcttctcctgaatggtaaggatccataaattatcttaacagtgtaaaattcactactagaatttttatatcaagatgtcctttcaatcttttctcccctcagttatgccacttttctctggaaagacttcgcataagacctgtgcttcttcagaataactcgtggagtgtccattttattttcttctatgatcattagtgttaatatatttaatcttaaacagaccacatgactgtagaaaaagaggtgaggctctaaatgatttgctcaaaggcaagggaggggagtaggtagtgacccctagagtttattccaggtctgttttcattatctcaacaacattaaaaaaatagtgaaatggctcaaagatgttaaataataatatgcaaatttattttatcatatctcacaaactgtatttttacttcgtgattttcttaagggtgaacctaacgtctataaaattgaaaccaatagttgggaggaattcattgcacttagaaccatacgcacaaacttagattgaaggaggaacaaggtgagaggagagcgagtgagcacacagtcaggagaggagggcagagagagaagaaagtagagagaccaagtagagaccaattgctactcagttacactttataacacccgaccctgataatctacaccagccccggccccatttcaaaactttgctctgaggctacctctttgtggcaaaaaccaaaaccaaaacgaaaaacagacaaacaaaaaacagaggctaactggaaaggaagaaaagatagaggaatgaaacaaaagaatcctaaatcctgacagcagaattaagacaatggaatcaattgttgttctaacaattttgaaaccaaacttcagtaacctggcatgtattagaaatgtagcaaatgcttaataagttggtaacatacacatccaagataaagtactacgaaatgtgggcctattttcttggtggaataaaatttattatatatactattaaaatatgtgaatgatatgtaacaattgggtaaatgggaattacttcaaataaacacagtattgttttaaaagccacggcagtaacttacatttatgcacttcattatatttgtcaatgtattctcaaaaggcctgcaaaaatgtgtaaggagatttggtagtgctcacagactaaaacagacaggattagaatacagaaatattggctattgagttcaaaaaggtgattatataaaataaatccttgctaaagcatgcatggattataaaaacatgattggcaattatattgcgaagtttgaaaaagtaaaattggaatttaaaaattttgtcaaatgggttatgagaaaacagtaaactcacacaggaacttaactgttttccaggtgtaggtttttatgaggcaagagcccagagactaggcagcttaagtaacttactcaaaggactgcttgtagaatccccttccctggctatgaacttagtgattaacctacactaaggcaggtttcatgttatgttgatttcctagatttggagcctggtgaaaagaaatggactaatgacacaaaaactcaagtatcaattaccctccttggggtgtctactaactgctggtaaatgctcggagtgtgaaaacactgtattctcacaacatccataaaacacccttatgacttaaagacaggcagtaaagctcactccttttgcaggtgaggaaacgaagcctcagagatccttaataactgacttaagaccatgcaggtggagagcaggagagacaagattcaaaccctggcgtctctctccagagcctgtgcttttaactcctgaaagttcacaggagatttcaaaccagggccatagaggaaataaaaatatatgaagccaagcagtaattttggttattgattagaaaccaaccaacaatttagatttctttagcactctgttgtataccaagggtctccaaccgcgagccacgaatgtggctgcccatcaaggggtgagcagcagaagccagagaggctgtgttgttttcacagctgctccccatggctcacgttaccagctgagctccaccctcctgtcagatcagtgggagcattacattcccacaggagcgtcaacactgtcgtgaactacgtatatgagggatcgaggttgcacactctttataactatccaatgcctgatgatctgtcattgtctcccatcacctccagatgggactgaccagttgcagaaaaacaagctcagagctcccactgattctgcattatggcgagttgtataactatttcgttgtgtattacaatataataatattacaaataaagtgcattataaatgtactacatttgaatgaccccgaaaccatttcctcccacaccctggtccgtagaaaaactggcttccacgaaactggtccctggcaccagaaaggttggggactgctattatatacaactcataatatcatggacatgacatcattacataaatttctactaaaagaatcaacctttgaaccaggaatagggcacattaaaggcaattccctgcgaggtcaacgcactggctatctgcaagcgcggccaagtgtttccctcattcccaaggcagccccagatccccctgccggcaagaaaaaccttgtggaagcagacatgtgctgcaacagagagatgaaaagcgcccttaaaatgggaaacgacaaatttgataaagccagttttctttatgctcaaatctgcccttgtctgaaagagctacactctcccacttgcagtcattcacctggcatgtgaatatataaaattcccatcttttgattgaaaaataacatttatttcctacacctttatgaatttatagatggagtttaaaatttgtgtctatttacctctgtcctttgcaagatacttttaatgaatctggaaaaaaagggaaaaaagactggaatctaaagcacacaggcacagccccatttctttgacaatcctacaaaagtcaggataagaacacagcaaaaaagggggaaacttgtagaattgaggtttattcactgtgggctccaggaagtgattttctcttcagcctcaagattaacagcttcaattcttttcaaagatatgacaaggaattttaaatatctggatctaggggctggacattgggactcacgcctgtgatcccagcactttgggaggttgaagtgggcagatcacttcaggtcaggagtttgagaacagcttggccaacatggtgaaaaccagtctctactaaaaatacagaaattatccaggcatggtaatgagcacctgtaatcccagctaattccatagggtgtggctgtaaaagctactcaggaggctgaggcaagagaattgcttgaaccttggagatggaggttgcagtgagctgagattgcaccattacactccagcctgggcaacagcatgagactgtctctaactaactaactggatctaagaacactaaatctgagtgtttggcagcacaagccactttttgaactcagcccttggctttgtgacccatcctatgaagtccccacactctaacagaaggaaagaaacaacaaaaagaaaacccagcaaaattgtctgatgaagcacttaagagcagcccaacattgactaaaacacaatagaggaggaggaagttcatgttacagtcaatgaagctaatccaaaatttccacccaattaaagacagagtaacaactgggaagacatatcacaaacccgatttactttttgactggaaaggaacaaagagtaacaaatgttttcatgcccctgacagtgctcatccggtgattttgggacttagctcttagactgtcaaatacacaccctttccacactccagaccctgcaccgcccatgaagccctacttcaccagggctcaaccatccatagctgtctcctgggcaaccgcaagaacaaactacatctttttcctcaagaaaatgctgtattttgtcagcacatgactctgcatgacaaagtgacaacagatgttaaaaccaattatttcctatagaaaaaatgatgtaatctaactcatattttgcatacttttgtctactcttggagacatttaagaagccaatactgttgaatgtctaatatagtttgtgtgtaatatatcggtgtaataaaaatggaagccattaacagtagatgctaaaaataaggaaaaactgtattttaaagtatcagtaatatattatttttataaatataacaatttcaatagggaatataaattgatacacaagtacatcagccaatctgatctttggaaaattaaaccttgaaaaaaatgtatgttttataagtactttgttaatccacctactgttcacaaatgattgttccacagccaaatgtgacacaggtaaaatgcaggattatggagttttgaggccttatttaattattaggagaaaactcagagttcctgcagtgtgatatcactccaaagaagtcaccatgcaggcccagagtttgtctagttttgttaaacttatcactggtttccacagaaaatctttggaagccctgttatgatatgatttgtccaggaaaactgaaaccttaactgcctgcctccttcaacactcaaaacattttcctatggctgtcatgctcccttccaggaatcatggaatctgctcttcacggcacatgagtgaatggtggaagctagcctaccacctccctgggggaaggggatttcctgtgaggtcacccgagttgttactgacaagtggaggtgcctctgtgtggggctgtggctgccttgagatctgtcttggccatgtggctacaataaaaagtaccatacctttgacagctaaacaagacaatagaagacagaccgtgtcccgaacaccttcagggcagggtgtgtgactccaaagctcaccttccaagtattaggactgtgtgaccctgagagtggagtgtgtgtcaaatgtagatttgacggaaaataattagaattttaaccaaaatctacattcttagcctttacatccacacatcaccatctacttttctgtcacaaacatattgaattaacttcatacgcagcagcttgttaaaatataagacccaatcaagatcattcacagatcttataattccaagtttcaagaataaaaccaacatgtccaactgagctaaatatattcttcatttcagcataaaaaatagaagtcatagatattgagagagttagatttcagtgtctcatcttacagacactggctttaggcttcttatgcctcatattaacttattgtaggacaaaattagttcatacttaaataaaaatattttaatacccaccttgtattgtggtgtttttttcatcttatctgtttttgtcactataaaaggatactgtcaatctctccttcttgtggagattaattgcctgatttatacatcaaacgtgcttaagtctgtttcaatttttgtgtgtacagagtagatgtgtgtatttgtggggtacatggcatgttttgattcagaaatgcaatgcataataatcacctcaggttgaggggtatctctcctctcaaacatttatccttcaagtaacaaacaatccgatcacactgtaagttattttaaaattgacagttactgttgattatatccatcctgctgtgcaagcaaataggtcttattccttcttctattttttttaatccattaacaatcaccacctccttccttcactcctactaccctacacagcttctggtaaccatcctactccctatgtccatgagtttaattgttttgatttttagatcccacaaataagtgatcatgtgatatttctctttcagtgcctaccttatttcatttaacaatgatctccagctctagccatgttggtgcaaatgagtgaatctcatcctttttgtggctgaagagtactccattgtgtttaagaaccacattttctttatccattcatctgttgatggacactgaggttgcttccaaatcttacctagagtgtacagtgctgcaatttgaatttcttgctcagctttctaggactatcctgattctctctatccctgagattgagactcagtgctttttcctcaaggtaatttaatgggacaggctatggaagaacaaatttccgaaaaaatgaatcctacagttgctacccaaaagaattcttttaggggaattttagaaatggcaaatccaatccaacaaaacaaagcaaaactttgttgtctcaacaaatcaaatcaatgactgaccaatgtatcaaattgaagaactggttctgaaattaggcagtagagaaaagtaaacttccttttaagtaactgaaatatgattatttagtttgagagaaaaaaaataagcttgttttaaaaagaaaatacattttaaggtattgctaacatccttgtatgtgaacaacttactgtaatcatgactagcaaagtgagccacattttctagtcatgattatccgtaaaatcagaaacattcaccaaaagttaattacatgaaaagtttcctctcaagatttttataacatagccgcgtatgtatttttgtcatttatttcatatttatattacagtttctgcagatatcttgagcagactatcaggtttaaaatgtttttatttcatactctatcagcctctgttcaccaagcctttccagatcccagagtcacacaaaggagttcgtagagtttaacctaatatttataagacctttagcatagaataagattctactatcttatatacttgcttaggctgccaatgagttccatgtttgtggtgtgaagacagagatctttgagttgtctctatgggaacttcataggccgtgtttggttgatgggcttgtctgtaaaactgtgcaggtctgcccctagttcacctgcctcactggtgtagaattcaagtggtctcacctgagaagccggctctcaggcttggacatcaacctgcttaaagtaattctctaagtgttttccatgtattttctcataaatgttgacagaaacccaataaagtggtctgatctgcatttaaaagggggcatggaatacttccaagcctcttagctatgaaggaacagccaatattcacactcagcttctttggtttccaagttcctgctgtttctagcacactacgctgcactcagaaaagaattgagtgtgcttcctgatttagatattgctgacttcttaaaaaactcataaacattgagatcgatctgcaagaaactcctgaaataatctcaacccaagccgtcttgtttttagagtgcagttctttaaggttgaagagacctggggctttcctgaatgctcatggaggtggtgtctgaagcagcaccaaatctccagtctctgaactctgtcctgcatcacccctttctcactggagcatgcagcttaattataaatacagttgaagttggtggatacttaaactctacccatccacatgacgctgaatgttaactgggacatgtggcaatggaccaacgcttgggttccacagcacctggctgtaggaagatgcaggtggaagtcccactcctttcacatgttttactttccatctctaagctgacgggagtgtggggagccctgcacagtcacattgtgctgaatcatgctcctattattttatacctacattatcccatggagtagtatttacttggaattcctgcaggtagagccacttatgcaaactcttgcggccttcatactcagttgagattacctgcagttacctgcaaatatttggttacaaatgagtccaaaccatgtgccctgaatcacaagtgcttgaaggatcaaaagatttgcttattattcaagatctaattctcaaaattgaaaggtgtattatctgaatctgtatcacgttcccttgaaagcattagattaccaaagaccaacggagtttaagtatgcataagtaacaatatatggtgtaggattccgtaaatgaattaatgtgaagtcatgagcgcttcatcagtcctagacgtttggggcaaattttcatttcagaactgaataataaactatattctttttagtaatcttagctgatataggtcttattggcgccatcctatttcatctgtattatatggttcacactaatcaatcaaatcaattaatcatctatatcaccttgttactgctgtggtaaagattatttcaattaagtaaatgagccattttattaaacacattgcaaatttcatttatttgaaatactttatatgaaatatattgcttctattaaacaaattaaacaactactaaattgaaaatgacctttcactgctgccaaaattaccttggtaatcaatacgttaaatataattattcaaaattaaagaaattgtgagatattactatacaactttgtgggttactaacttatttcacgtacgtttattacttaatatttaataatgtaatgattttcatctaactttttcctaacattcttatgttttcctactttcttccgtttgacgaacaagctgagatagctatatacatatatgcatacatttgaaaatgtatatttgaagtatgagtttactatctgctgaaaatacatatttctttattattaacatacttacatatttgttttaaggtaaagtaaaacagcaccataaggcaaaatggaagttggtaggagtgcgtactatgaaaatgtgtgcttattaaaggcagggtttaaatttagttaggttttgaaataagtaaatagagaacataaatcagttttgtgttactaatggagaatcctaagcctacaaatagtgactttgagaagagatgtaaattcaggggtgaaaattaaaggcactaatacagaaggcagcttcgaaagataggatggtgtaatgagatcccaaaagagaatcaactacacaacagttaacaagcttaataaggagtaataatatatgtttacagtttccacacatgaattaagatcctggcctgcacacttcaccagcctagacatggggggtatacacttaattttcctaagagttaagaagcttaatatatctaaaatagcagtgatcaacagtttaaaacactgtttttaactgtgttaggatattggaaaagaggaactcattctctttaaagtgcagctttggtgtaaatttcttgctaatttggacgtttctttctagattaataatgtagaaatcttttgatccagcaaccttttgaaatatgccctacctatatgtgcatgtgcacctatacatattgtatatatttataagatgctcacagcattggtactataaccagaaaaatggaatcagctggaaagtctattaactgggaagcatgtaaataaatcattacatatttatgcaattatacaatgaataaggagtcagaggattgctctcactcacacctatatctaattatcccttttcccccagcacaaaatcattgttcatcttgttactcacaaaaaaaaatctcagcaactgttctcatttccctctataatttctatggatataaagacatgtacagataacattgctgacatgcatatctatatgtaattttcaaagatgcaaaaccaactttagcattttctctggaaagataggtagtaccatgcaatgatagggaagaaaaattgattgcatacatttgtgctgcttgagaattttatcacatcaatgtattattttacaaattaattaattctggccgggtgtggtggttcatgcctataatcccagcattttgggaggccagtgcgagcagatcacctgaggtcagcagttcgggaccagcctggctaacatgctcaaacctcctctctactgaaaatacaaaaacttagctgggagtgggggtgaatgcctatagtcccagctacttgggagactgaggcatgagaatcacttgaacccgggaggcggaggttgcagcgagccgagatcatgccactgcacttcagcctagatgacacagtgagactctatctcaaaaaaaaaaaattaaaaatattaatgaaaatatatacatctattatcattttaaaatataaacttttttcctaataatttgactcgttaatcaaaaggtttttttttttttttttttttttaagagatagggtctctgtcacctaagctagagtgcagtggtacaaccttggttcactgcagtctcaaactcctgggatcaagcaatcctcgcacgtcagcctcttgagtagctggaactacaggcctgagcactacactcagttttttttttttttttttttttggtggggggagtagagagggaggtctcactctgccccctaggctagttttaaacagctggccccaagcaatcctcctgtctgagcctcctaaagtgctgtaatcacaggcatgagccaactcacccagccccagaagtcatctttaagattactttcttaaaatgaaatcagtgttgaatgttttattaggagttagacataaggtattttacagagagagaatgcattataaataactttcaattttcatgtgcaaaacatagaagcacatgaaagcctatctcatctatgcaaacattttatgttcaatacatttgataatgctgaagttcttcaccacctaggtatttaattttatttcacagaaaagtcacatttttttctaaaatatttacaggtatctttcaaataccaattaaaacgtttgaggtacaggagataaatgaaaatttttacttaaatattgcattgcagtccatttgactgactaatcttgggtgtatcacaagataaatcaaataaggttcaatcaaacactgaagtttgagtaataaaagcatgaacgaaaattccagaaagatttgagttattttaaagtatgctgctacaattttaggaaattcctttataaatcttatcagcttcttacataaccattgtactgagaaactcaggggccaaatgttccgaaaaccaaataataaaaggtagacttgccctgagtcatttctatgtccccccgcttttttctaagaggtctggaaacccattttgtttcaaaactgctcagagtttgagttgtagaaacacgtgacgaaatgcttatctcctcccactcttatctcctgtcctgattcagcaaaaacatctgaaacacagcttcaaatgcaggcaaagtgacaatctcctgacaaatctttatagcagacatgatgtcatacacagtgcagtgatggctgtttattaatctttaaaattttgtttttataacagtaaaaaaattattaaaagttagaaaagaaatgaacacaaagtataaagtagaagttctccttccaaactatcccattcccacacgtttgcctagagatttctaccattaacaaagcctacgtttccagtccccactgtatatatgaacatataaagcccagttctataaatacatctacttacatgcttatctacaagcatattacatctgttatgtatataaaagatgttattccttatgtctgtttacctgaagaacctctcaaaccatatgcaactaaagagattttatcttgtttcacttatagctcttccccaaattggctagaaaaacagaagcaagccctctggattgctggggattccagagtacttttaaaacttcattgactttcccttattcaatgtctccgaaaaggtagttccccgaaatgtgtatttgttgataatacaatcagtcactattttatgtttgcatataatccaaagacagtaatggtctgtgataacttacaatttttaaaatttgatttctaaaactgaaatatgtaagttgcctttatttacatgatttgagatgggactgtaaattaatgagattgcttgtttacagtgaacagatgtttatgtttatataaacataaatgatatttgtccctcaacgtaatgtatctacagcaccacaggtatctccaaaatagtgtcattgctttaactcttccatctcccaaaaacactgtctactttaaagatttcgattgtaattgtgaatatacaattatttgagaagagtcagaggtggtatctgcctttactttctgaatataaaagggctgtaaaaagtggtagctggtatagcaacagtatcttattcctccttttaaatggtagaattcttacagtgatatattactgagtatacaagaggtgttcaatttttatttgtaattaatgtgttttaagatggataatgtcaaatcatcagcatcaatcaatcttcgcctaagttttgtattcgctagaaaataaacttaacttattttagagaaagtctacccacaatatgcatacacactggtctttgaaacaacggctttgataacaaaggcaacaaaacacagttccaagaaaattgcaacaatctttattcattattcaacaacactgaattgtatgatgcaatcaagatttatcttttcatcttatgtgtttctttatatgccacatatattaacaccagaatacagtatagaatttcacgaatgatatgtcagccacgtgtggctcaagacacatgaataatatgcatttgcttaaaatataaagaaaacttcgcattcaaagaatgtactggaacagccatgccgttgacgtgcagttaaagaaatagcatttataccattcaatcctgcaattcccaacaaaattctagcagcagttggctaaagatgatccaaaatatgaacagttttatcaaactataaacacattctatctctaccaagtgtgatctgtgtcatgtccagaaaatcccttatatggtgatcacagtgttagtaacgaacttctgggtaacaaagttgacatgtgaaaacactcagctatgttttcatttcatcacatctacaggagtcctcataagaaatgcgtacatatacatgcatatattcgtgtgtgatataattacctgtgatatgaggtgaaaatgtacaaacggagtaagaatggtgacatgttaaggaaggaaaacacacactatctttgagaagagtaagatagaggtggcctggcacagtagctcatgcctgtaaccccagcactttgggaggtcgaggcaggtcgatcacttcaggtcagaaatttgagaccactctggccaacatggcaaaaccctgtgcctactaaaaatataaaaactagccaggcatggtggcacagacctgtgatcccaactactcgggaggctgaggcaggagaattgcttgaacctgggctgggaggtggacgttgcagtgaactgagatctcgcgacttcactcaagcctgggctacagagtgagactccatctcaaaaaaaaaaaaaaaaaaaaaaaaaaaaaagcagaggttcttggagtaggtcatgctgaatgtggtgctcaaaaatggacaacttttagatcaacagcatgtgagaaaaccacctgaggaagacataagcagtcgcattcaattaggatatattttgacagacaagtttttttagccacggagaacaataatgtccatcttttaggggttttctaagaattaaagcagctccagaacatgaaatgctgagcattctgcacaagggatagatgccatctgtaaacatggttattatcattcagggcatgattgtaattgtgatgacatgttgaaaacatcaaaaagcagggtcactctaagcacaggtgcatgaaggaaaataatgaggtaaaatgatatgaatatgtctacctaattttccctgatttgactaagaacatattattccagataatcagatgcttgtgacctcagccacaagccttcaggtgcaaatgacaacccagaggactcctgctgcagccaaggtaattgattgttcagactctgaccttgtccaggtcttacatatttgctcccttcttcatttacataaaataactgggaaatctccactgtgttaaagaaatgttatttcccttctcttgcatttgattttcaggtgttaaaatgaaaacctatacccatattgaaatcactgcacatttatgcactcatacaaaactacatgtttaacatgttacttctctgaacaacaaaaaaagtatgactggatagtagatacagtgctgttttaagattgggtgatggcactagaagaatctgacaccttttttttaatgtgcagaatcctggttaagactactttcttcattgtttgaccattatttttctcttgttctctttctagccatatgttctctgtcattacctatgacattccgttagttatatctgcctcattaaatcaaccattttctgtatacttcagaagtgtatgaagtcttttccttaatatctcatttgaggagctcaacaaattctatgcttttggattattctaatactatttcttactgtaccaaatcgtctttcaaaatttataccctccagtgagtcacttaagaaagtcaaagtctttgctttcataaagccaattttatacttcattggttttgttttcatttgggtagcttgtgtgataaaaatggcttcaatgaattgaaataatacgctggtgtttaagaaagaactgtgtgttcagagtcgaactgggccaggcatgtgttcctaggaaagtaaggttattgaagccactagagaacattacattgtcactttcccacaacttggaaggaatttctatttgggggcgtaacgttgcattaagtatccaataatagacggtcctgagaatctacactaagaaatcacagaaatgtgtcagaaatagatgattaacgagaatgtttaaattgcctacttagtaattaacatcttcaatgcagaagtgttctcccgctggagaagggcacaagaggagagagcacggatgcagggacgtgacctgggcctttcagctggtcagagaaaaagtatttcggtgttgaggtagacgaaaggatagcaacaatgtcagtgcctcttccctggcagcaccctgactctgtgccaactcttaggaacttgacacagcccaagaagaggagacgaggctgtttcataggcggaagggctccgtgttcactgtagacagcaagttgtgattttgttgttacattcgttacatacgtgagttttgaactgaaacccatacttcataaatgacgcatcaaagaaacaaaagacattttgttttttccacaatcatctatttctaggatacctttgggacagaagatcacttgaagagtggacccagctgggagtggtggctcatgcccgtaatcctgcttctttgggagcccagcatgggtggatcgcttgagcccaggagtttgaaaccagcctgggcaacatggcagaaccccaactccataaaaacaaacaaaagtagccatgggtggtggtgcacacctgtagtccccgctactcaggtggctgaggtgggacgatcaccgaacttgggagactgaggctgcagggatctgtgatcaggccactgcactccagcctgggcagcagaatgagaccccggttctgctttgttttgttttgttgtggggaagatggagtctcattctgtcacccaggctgcagtgcagcagcgcgatctcagctcactgcaaactctgcctcctagatttgagccattctctgtctcagtctcctgagtagctgcgattactcgtgcccaccaccatgcctgagttgtgtgtgtgtgtgtctgtgtgtgtgtgtgtgtgtgtctgtgtgtgtgtgtgtgtgtgtgtgtgtgtgtgtgtgtgtgtatttttagtagagccaagttttctccatcttggccagactggtcttgaactcctgaccttgtgatccacccgccttggcctcccaatgttctgggattacaggcgtgagccattgcgcctggcagagaccgtgtttatttaaaaaaaaaaaaaacattggccctacaaaaacagcaggagatgactgggtggagtggtaagaaactgttgcatggaagggattgtggagttaacaaaaaggatcatcagcctgtgtcaggtctgcgagcctagcctcagttatgacagcgtctctttgggaaaaggtacttacttaaatgtacatttgcaaatagaatgttaaagacaaacaacattttaataaattattgatcccatgttatttcccaattattatggataagggaaaacaaatatacatgacaaagttcttgcctgatggatgcttacgttatagcaggttagatacaactaaagcaaatcaaagtctgaggcagaccgtgatcattattattacaatgaattatcagaatgtggtcattcaaaatgctatacaagttaagaggaaatagaaatccctttcagctccttgaatgattgggaaaggaagcctgaagtggatggcatttgtctggacccagaggaaggagtagaatttatattattcatagacagtaaacaaaatctttaaatctaagatgtgaatgttctttggagaggctctaatccaaatccctcactctacagataacagagtaacactacaaataccaatgctctgtcaacagaaaacgctttcatgtaatacttcccacttgactaagcttgttcaaagtcgacaggtttacggaaaaggaaggaatggtttccacactctcctgtgacctcttgttttagaaagtgcactcatagttaataaaaccaaaattaagtctccaaattaagatttaagactcttttgcagttatgtatcaagtgttataaaaggagaagaaaataaacgaacacaactaagaagtcacaacgtttcaaagatttaagtgataaacttaaaaaagtgtaagtagaggaggctcgacgaatgtacaattttattgttcgattactcatctttcggaaatgacgacaattaccacactcaccatattttttaaaagacaatgctaatagtaccaaaaagcctcttggaaatttttgccaggggcaggtggtaaaactaaaaaactaaagtggttccgcatgaggtttcctggaatatcacccctaagcttagctgtccagtggaaattctgttcccttctctatgttcttgatctcttcctagttctcacttttaccaatgtgtatcgctcgtatcacctcaaggtgaacatgtaaccataatgtctatttttaaaagttttttaacactgaaaatatttttcatctttattcaggtgaaggaatcaaaagcccatttagcaaagcatttccaaatatagttataacacaaaaaagggtacattttgtttgccgatctaggaggatttttaatttaaaaagccttctgcactaactcaattaacagggaataaaacacgccagttgtccaactcctactttcagtaaccctgtgtgccctgatgcagattggaagacattttcactgtggagctattttcccttaaatactttcccagacaacagcagaaaggaagctcagtcattttaagttcagattagtacataagtttacataaatcatgggaacatcctttgaaatctaacatttttccttcctgtattgtgcaattttaaagtcttagtatcaattaataaatgtaatggtgggaaaatataatttattcaccaacatatgtcaacatctgactttcttctcagtaggaaaggtcatatatcttttttggcattgcccatttcatcttaatttcacttttgaatttttctgaatgacataatgacaaccatatttaaggctttaaatgatgtcatctgcagaaggagacagaaacctaattctgggacagggtaaaaggtaatttctctatcttctttctgatgtgtatccaattctcttattcaccaagtaaacacacacatgcacacatatttcatctattaagttcaaaatttccagataaattaccagtgtacctgtttctcttctggatcctaaggtacaaatggatagtagtcagtattatttattacttgtgtgcgttcagcctaatttatggttcttgagtaaaaggcccacagaaggatgctataaacctctttctaaggagattgaatagcttaagagatttgcaaaaataaaacaagctaatgaagtctaaccagactttgcaaatatttagcaatatagatcactcaaaagcaagtacattcttctacaatacagttttacttctattttctcagaataattacactgtctatgcttattcacactcaggttgtaactattgaaaggaaactcagaaatgttttaccaggagcagatgaaaagactcaaatgagcatctgtcttcattggttttaagcctccccctctctttttttccagaatgattctggtgtataacataagagatactgtggctatgtttagaatagccgtgtagaagttcatatttttccccaatttttgttgataattcagttattaaaaccatcatccttcagtgtaatatgaagttacttgtcattttttgtctttaggctgtgtctgtgagtcacaggaagttggatcccaatggactcatctaattatttagccattcccataatagagataatcaatattcactgctgtagccagaatacatcttggagcaatccacatagatcatgaacataatcagcctgagaggaatgggatgggaagagagggagagagagggagtatggggaagaaatgccagaatagggtcgggtgtagaaagagaaacaatggtggcaagcagttgggagcagctatgtttgggcatttttacataacagagccctgcaagcttcccctcctacgttccctatctcagtaaatgacttcatcctcacccagtttctttacttagcaatctcaacctccataacatatgtataaaacctgggcaccatgcccaatacacagaagatgctcaattttgctctttttcttgtttttccacattctgcctttcactggccctgtcctagccatctctcctgctatggcctgggtgtcctgtccttgatgactgggttccacttttctcccggaccaaggacttcctcgtcctgtctcacttctgctcaatttatcctgtacaccagcacttctttgtccattgttttccaaattacaaccccaaaatggttgatatacgtagagtaaaaccgaactgggcaacaattgaagttacagagtacctatatgtgagggagactaagatgaaagcaaagagacagtgtctgatcttcaggagcacacaacatgggagaaagctgtgcactgtttgctgcaactcagagtattttttctttgtttttttaaagatatttagtagccgggtgtggtggctcacacctgtaatcccagcactttggaaggctgaggcaggcggatcagcaggtcaagaaatggagaccatcttggccaacagggtgaaacctcatctctactgaaaatacaaaattgacaaaaattatctgcgtgtggtggtgcgggcctgtagtgccagctacttgggaggctgaggcacgggattcacttgaacccgggaggcagaggttgcagcccagatcgcaccactgcactccagcctggtaacagagtgacactcagtctccaaagaaaaaaaaatttggtactttgatgcagtatccactgtcttgcactgtatccaatgtataacacatcacagagttttaataaatgtcaaacatttaacagaatagcaacaaaacagcggtctcttcacaaattgaaagcaagtattgtattttcattttgctttcatttacgagaggcataaacatactgcacttgtgagtaagggtggtggatgtgagaggaacaattgttaatattcttccaaccagattgcgctaatataaaaattaaaattaaatcatggagaggaaagggccaataaaagaacccatacaactaagatctacagtaacgtattatatttgggtactgaattgacagctaagctttctgttgaccaacgtggggaaaaaaaaaatggaatttagtgaattctgcactgctcattcaataagtcagtcaagcactttgggaggccaaggcaggaggattactcctgagttcaagagatccagactagcctgggcaacacagtaagaccctgtctctatcaaaataatataaaaataaccaagtgtgatgaggcatgtgcctgtagtctcaactacttgggaggctaaggagggaagatggcttgagcccaggaggtccaggcggcagtgatccaaccaatcatgactccatcaatcaaccactgcaccactccagcctgggcaacaaagcaagaccctgactcaaaataataaggcaatcacaagtgtttatggaagataattattgaacatgtgctatgatcagtgttttccacactgaaaaagtggtcagaaaagcttatcactctcatcaagtcccactctcctaaagcttacccatagagaaatattaaacaagttttcttatcacaaaaattccagagacagtgactctggaaaggtaaagggtgagcgatagagtgaagacaaagaaagccttaaaaagaagaccattttagaggttatattcaagaaggaatctactagaaggtaatgttaggatacattccttagtcaattgagttcactgatgaccatgaaatatcagttcttccaggcaaagctttttaaaattaaaacaaattacaacaacaaggcatcgaatgatacagatagaaccatcagtagtatttgagcaggatccacaatgccatcttaaaggatgggctcttaccacagtgagttttgtttacgtaattcactcatttatgctttccctttcaaacctcatgtgttctcttttttcttccacactaaaatgatacctgcccagagatgtaaaatttaatgtatattattatatataatatataaatatatataatttgatatacatatagtttgatatatatataatgaaatattatctttaggcagcctgccttctcaccagaggggtggaagaggaagattaggggccagaatgatctcctctgctttctttagaaatttagggcagtgtgatgcttccagaggtctgtacaaacaccagctttcattgtgcttgggagtttccatgcctcttccttctcttcgcttagtgcacgtttctgctttttatcagtttgactgcctgagactgattccaacaacccaaactgaacgcctcagctcctccttgtcaaaggaggatgacttgtcttaacaactatttaggtgaattatttctacagtttttgaaagcaatggctctaaacaaattccactggggtgacaagtacaatacaaaggcgtagcctcgagggcttggggttcagaggttcatgttcttacacggtgattcttgacaaataaggcattaatcctgtcaggcattacccactcatatttgagcaaaccatgacctgctaactacagctttaattttagttcattaactcaacaattataaaaataattcactttttccaatcatttttatcaagaatattaaacatcagaaaaccggtaacgaaaaagataatagtttttatgtgaagtgcacaatgaaaaattcttgagtgaaacgtaacattgcatattttctccagaaataaagtctaaatcctgatactctcaattacatttaaatcaacacggacacagacacaggttattcatctttcaacatatcatccaataacacaaatccaataaagtttattggattaataacaaaaatcccccagtcctcaatatcaggtgaaaaaaactaaaggcaaaatgagaaggtgatataggaaggccgactgtgaaacaaattcagtagagaagcaacgatgggcacagtggtaacagcctttttattttagttaaatagcgttgatttttcaatttaagcttttgtttctggagttgcagagactgtttcccacagtcctctgaagaatacaatttaagggacaacttagattttcaagcatgttgtgctaggaccatgaatggtgataagctctcctggggctatagacagggagccaatgattcggaattccttggacacatgtgtcaccaatttgaggcaaatatggcacaagcccgttcccccctccatcccaacacacagacacacccacacagacacacacagagacacacacacacacacacacacacacactgaacctcctagctgtacctaatgtaaccaaaacatgaatttacactcccactggcaatcaactgtccccaagaattcagactcccactgggaaccaactgccccagtctgctgggattgggggtctcctgggcacagaacttggtgctgaagtcaggagattcccagaagacactggacagttagtcacccgtgtgttggtgcagcagcaagaacggtgatgcgaagtctggctgaattcaaagccatgcatccttcaggccttcttgcatcagattcctgcagagaacacagccgacagaataacttgggccacatgactggcttatatcgcttgaacaattgaactgctgtgaatcgacagcacagtgctgagaaatgtatagaactggcatgtgtatctctagcccccgacacctgcaggtcccgcagtctacagaccatgcctgcttgggtatgcacaggcatcacagcgggcttaaccatccccaaacgtaattccgggtccccatttgagcgaacgcctcagctttcacccaggttcccgaacaagattgcgcaattcgtttctttttttttttttttttttttttttgagacagagtctcactctgtcacccacgctggagtgcactggcgcgacctcggctcactgccagctccgcctcccaggttcacagcattctcctgcctcagcctcccgagtagctgggactacaggcgcccgccaccgcgcccggctaattttttgtattttttagtagagacggggtttcaccgtgttagccgggatggtctcgatctcctgacctcgtgatccgcccgcctcggcctccctaagtgctgggattacaggcgtgagccactgtgcccagcctgcaattcattcttgattcctcctactctgtgagcagattcagcctattatcagttcctaccccattctgcattaaaactccgtgtctccttatccacccccaacaccgccaccctccttacagtgcttaccgcctctcactgcctaactggactcctgacttcggtggacaccagacgcagcctcttcttccgcatccttgtcagtagacatgcagcttcatcttacttttcttctcccaacacatacctcttgattttcaaaatttggctctggtatacctctaggagatcttctttggataccctaccctagtctggctacaccgccgtttgagtataaactcttcaagtattttgttcccctagtcacatatacaatccttggaagcaaagaaaaagtgtggtttctgatttctaatacagagcacctttgcacagagtagacccaatgcagcactgatttagggctggctggggaaggagggcatagcagaaggaagctgataaagagactaaggcttcagtgcagccttccaggtcctattatcttagcatgttctctacatagcagctaatcaacctgaaactttcggtaagtaaatggataaaactatactcgtttagaaaggaagaatgtctgaaatagccattctaaaggcacttaagctacaactagaagtgaaaattatctcaaccataagaagagcaaaggtttttttccacagtttagttttaaagaaacttaatctaaatggcgtcctgtgatacacctacagaaactgaagtcttacaaacacatctcactccagactcatgacgcttctgtacgttgtttcttcatggacctgggatggcagagttaggagaagggctcctgtgtgttgctatcccagtgtgtcagtccgctgtcatcaacacaatatcaccatgtttaggctgggaaacttcgtgctatacaggaattttttcttaaggtctgacacgtaataaaggatgacggatatcaaagaggatttggacaacagccaaaaggaaaatggtatttcagaattaaagatgcaacaaaagctatgactctctttatcttactctgaaatacttctctaaaatatttgttggccttttccccaggttaaaaaaaataggagaaggagaacttcatgatggattcttgcatccattagcaaagaagatgatcacaaatccatgtaacaagcaaactaagtgacacccagaagctggaaaactggtcatcaactcagtacattttatacacagctgtcatgtgtatcattagaaggcaaatgatggagaaatgatacaagcacacagccaccttgcttgacagcacatctaagaatagaggaagctggtttccatttgtctctgcagctggaccagaaacacatcatgggcctcactttatagaatatgacctcctgcttgtgagatcaaattgacaaattgtgaatttttaaatcatcttattttctctttcaggaggaaaaacataaaacgcaattgaggccagatacagtggctcacccctgtaatctcagcactttgggaggccgaagcgggtcgatcacctgaggtcaggagttcaagaccagcctggccaacatggtgaaaccccgtctctactaaaaatacaaaaattcgctggatgtggtggcatgtgcctggaatcccagctactcaggaggctgaggcaagataactgcttgaacctgggagacaggttgcagtgagccaagatcatgccactgcaatccagcctgggtgacaaagtgagactccaactccaaaaaaaaaaaaaaaaaaaaaaaaaaaaaaaaaatgcagttaagatattagaagacaaacaataaattgcttatcttctccttaacacagtccattctcctcttcaagttcttcaatactatcattgaccaaaaaaaaaaaaaaaaaaaaaaatgtgaaagtacgtactgcacacttaaaataagaaggacattatgccaaatgctgagagggttaacagagagtggtccctgtcttttggaaaaagcatgacacaaactttattacaggtttttaaagcttgggccaattggttcagaaaatatgctttaaaatacaaagtatgtaacagaaaagatgttaagtgagatctaaaagctgaagacaatttgtaataaagacagcagtaataaaaaaattagtcatagagcaggaacatgttggtaaaaatactgtatctgtcactaatcaaatagctaggtatcaaagacaagatatcgacttcttagaaaaaaagtatttttaattgctgttaagagtattcttaacgaaaatcaccaacagacagggaatagtctttggaaaattgtaggttctaagtaaatgtttatagtgttggcacttcagtagtgacaccactttgggtagaactgaaaacagccctgtcttctcacaaacacggctgtagggatagaagagtagaggcaatattaaacatatttaatcatcagtatggcagagagaccctccaaccaatcatctgatctgatggatgctggctctggtggaagaaacaggcatgtggaccccctgctgcatcagtccttactgtctagttgctagatcctagggagaagacccatctgacaacctacgaggtaagctgaagaagctacctgtgaaggctgagccagtgggtacctgcaggacccatcctgaccaagcctggccctgggcactggcttcaaagggagaacacacccgtatttgaagccagtttccacccaccaactgtttatcctgagcatggcaattcctctgatttacaagagattttgatgagtgtggtttttttttaaaaaaaaaaaaaacaacaagaaaagaaaatcaatgttaatcgctgattcctggagcatctcagagaattaagccccataccaggtgtgtctggcacagagaaaaataatatgactatcgatgtgtttcttactgtgaaagagttattcctataccttttgataccatgatttgggttttacggacctagatgtgaaatgtgtcctgttaaacacatgtggagggaaggggggaactcatctttcccattctcaaccaagtggttttacctgtttgcccatcttacttacatatatcatttgaattgcatctttctaagactacttttgaatttgtagagtgcttgggacaccggagaggggtttgcggaggaagaagtgattggggcttcccgaggtctggaacaggaagggaatgtttactaaactcaggggagtgacagggaaaaaacaaacataatgcattgaaaagtcttgcttattggaaaagattacctgtagttttctataagaaatgatcatctggacatacccatgtaattaagaaaatttcaattttatactagatgggcctgttaatttattgtctctgagcttcaaatgcaccctacattgctacttaatcataatggagccaatcatcataaatatttattttcaaatagcatgatgttaagctcagacaatgaagagcactagaggttcacatgggagaggcagcttcccttcccggtccttcatgtgctcctctgtatgggatccagcagcataggacacctcttcactggctgcttctcccaagtccctcttagctggcttctcaccacctcagcacccttgcagacagctttgcagtgacttccgaggcttggcacctcccctgggacagcttgatgcagcaccgtagtgaacgtctccattttcccatacaccatggggcagagtctatgtatgtcaacccaggcagaaaaacccagatgtacttctttggttggtggcacttcccctgagaggtagtgacttctccctatatccggtattcctctattctttaaaattccttttacccctgaggtacacaatccttcatgtttttaactccttatatacttaatatttctttacatgaaactttctgtgtttaaattactttatggttttgctgtcttgagtggatgctgattaatatactaaatatcaaaatgatactaatcaccttgtaaagaaatatggaacttataatgatcggtcacacttaaatggttgcagagtaaccacaaaaaatgacactcaatgagaaatatctttctccctctttttttttgtgtgcgcacaagggatcgattagctgaaagttatatcagtaatcataataatgaaattaatttataaacctaaagttattacaagtttatggggattattggcagtgatttttatcagttggtttctaaaacagtctgaagttaaagttatgtgtaactactattgctaagcatgcatattatgagaaatagatgaaaattctgtatagtgtgaaagaggtatgtattttcttaatgttaactgttactctttgaaagacattgtaacagtaaatacaaggaaaaaaaagaaaaatcatcacccacacctcagcagcaaaatcaatgagaatgtattttgtattctcaaaggtccttgtctgaaactaaccaaaactgcagcaaaataattagattatttctttattagtgggaaaaatattctccttttgttacttacaaaaacattttatgcattgaataagataacggttaggaatatttaattttttttaacaacttttcaattagatccaaagacccactttcagaactgaggcaagcgtagcactgaatactcattccacagtgaaacaagcacaatgggtggagaatgtattaaaaatatttaagtttctggaagtgcattaagcttgtaaaccaacgaggaaacatctaaccaagaacatctcagtgaggattcacgtttgtgcagcttgggccacagcctgctttcttccccttatctccaatctaggtgagtatggccaggaaaactagattctctctacctgcagattccagccagggtacgcttctaaccaggagggtcaggccaccatcctttctcatcctcacaagcttcataggcaaaggataaactgcagatgagtttggccaacaggccatgtcgctttcaagttccacctatgtaggaggtatgggaggctcaactccagaataaaaggtcaaaatgctgcagttcctgtcacttgtgcaccagatggcatataaggtgaaggttctatgccaccaggagcaaaccaagacaatcaagctctcacctcagacccgtggtttactcatgaaacaagaatgtcagtccagcagaagctgagagtgtctctgccccacgtctgaagcagtggctcagagatttttcccaagaggagagatagagggcaggaaattcaaatccaaggttgctctcaaaaataaatggaaattgtgaggataagcaatttagaggagcctggtgctttcactagagctgcaggctaatccatggaatggctagtctaagataataagagacagagaagaagatcgcattgtgggttagaacaaacctcaaagcctggcctcaaaaatatctcctgcaaagaagtgtggacataagaatatggagcccagagcaagttcagaaataatgaagcaatcaggtggaaatttattagtgattcagcctctagcctccagaactatgagaaaattaatttttgctgtttaaaaccatacaatttgtggtactttgtgtcactgggcctagataactaaagcatgcccctaccagagcctcaaaatatataaaacagaacctgacaaaattgcatgccaaataaacaatcaaacaataatgactgttctactcattttcatagaggaacagaacaatctagccaaaatgaccatcagactagacaaccaaaatagtactataaaccaactggaatgaacagacatctacagaacattccagccaataacagaatattgttttcaagggcgtatgaaacattctccacaacagagcatatgccatgccacagaactactttcagtttatttaaaatgagtgaaattatataaataaattatctgagctcaatgcaagaaaattagaatttgagaaataatagaatacgtggaagttaaaaaaatttctaaaaacccaaaggagttaaagaaatcactagggaaatttaaaaataatatgaacgaaaatggagatcaaatacatcaaaatgtatgaaatgcaactgaagaattgcatagagggaaatttagagtagtaaataactatatttaaaaagaaaaaatcttacataaatagcctcaccttccacctcactgtcctggaaaaagtacaagctaaacttacggtaagcagaataacaaatattctagtgagaataatcaagtatacaatagaaaaaaatgaacgtaagcaaattcaaagaaatttttaaaccttctacaaaattaagaatcttttgctagactgttcaagaaataaagaagtctcaaattactaaaatgggggaaaaaaaggtagagaatattactatggaccttacagatatttaagaagaagactgtaagagaattttataaacatctggtagtcaacaaactggatgactacaaaaatacaaattacccaaaacttaagtcaaacaacatcagaatagacctcaagtaaaggtagtaattttaaaattatgctaaagaaaattccaggctcaaatggcttcactggtgaattctaccaaacattgagagtagaattattgtcagtctttaataaattctttccaaaaatagaagagggatcacattccaacttattttataaggtcaataccccaatatcaaagccagacatagttatagatagaaactacagactagtatttcttaagaatatgaacacaaaaatgctcaaaacaaatcaagaaattcagatccaacaacatataaagcattatatactgtgtccaagtgctatttatctcaggaatgcaagataggcttagcatctgaaaatctaacactgtgccataacaataaaataaagtcagctgattgtcttaccagataaaaagtgacaaaattcaacattctttgatgataaaaacaattaactagcaatggggaatttcttcaacctgataaaagtcacctgcgaaaagcctacagttaacattgtatttaatgaaatattgaacattttctgcctaaaatcagcaataagacaaattctattccacagcatactggaggttttagctagggcagtgatgcaggaaatttaaaggcataaagataggtaaagaagataaaaatataactatttacaaatcacatgatctagtatacagaacatcttagatatccattaaaaactattagaatttaagaacatctccagcaaggttacagagtagaagatgaatatgcaaaaatccatatttttttttggtgggtgggggtggggtgttgggggatacatcatcccgttgcccagtctgaaatgcagtggtacaatctcagcccactgcatcgtgtacctcctgggctcaagcaatcctcccacctcagcctgctgtatagctggggccatgggcaaacaccaccatagccagctcatcttatttattatttatttacttattttttttttttttttggagatggagtctcgctctgtcacccaggctggagtgcagtagtacgatctcagctcactgcaagctccacctacggggttcccgccattctcctgcctcagcctcccgagtagctcggactacaggagcccgccaccacgcccggctaatttttctgtatttttagaagagacggggtttcatcatgttagccaggatgggctctatctcccgacctcctgatccgcccacctcggcctcccaaattgctgggattacaggctgagccaccacgtctggctgctaatcttattttttatagggatgaagtctcactgtgttgcacaggctggtctcaaactcctgggctcaagggatcctcccaccttggcctctcaaagtgctgggattacaggtgtgagccaccacactcagccacaaaaagcaattgtatttatccacaatagtaataagctgaacatgaaatttaaaaagaaaacaatccctttaccatagcatctaaaaactccaaaataattaggaataaatttaacaaaataagtacaaaatatatattccaaaaactataagtgtttaaagaaattgaagacctaaataaatggaaaaatatttcatgtacatgaatcagaagacttaatatagataagatggcaatactccccaaattgattagcaaatttaacataattcctattaaaatctctgctggcttatttgcgtacattaacaagctgatcctaaaatgcatatggatattcaaaggacttagaatactcaaaacaatctttaaaaaagaaaaatttcaatattcatacctacctgattcagcactttctaggaaaccgcattgatcatgattccattatgcttgcattagacacatggattaatgaaataaaattcacgttccagagataaaaaccactgacattacccgtcaatttgatttttgacaagatgccaaaacaatcaagaaaaaaatagtttttcaataaatggtgctcagacaactgagtatccacaagagggtaccccttccttacactatccacaaaaaaattgataaatcatagacccaaatgtaagaagtgcagctcaaactctttgaagaaaatataggagtaaatctttgtaacctgatgttaagcaaagtcttcttagatatgacatcaaaagcacaagaaaagaattaactggaattcatcaaaattttaaactttgtatttcaaaaaacattagaacagaaaaagatctatagaatagggaaagtttgcaaattatataaaatataaataacttgcatctggaatacataaagatctcttaaaactcagcaataaaaagacaaattaccaagtatgggcacaataatcgaatagacgctgccccaaagaagatacacaaatggccaagaagcccgtataaaaattctcagcatccttagccatcaaggaaatgcaaatcaaagacgtactgagataccagttcatgtccactaaaataggtaccatcaaaaagacagttagtaagtgttggtgaggaggtgtatgggtgtttcacttccctatggctggtgagaatatagaatggtgcgtctattttgtaaaatactccggaagttcgacataacattgccatatgaaccagcaaatccacagctagttctatacttaaaatgtgtccacgtaaaaatttgtatgcaaatggttatagcagagttattcataattgcaaaaagtggaaacaatacaaatgtcagtcaaccgatgaaaaaacatggtctatatccatcatattaaataggatccagaaatacagaagaagtgaactgccgatttattccacaacctgacaaaccttgaaaacctactaaatggaaagagctagtcacaaaacacattttgtaccattgcacttacattaaatgtccagaataggccaatccctagagacgaaaataaattagtgtttcctttgggccgtggggctgagggaaaatagtgagtgggtactaatggatactgggttttttgcattaaacatcttccaaaaataactgtggtgatgaatgcataaccccaggaatatattaaaaagcactgaagagtacacttcaggtcaatattgtggtatgtgaatcatttcaatatagctctgattaaaagaaagcagcagctcaggactagagaacagagcgcaatatgggatattgaaattccatttagctataagtctcatttcctgttatatcacatgacacctatattaattcagtttacgaattaaaaaaaaaggaatatggtaagaagactgaaagaaacaggtttctcagttttctaaaagaatgagatagagctcagaaccttgagtcgaaggcttatccctccagctggaattctacttcctctctacttcacttacaggactctaatttagccttccaagacccagtttggatttcactgcctcttaacattcccacattaacatcttcctgcagtgattgtatgaagcacagggcattattatgtatgcatgcaatggacagacgctcttcaacttacagtgcggttatgttctaataaaaacattgtaagctgaaaagagtgatgaaaatgcatttaatatacctaacctgcaaaacattgtagcttagccttgcctaccttaaacacactcagaacacgcacattagcctacagctgggaaaaccacctaagtcaaagcttattttataataacacattgagtatctcgtgtcatttattcaatattgaactaaaagtgaaaagcagaatggtcgtatgggtactcaacgggtggtttctactgaacgtgttattactttcacgctattgtaaaagggtaagagtcccaagttgaaccatggtaagtcaggggccgcctgtagtcaatcctgtaatatagccaaactctgtattgttgtgttttaatgtatctacactgattggatcatcagcatccgttgctttaaggcgagtcctgctgagtggggtggggctgggctgagagatcaagaaaactgattctctttgaagttttgggaggaaagtatctatgatcccaatttaccctgctgtgttagttttattagttttttattagtttttattagttttattagcctctccattggggctgagcacgaagccatattcaaaccagatgtgcttcctcccactcatgatgccaccagaatgacttctttttcctgaacccaggagctaccttgggaaaggaagaaaataggaaaaaagggaaacacaacaaggccgagcatttcagactcagtttacctgaaacggaacggttttcactgggagacactaacagttaattttcccatctaaggctcagaatattacccccaaactatgtcactttatgtcaccagagggaataggaagtccaaaccaggaggatgccacataaagtatacacatttgctctgaagtttgagtatgtgtctctttcatctttttttccagtgcctgtgacccaggtgctaacccagacactaggatgtcttggtgaagatgacggtccctgtgcttgcaaaaagtgtacatcagtacatgtctactaaagataaatgagaaaacatggtttgaaagtctatttcatcatgctgaaggagccttgtacgttcaccattgacaccatcctgccttgccatattattttaaaataccaagatggttcgtcgtcctcccaagaggtgacttaacagtgggggatatggaagcacatacaactccactctcagaatggaagtcaagtaaagcaatgcctgtttttcagcaggccacttagaagtcagacgttgaggattattaagttaaggcctcagtagaacaagatttccaaatcccaagtactggagagatgaaattcactttattgctctgaccattaaaggaagaagaatggtaggaaaggatgctggtgtttggaggaactctagtttgtaggtcatctattattttctcacctctgagaatgggggtggttatgggtactttactgccaacccaccccacattcctgaagtatctcaagccacacattctatcctcttcacaggtgattgtatctggaagtggctgactcactgcactaacaaactcacagccatagaagaaggaaaagtcagtagagaaattatgtgcttccaataccttgtgggagagacaaggacagatgggaaaagactgagacattaaagatgtgcaatcacatttggattgacaaattacttttattaccatccaatgataacacaagtcaaacaagttatggagagattaaatatcatgacaccagctctcgagtaaatgggaggatagttttataaagaatgaaatattgtgagagagtcttactccgtggtcttaagagctgtttaagattgggcatgatgcttttataatagtgagacagggatctctcctggctatccttcccagataaccacagatcagtggaagaataagcttgatgaggaagaaaacagaggaggaggaggagaaacagaagagggaagaaagaaagggaagaaaagttgacagaggttgacaaggactagccatggagatgtatcggggagttgaagaaaaaacaaagccaaaaaaaacactcactttgatattgtcttcaaatgagtatatatatactcaatatataggcaaggaaatttagcctatatattgaacaaatgttgaagtttattgtttagaaggcaatggaaagctgtgtttggaaaaccatgagcaaaaatgggcaaacaaatgccaacagtgtcacaaagtttagttattctaagagttcataagccagttcaattttttgactttatttaaatgtttaatttttcagaacaaatataactctgagttgggatatgttctccagtcccagctttttaaaaattttaaaatggtgtacaacaaatacatatttccaataatactatatttatcaaattataatatgagaataccaccaactgaaatccatagaaaaataacaagccatttaaaatttaaattcagagagcaggggaaacattattccaagatgacttcagcgatgagactaaggttatttttaattatattgaaattttacagtgtgtttttacagcattgaaattagaatttcctgtgaacatttcttccttcccttagctgtaaggaaatgctcagctgtgggagctttctcaacatagctcaactggcctcaaaggcaacaaaagtctgtttcatggcagaacaattaaaagaagtgattagctttgatttcttttcaaatttcaacttagtcttgctctagattcttcagagtaaaaaaaaaaaaaaaaaagaaaaaaaaagaaaaaacaaatgttgacaactcgttctgtaaacaatgttcaaagtccttaacagtttccttgtgtctgcacaaagctcccagggacacattccagctaagaatctacttcaattcgtgttcaattaaaccaattcatggcaaggaaaggaggagtcactatacagattatttaattgacccattactgaatgtgtaattcctgcacctggatcaattcaaatgtcctcattccctgctcatctcctccatttttctctttttccgtcttagactaccaagcagacatccttctaaaccgttaatcttggctgtctttgtgccacccatgagtggccagaggatagagttctgacttaagcacagacaacttttttctttacttagcacattaaacctgttgaaaaattgttattttaagaaacaaatattttctcccttttcaagagtcagtgcattataacaattcttttcagttttctgaaatatcttgttttacctttcttgtccacatgaaccaaatcaaggtgcaaatagggttggacaagctattatctttttaaaaaaatctcaagcccaatggtaaagctaaagctaacaaaatatttaccgtagaaagcaccttgcatttactatttcttatatggggaaagaactagtgaaataattggacaaactcaatgaaataattggacaaaagtcagtgaaaaggagttccaaaaaaacagaatcatctagtgggttgaacactggtttttgggatccaaacagttggaattccattcctgaactaacaaagtaatatgatggtttacaaggcttgactaaggaccctgtcctaagctgtagatttgtgtagtgataaccccatctctcacatgggttactcaacaggccctgcctcctgtccgtccctgtcttctgaaattgatctgcactgttctgatgaaccgctttctaaaattcagatataactttttgactaaaaaaagcctacagctctctattttctgtgctctaacagcacttgtcacgctgtgtaagttgagaaagcagcagtgcctggggcatgcctggggaaaggaaggagagctggctgacttctgagactcctgaccccaccttcacccaaggaacttgagaaagtgttgatcttctgttattgactgggcgataggcctttttaaaggtgttatcacaaaaccttttaaaaaccattaataaagaggataatattttgattttaaacctttagcagggtagacaacacctactttgatgagactcaggccaaaacttcaaaccttatgatttaagctcttgatataccaactcattcttatcctctgaacatgtacttttctatttcttcttacatgaaggcatttacacactcttgtccccagctaaatcctccttccttgattcatccattcagccacaaatgatttttcaagattcaatttgaacctaattgttaaaatggtccatatcctactaaacctaggtagatctcctcccctggactgtatgtatcataacaagagtgtttagcataattcaaaaacattgcttagggagagcctactctgggcttgcttctatgtctgaatcagcttagcatgtcctgtgtttttcatataatggataatcaataattattgtattgaatttagcccaaacagcaattgaattatcaattaagctaattataaacttgaacactgcaaggaattttagaatattttggctaataggaaaggaatgctggaaacaagctcattctgtttgactccttacagaccttcaagagcatgatgtgagatgggtatagttctcttatcagagactctaaaaggaaaaaaagttcaaaagacaatgctatactctctaaatgaaattttaataacaagagcacaattgtgtcttacacagaagacctgtttgaagagtttggtgtggcctccctggagctcttttggtaggaaaatggaagaaggcactacttacttaaagacaaatacacatcagtggcagggacctagaaattacctctccaaggccaagacctaaggaaaggaaagctcataaaaggagctcaggggtcaggctgcagcaaagacactatgattgtcatagtcagtgggactttctcattctaacaattattttcggctttctgaaaagtcttgttattttaccttgtccacgtgaaccaaatcaaggtgcaaaacggctggtgtcagcattctgccgtattttcagattacaagtatcatctgggactgcaaattgtgttattggctacatttagagaaccaattcagatcaaaacaggtgagtagattttacctagaaccaaacctattccttccggagccttcctcttctcaattaacggcaaacctattctttcagtagcttgtgcaaacaccttggagtggtctttgactctgtgtattcctgacatccctaatgtagcttagaggccagtgtctccccacctcgtctggaaacaggcccagggaactcttgtcatcacaggcctaacgtcaccacttttgcccttgtccctctacatctctgcacaggaggcaatggaaggagcccttggaatatgccaggcgacagcactcctctgcttacagccttctcacggagggaacccaaagtccttaaaatgactcgcacacctacgtgatctggcctttggttttcctttttttttttttatttgagacggagtgtcgctctgtcgccctggctggagtgcagtggtgtgatctcggctcactgcaagctccacctcctggattcacaccatcatcctgcctcagcctcccgagtagctgggattacaggcgcccgctaacatgcccggctaatttctttttgtatttttagtagagatggggtttcaccgtgttagccaggatggtctcgatctcctgatctcgtgatccgcccgcctcggcctcccaaagggctgggattacaggtggcctttggttttcataacctcatctattcctctccattgtgatccttcacctgcctcctctggcctctgatatttttcagccctgccaggtccatttcccatcaggggctcctcctctatcccgagccttctccctcctctccttcaacctttatttcatgctagtttctacaacgtggcgtcacttgactacgatggttcaactcccaatgcttcctctctcttccctcttatttttatctgtagaattatcacctgacaatttcttcacagaagtgatagtgctgctatgtagacaggttggggtcatggtcggcagctcaatgcttaactggaaggataagtgcatcaaacacggaattccttacattaaatgaactcagacaaaaatgacatgccaaaggattcagagtgaatgtacaaccaaataatataactgccaaacactggtctaagagctcataaatggctttcctgtacgttaaccatttcaacagtgagatttctaaacggccattagtgctttttgaaaaagaatggtacgaaagagtaaagacaaaaagaagaaaggtaaaatgaacacagaaaaacaccatgaatgacttaattggacccagattatttagacaatatttaaggattgtctaacacattcttacaggttatctgaatcgatgttgtctctgggcttctttgattttttttgagttatgtaaaactgaattatttttaagtaactcttaatgtaaatgattgtttagtatgaatgtgtaaataagtatttttgggatttccctcaagtgacatgtcaattcagtgtcttttaaatatatttgagcattacatactttttatgtacgaggattctatgaaatatcttttgaacttgcaaggtctaatttcctcattaataaatcagttaaaatctttgacatatttgttttgtatttgtgtgaaatgtttaatttttaaaattatccttcaacagaacagaaccattatcacatgccaggccttactggatttaattccaacaacattattatggaaaaacaatcttagaaaaagtctcgtgttccccaagctcacaaaatggtgtcctacttaaaaaaatcaggaacaataaatttcacaacaaagtcaaacaggttggtaaaaagctggaaaaggcaatagtgatcactatatcgcagcttatttctagaagacattgggttagactatttctaatttactattttgacaaggttcctatacaggtagattacccaagtgcagcacgtagctgtcagcaagcctctcgacaaaatcattcacaagatgcatgtgcctaacaaaacatggctcagtgtctgggtggtcacaggacggcacttctgcttaagaattagaaccagtgcatggtgtttaataacgaaggcccgttttagagagaggtgcagggagaaaacaacccagaacattacacctaactctgcggcgactggttggaaagaactgggaatgctcaccctggttgaggaaggccagcgaacgcagagagaacacgacccatcttcaaagaaaaatgcagcaaacacgcggagaaaagaagttagacccatttctttagcgtcacaaaggagactgaggagcaatatatagatgttaacaggaagctggcaggtgtgtctaatgactacgctgcaaggaaggtgttttcaatgattaggctacaaaaaatggtgtttccagtgggtaggctacaaaggtgtttccaatgattaggaaataacagggactttatagagggtgcaaaacagtgaataggaagccttctaagcgatacgtattatctgctctaaccctaagaatcaacatttcttccaattttttaactagaaataattggaactcagatttaatgcttagctgggaaacttgttcgacacagtcagcagagatctgttctaaagaatgctttaattctttcttcaatatcgatgtgtcttgattgtcatactttttaaatattaattttacttttattaaaatgttattttttctcttatttaggaaatctcaaaaattattttaaaatcgaatagttcttacacttttgcacagcctcagatgcagtctcttctaataattaaaaaagtaaagctctaatttttacttgacaacttaccaatagtagagaaagcatgtatgtacctggtttatttcatccatcacttgatctgtagtaacagtgcttcactgtagtctcttaatacttttattttaaaggtatatgtcatttatagacatatatttaaggtaataacagatgaataaaatgagagggacccggggaaccttatttatgctttgtaaaaaataaaaggaaataccaaaacagtatttagaattatattccaaagaatagctattagaaagttattcatcatcactttgaaaagttaaaatatttaacaagatattctgcaaacaataagaaaaataattttaaacaaataatttataaaatattaattgctttgttatatcaagaaaatattgaaatgagcatattaggtgtaaacagcacttttactttcataactgtggacgttcacttcttttaatatagaaagttattttaaaataccattcaatatcattgatcttagatacttaaaaaatttggtatatataccctttctgtaagtgtgatgacatatgattaaacatagttattcacttttagaaaaattatagtagaaatttttgccataatattttgataatttacactccattctatgtaaatctacagtaacattacctatttatatttcatatatattatttttatatgtacacataaattatattgtttaaattcctcaaacaagtcaaaatattcaaattctgcattaagtgatattttaggatatgggcctgaattatgtaacattttctctacttgtgtttgaatttagataattacaaccttatagtaaattcctggaatatagattttaaaattccaatgattttccaaaccaatgacgacttaaaatttcaattataaatgattaaaaagttttaaattttaagccattttgtaaaattgtaaactctcatggttacattttcggatttagaaatatgacaatcaatgtgagttcttaacacaaaaggagggaaaatcagcagagacaacctgatgccattggggtatctgaggttgagaaagtggctggcttaccccattctcattgtaggtagtctttaatccagtcagcttacctgagtattattttgtttcataagcaaggatttcacaaagtaatacccagtgtctgcaaatccaaagaacccccactcccctcttgcacctgctttgcaattaggctatgcctttttcttgtacttctgcctctccatatcaatagtagttatgcacaaatacggacaagatgacattgtacatcactttacctaaacttggggagtttagtttcctttatctgtgaaaacaaagagcatatgactctaggtaactgtcaaaattaaatgatgtaaggtatgcaggaatgtgtagcatgtagtaacacataaatgttagtttcttttcaaccaaatggctttgggttttcttttaacctattatcttataaaatgacagaaaaatagagatagaattgtcaaataggaacacgcaaatgatcgtagcatatataagaatttaatatatgagagaggtagcttttcaaatcagtgaaaaagaacaaactaatcaataaataatattaaagcaaatggttttctactggggggaggatttaggtacctgtgtcaaaagagacacaaaaaattaatttcagaaagacccaatccattaaataagagatactatcaaagaaataaaagcaaatatatgcaaacgtataatgtatgcaattacaatctaaacgaacatacacaaaaagaaactagagagattgaaaatgataaatttgcctgccttacaacacaatttccacacatggaaataatcttcgtaagtgaaaatttaaatgtaagaacggcctacaagttgtttattataggtataacacgagacataaatttaaattatgtttatgtttataaatagttcagcaaggtgacagattaacgttccaaatagaaaaaaaacataccactcagacattataaggaagattttatgctggtgttgtctaacttgagctgattagaataagaggaggacagagaattggtctaagaaaggcagagggtcatagaagtgaaaaagaaattctgtagaatggagagagactgaaaatggaaaatcaaagttgctaagggctgcagtcttagagagcagattagtacaaactttgagcagatgtcatggggtttagcacttttgagagtgagagctctaaagagaacctttaggcggtgtttctgtgtgagctactacgtaacccattcctgggtgccctcaggaattacagagtaaactcttacacagttgacgttgaacaacaacgtggatctcaactgagcagtttactcccacgtggactttcttctccctctgccatccggagacagcaaataccacacctcctgtttctcctccccagcctactcagcatgaagaccatgaggaggaagaattttgtgaccccttccacttaatcaatagtaaatatattttctcttccttatgactttcttaacattattttctctagcttactttcttgtaagactatacatataacatacaaaatgtgttaattgacggtttgtgttatctgtaagattcctggtcaactacaggctgttagtaattacgttttgggggagttgaaagttttatgtggatttttcaatgcataaggggtcagtgtcctaacctctgtgttattcaaggattaactgtatttatttttaagcatttgaaaaatggatatgtgttttaggatgctttattatgtttaggctagtattaagcaagcctattgatatgattatggttgcctataatacagggctgtgaatatatatcttaaaagttgtggatggcattcaatactgtttatctatttcctccctccctctctcactccatttctatatccataatagtttgaaatctaaatattacaagcatgtctccaaattgtgatagcttcataagacagaagcagtatattaataaagagttaatgtatgaacaatatcaaatgtgttatgatcctgaaaacttgttgagtgtttctcttttttaatattcacctgtggcatcatatggaaggcaaccccatttgattctcgatacagagaacccagaattgtgttttttagagaaaaacatggactcagagataactagaaagtttcatctatcttgcaacctatacgtcttaaataccacccaggcacaacgttcttttcttagggttttttttctttttctttttcttttttcttttcttcgagacggagtcgccctttgtcacccaggctggagtgcagtggcatgatctcagctcactgcagctgcctctgggttcaagggattctcctgcatcagcctcccgagtagctgggattacaggcgtgcaccaccacacacagctaatttttgtatttttagtacagatgggatttcattatgttgaccaggctggtctcaaactcctgacctcaggtgatccacctgccttacgctccgaaagtgctggaattacaggcttgagccacctcacctggctcttttattatactttgttggtgttattgctgttggtttcattttgttgtctgtatttttgtttatttgcacagtcatatctttcattttccgtaattaatcagcagacaaaagcaatgtattatttagaaaatttctggttaagacagtgtgattttttcaatttaattatatatatttaatacataatagattaaatttataaacaagttacattaactattaaaagtctcttgtgtaatcttccaattaaaatatagtttgcttcaccagcataactgataatttctttttaacagaaaataaaacttttttaaaaaaagatatgctagaagatattatactttttattcatcatgatagagaccggatgtttataagcatgtatctattctaacacgaaatttcacatgtcaaatttaggatcataagaatatggtattagtattcagcacaattttggctttacattttggaattttggtagttaagtgtgattaattcagcttcttttaaatgtagtcatatatacatatggtaaaatcatataatttgggaatactcatctgaattaatactgaaattgaacatcatcactacttttcggagttctaaaatatgtatttataaaacagaaagggattttaaaataaaacataatcaaataggtctccacaacacttttagtaaaacactgagggtttgagactgcctttagaaatagcaactcatagtctaacaccatcccaaggctgtggactcccaggtcaaatgccagttcaagtcccgatttcaccactcactttatgaatagctttcttaatttctatacctccgtttgttcatatgtaaggattagatggcacagagagcacctgacacatgaagtcctccatcaaaacccatcaccgtacttccctggattccttacgaaaaaagcttcagtcaaaacataaactacaggcttttttgtgaaggaaaaatcccagggaatcaagggtgaaaagagaaagaaatgaagcagggaaggtaggtaaagaaaagcatgaggtgtgctgctgaatgccaattgctggctgcctaggatggacaggtggctgtggttacagggatttccctcccgcagggctggtgggaccccagccttgcagctgtgtcagggagagggaagagcaggtgtgagcactccttcccaccacctgtctcttaagagtcacagtttatccagtgggcattctgtgacccttccttatcccactgtcttcctgcgcagacacctccagctgagcccagcccaggtgagagggctcccagtgacagagctacctagggctagagccactgcagctcccactaaggtgtggacggtggaggctgagctggtcctcaccgtggggaagccgaggcgttggtgctggaaggagttaggctgtcatggcagccgaggggctctccacaagccatcggcaacgcctcgatcagtctcggggacttggtgctgagcaaaattggggggctcagaaactgagtctggtaaaacacatgattttcagatatttatatttaatcactataattaaaatgcagcattacgtgagtggcctggcattttcacacgatgctctatgacacacacagtttaaatgtacatctttttttaaaaattgcgagttgagaagttcctatttaaactgacttctgcacagagaaaggcactgtgagatatctaagaaatcgttgactgggtactggaagtgacgcaaggcatgtccccaaaggatagactgaaacaacctttgtcaattatgcacataccaaaagccattcttgtccaaacctcttactcacaatactgtattttaagtgagaacttttattaaggtggctacagatttggttagtatgtgctgtattatatttttggtttgtttgctttaactggacataaattctgaaaatctcataatcctcatttataactggtggcaaaacctgatacctgatcaatttttgcctggcgcatgatagctatgcaataaatattcatgcattccatccatttctatccatgcagaaaactgttaagtaccgggaactcagtgaattctactaccattcactttcatctcctctgtagcactccccgagttaaaactgattttaacctgtttttttatggggccataagacctacccctggctgttacgttcacaggcctagtgcctgtaacagcaaagatgggcaattttcttactttccttcttcccctctttttatattctttcactcgccaaatgattcacttcatgttaatactgaaaagcttccttagaaatgcttatttcccaatttgctcctaaggttgaaaatagtaaaaagcaactcaaagcaacatgagttgcctcatgtgacagtttaatttatttttacatcttctaagctctgggaaatattaagatttgaaacacacaagtccaaagtattgaaatactttgtaaagttatatatcttgtcagtaagtcacaaatgcctttagataaaaattgaatcaatagtttcttcattagctttcccccccaaaaaaactgaaagtagatgtataaatcaaagaaaatttaatacactgccttccatttaatgtaccgatattgatgatagtaaacgacattaataatgaagcaaaagaaagtattattggcagggcgttataaactatcagagaggaaactataaattttctaatgtcaagttaattttatatggccatggtgcatgttaactggttacttgtaaagctgattcttctccaaaatgcacactttttccttagctcatagaaattcataaaatatgtaacaaattttaatggcattcaaaatatttaaatattctttggagaatagtttcaacatatttcatatgctttgacatccatacttagatttttgaaaacagggctagacttaaaaagcagacaaatggaaatttaatttagtttctggcaattgtacttgactgaccttaattcacggaaattttctcaaccttagtttattaattcccccaaaaggaacgataattcctacactaaaacactgttgcaattcctagggaagataacacagagtatggcaggggctcaatgctattcaaatgtttacgtgtgtaaagaaataagacacagttatatctattttctggcatagagaaaattacaattctttaataaggttaatttataaataaatacataaataataatgggtccacaaccttgaaatgtcttcagagccctgagaagatacccctggaattacatattaatattgccagcatattatctcaggaataaatcaaagttgcatttgtttgcttgtgaatgtgtttttcttggtaagtatgaaaaaggaattttatacagttgaacagctgcactttaccacatatgtccggttacaaaattgattatagttagcaggtagagctttcacttcagtaattaagaaaccagaaaacaaaacaaaacaatatatttggtgcaacttaccatacaaccaaaataacaaagaccttaatggattctcagtagtttcataaatacctttgcctcttatttactcattgatcactcgtttcacttccagagcacaaataacatttttctctaaaattttagttgactgctttaaaaatgactttccagctgggtgcagtggctcacgcctgtaatcccagcactttgggagatccaggtgggtagaccacgaggtcaggagagagagaccatcctggccaacatggtgaaaccccgtctctactaaaaatacaaaaattagcttccttagaagctaattctctactgagaattagagaaaccccgttctctactgaaaacacaaaaattagccaggcgtggtggcgcccactcctttagttccagctactcgggaggctgaggcaggagaattgcttgaacctgggaggcagaggttgcagtgagccgagatggagccactgcattccagcctgggtgacacagcaagtctctgtctcaaaaaaaaaaaaaaataaaaagtcaacaaaaaaaagcaaactggataaagcaaacatacttatcctatcattctccctggagaatgtggtcgtgagttctgttagagaagtttgaagtagctgaaccatgaccagttaaaaggaactttgttctgtgctgtttcattgagaatctgttttctactattttcctaataccacgagagtgcattgttatctcacaaaaaaaaaaaaacaaaaaaaaaccgagaaggaaattactgctgtaaggaaaaagcaggacttctcatgtctagggtagctctgagttgacccccaggatgaatttgcacaaatcacttaacctgtgtgtttctgcagcctttgagaaactggttcacctgttagctgagaaaattacatttctcactagaatatttgagccttaatttaagtttgtaaagcgcgttaacatccttatctcgagtctattgcgagcataaccttctactctcataaaaaagcaggggcctcagctagttgtattagacaaccagatacttggtggacggaaatttctccgcctttttgcaccatgcgtcaagcggaggtcctgttactgcaatcagcacggtttagcttcaccttacaaaaccaagaatgcatgagaaacaaacacgtctgtgggccattctctaaaataggcttgcatttactaactccctatgggtccttgtgtagctgtgtatccatctctttctgacaaccacctggtatagaatccacttttttgaggtttcaaaatatactgcattatatgttgaagacgaggactcaggaaccaattaatattgagctgtgtttcctgaggccgactgccacattcaggttttgtcacaccattgtcattaatccctgggtccctggttaaagatctagattcctggggtacatccctagttgttgagttcatcatcttagtgactggccctagaaatctacctattaacagtcttccccaggtgattctttggtgcagtgatttttgaaaccttcacaataaaacagctatttgtttctatttctctcccaacccaagtagtgacaagatatgaatatatctaaatatcacctaagtaggaaactgccttttccactccagccttatttacaatgagcatctcaaggcttgagagccacacatgtaagattccgaatacacatcagttccagattatagtcaattgtgcttgtttagctttaccttcctatcagcagacctaagagtccaaatttagatttgtacgtgcccatgcacattttcctgctgtgccagccctatcacactgacccttatctttcccatttttaattataatgcattaaagtctatagcttaatctatcaaaagggttatttcaataaatataaaatgagacatctcaatgctaaggagaccttggatcacagttgaattggcagtgttttattttttcttagtgggagataaaataatgatgtgttcagcatgggaaggcatatgagatttgatcaaatatcttctcatttgctgttttaaagatagagaaggaattaacctgtttttatttggtgacggactaagctaatatttttcacgtgtgatctcatctaatccttataaaataaactttaacacatgaggaaataaaagcaccaagaggttaaatacctgagtccacagaccttgtaaatgcttcaggactcagtctatttggtttgttccatatattagactacttctttaagcttaaagaagtaaatattagatactgtgcctagtatatgccagagactattgtgagcacataatgggattaacttgtttaattttaataatcccaggaggtaggtactccacctacttctattttagaagtcaggaaactgtagcacaatgagatcaagtagcttgatcaaagtgacttgaggtgtggaaacaacagaatgcagaagcctggctttatgatccattactcttagctgctatattatataggctttatcagtacaagtctttccagagatttatgaattctcctgccacacccttccatggccacctttatgactgtatacaaaatcattgatacaaaggtagcaatacaataactctcttttaaaaaacttttaagttcaggggtacatgagcaggttacataagtaaacttgtgtcatgggggtttgctgtatagattatttcaccccccaagtattaagccaagtacccagtaattatttttccagatcctctcccttctcccatcctccacccttatagcccccagtgtgtgttgttcctctctgtgtgtccatgggatctcttcattcagctcccatttataagtgagaacatgcggtattcggttttctgttcctgagttagtttgctaaggataatggcctccagctccatccatgctcctgcaaaggacatgatcttatttgttcttatggctgcatagtactccatggtgtgtatgtaccatattttctctacccagtctattattgatgggcatttaggttgactccatgtctttgctattgtgaatagtgttgcaatgaacacacatgtgcacgtgtctttgtggtagaatgttttatattcctttgggtatacacccagtaatgggattgctggattgaatgttatttctgaatttaggtctttgaggagtttccacactgtcttccacaatggctgaaataatttacactcccaccaacagtgtaaaaggattcctttttagccacaaccttgccagcatctgttattttttgacttgtttaaaatagccattctgactggtgtgagacagtatctcattaaagaaatgcaaatcaatactaaaactcttaatttgctatttatgtttttttaaggaacttcataaagtaggggcatgtatgtaaaattttccaaatatattaatttttagtaagtatgggaggcgtaggtataaaacatgcaaaaatgaaaatagagtaatggagttaggtagtaaaatagtttagcaattgattggtttggctctgcgtccccaccgaaatctcatcttggattggactcccataattcccatgtgttgtgggagataattgaatgacaggggcagtctcccccatactgttctcctggtggtggataagtctcatgagatccgatggtttgataaggggtaatccatttcacttggttctcattctctctcttgccaccaccaagtgagaagtgcctttcaccttccaccatgactgtgaggcctccccagccatgtggaactgtgagtccaataaacctctttcttttgggaatagaccagtctcggatatgtgtttatcggcagcatgaaaatgaacaaatacaccagtagataaattattttgcttaatgctgctacattttctaaagctagctaattacatctaaagataaaaacaagtcattaccatttagaaaaccccaatgctttaatataacagacttctaatcgataaagcaataatgtatgatgtatgaaagtcatacaaacatgagtgacaaggacaccaaaacttatattggttttctctcaaggatattgaaatcaaataggtgattcattttcaatacaagcataggtgcagctaagactaatttaaaacagcaaaatgtgatttttgggctaaacacatatttaatccatttttgtaagaaaagcactgattttgcttgtcatgaagaaaaagaaaggttcaaacagttctagaaaataatcctgaacaaaataaataattaagaactggtttaccatttaaaattttattaatatgggttggtttgtgaaggtttcaaaaactctagaaaataacaaaatatttctgggtgtttcacaatacttagagtaagtcaaaaatgaaccgaaagggtttgcttattcaggccaagcatcatggctcactttgttgtataatgtcgttgtctctcattgacagtcctgcgttttcggagagagcacagccctgggagaaacatcccattgcctgttggatgatagggctgcattagacatttcttagtctgccaagcaatacctcagcatcagttcaaaatgaaagggtgtctgttaaacaggagagctggggtcatgaggttccacaacaaaggctagaaggatttgtggaggccgcttcccttatcagtggagtgattggactgcagcttggatgacacgaaaaaaaaaaaaaaaaccttgctttctgattgttttcaaaaattctatggaaggattttcttctaggaacaaggtttcattttgttttgtccctctgtcctgatcatttctaagttatctggatttaaaaaattttaacattgagagaaagagaaaggtggggtttacttacattatgaacactctctcattcacgaactatatcagaaccagaagacacagagagggatgggggttttccttctttatttcagtcagtacttgggcaatttgaaggaggcacaaaagagaacaggggatcttaagcaagtttggtaagtccatctcacaacaccccacactcagagtcatactgaatacacagattcatcactcgctctctcaggtatcaacttggagggctgacgtgacctgctctatgagagggaaagtgagacacatcttcctgcatggtccctacctgggaagatattgaaagaggaaaagtcaccgggcacgatggctcacgcctgtaatctcagcactttgggaggcagagacgggcggatcacgaggtcaggagatcgagaccatcctggctaacacggtgaaaccccgtctctactaaaaaatacaaaaaaaaattagccgggcatggtggcaggcgcctgtagtcccaactactcgggaggctgaggcgggagaatggcgtgaacccgggaggcagaggttgcagtgagccgagatcgtgccactgcactccagcactccaacctggttgacagagtgagactctgcctcaaaaaaaaaaaaaaaaaaaaaaaaaaaaaaaaaaaaaaaagaaagagtcactatgacatatggctttcttcccattttctactcatttctacccacacagaaaggagatgctgagagagggtctgtattcaggtttttccaaataaggtcttcggcataggctgtatgcatttccttagatgtctactgatttgtataaagagagtgtccttaatacttcttcacctctaggatcctacttttcatcccttgagaaaagatgaagcaccatcatgttcaaacttgcttggaacgcctgtcagctgagaacatttatccccagttgaaatttttaccaaccaaactcttcaaacaacctgtcttcatttttgtctttcacttgagttaacaccaaatgaaaccattgccctacagacggggcctgataaactgactctcacagagagaggaagggcttctatggattcacaagttccttcaaatatgtgtctgggctgggcagcaagcctgcttcttcagttcctgatcttaccatcaatagtcccttaatggaatggcaatattcttataattgggtgactttatttcttgccacttctatccatggatgttcaagctagaaaatggataatgctttctactattaaaattgatcttgtatgctatcgcagagcccaggtaaatgaggctgaccaaaatcaagctgttaacaaattaacaaaagaaatcccaaaataagtacataatcttaatcccaataaatccaatggctttacttttccaaagttggtgacatactgaaatgcatctgctactgacaaaagaaatggcaaattccaaaatgtggcaacatataaacgcaaatgtcaaaaaccccattatggtgacatttcactctgaccagggagtaagaagtggatttcctggcagccaggaagttcatttcaattattttgtagccacaaagttcatcactctgatattgatacacactggaagatctgcttgtgaatccctccttatgtaatagcaattatttttttctagcaatcctgacttcataaagtaataatatctaagtattaaaattaaatttctctttctctttcatcatacatatatatgtatgtatatatacatacatatatatatatatacatacatatatatatatatacatacatatatatatatacatacatatatatatatatatatacatacatatatatatatatatatatacatacatatatatatatatacatacatatatatatatatatatatatatatacgcacacgcaaacataggcacatagagcttttatccccctagctacaaataacagtaatttgcgacgattctaccaggttgcatcttaaacatgtatatctccttctcatttttacttccaggaatcataacatgatttatatttaattataatatagttgtgaactactatatattttaaaaatatttcttcctttatattagttttagattttaaaaattagtgatgtttatattgtacatttttatctgtttagtaatatttttgaagtaagcataacagaagcttatcaatgcatatataagaagtccatctttctgaaactttatttatataaatacgactcagtgacctaaacactgtgacatacatatagatggggaaactgaagtttggccactttgaattaagcaaaagtgaaatacaaagaaaaatgtacaaagagggttccccttcatggaagaaagccactgcctgatacgaagaacctgagtgataaacgatcctgaaaactgcctctgctctgctgcaaaggtgcctgcaaaagttccacttggctattgttattaattacacatcaagctcacaatgttgcacctaagataaaaagcaagaagaagggggaattagaatttaattaaagcttgtcaagcaggcagggtcctaaatggtagctcacagagagagatgcacagctgacggctacacacgccttccacatcgaggtgctgaggctaaacaaagttccactgaagagaattgtaatatctttccgctttctaattaagttggagaattttttttctttttgccatcttagcctcaaggaagaataccagatcatataaggcactatttcaagcaatgtgtaataatgatgaagtttctttcttttttattattattattatactttaagttttagggtacatgtgcacaatgtgccggtttgttacatatgtatacatgtgccatgccggtgcggtgcacccattaactcgtcatttagcattaggtatatctcctaatgctatccctcccctctccccacaacagtccccagagtgtgatgttccccttcctgtgtccatgcgttctcattgttcagttcccatctatgagtgagaacatgcagtgtttggtttttcgttcttgcgatacattactgagaatgctgatttccaatttcatccatgtccctacaaaggacatgaagtcatcatattttatggctgcatagtattccatggtgtacatgtgccacattttcttaatccagtctatcattgttggacatttgggttggttccaagtctttgctattgtgaagtttcaaaattaaagtagaaataaggcacacccttgattttgtttcaaaaaaaggatttttctgtaaaataattaagtccatttaaaaaattttgccaaaatgcctgtttagaggatataaaaataaagtgtactcagtctaactgccttaatcgtctaaagaaaatgtcctaaatatacttacaaaaattaattaacttaggcaagagagagataacaagggctaaacatgtctttatttccatttatctgtaaaaccagacacttaagattgggagggattaaatagacaaatgaaaatcaaatgaatgatatgaaaccctgtgtcgtagactgaatgtttgcgtccctccgaaatgtatatgtgaaaatcctacccattaaggtgatgctattatgagatggggctttctggaggtgagtaggtcatgaggatggagcccttgtctctttctgtctctgccatgtgaggacacagctagaaggcaccatctataaataagaaagcagggtctccccagacatcgaatttgctggcaccttgatcttcgacttacagcttccagaactgtgagaaataagtttatgttgtttataatccaacaacttaatggtattttgttacagcagctcaaaatgaataagactccctgggagctgaaatgccctgaaagacctctacttcatataaccacaggagtagttaacatgtgtaaagtgcttatgatatccaagtgtattctgaacacttgacatatagaaacttgtttaatcctcacaataacctgtggggggcttgatctcgttgcctctgttttacagagggcagaggtgaagtagtatgctcaaatgaatattcacaaaataaactagtggtgacagtagtcaccctactctgaatcaaacattggatttctacaatgtttttaaactggtggagtcggcagcagagccccaaaaatttatctccagatttgctgctttcaattcctgtgctttaacacatccaatctatagcaaaatactcccttacatcctctaaaaaggaacaccaaagaattacataatcatggcggtggggggggtgaaaagtgtggatatgtggcatctgtcagcatccccagcaccaaatgggccctcagaagtcagctatgacccgcgtcctgcgtatccaaaaaggaaatactctatgtccatatttcctctctgcaaagagatcgccagttccttcctgattcccctgtccttatgataaaacgacagaaatcctttcctgcagaatgtgcatgccttcagcaattactaaacatttttttatttttgagactgagtcttgctctttcacccaggctgaagtgcagtggcgcgatcttggctcactgcacgtccgcctcccagcttcaagcaattcccctgtctcagcctcctgagtagctgggaatacaggtgcgtgccaccacacacagctaattttttgtatttttagtagagacggggtttcaccatgtcggccaggctggtctcaaactcctgacctcaggtgatctacctgcctcggcctcccaaaatgctgggataacaggcgtgacacactgcacccagtctactaaatacttcttacatattttctacttaaggtgccctcctttttctaagaataagcaaggagctgcagaaagttctgggaaaatgtctcaaagattcaatgcataaggaaaaacttatttgagtattttgctgttgtttgcttacacacatccatgtatatttcacatgcaatccccaccaaaacatttaccattcttcaaagtgatgctcaaagtctttttatatgttcaaaaactataaaatgggtgctgaggggaacaccatatgccccaccagaaacgagaggtggttggaatatgtaaagaattactctcaatgattgtgtggcagacaggctatgaaggtgccaccctccccatccctgccttctggagtcataccttctctttagtgtggcatggcctgtgacttgcttctggtcaacaaggagctaaggtgacggcatgcgtgtgagcacctatgtttgatctggcaggtgagattgcagcaccctccctgctcacaccctggctggcagggaagaagcagctgccgcggtgtgagatgtttgccatgaaaagcagatccttctttagtaaagcctgagaggagaacatagtcaggctgccacctgacttgcagccttgtgaggtcgtaagcagggtgcccagccatgccttgcccagactacgacccacagacaccgtgagatcattcattcatgctgctttaagccactatgtctgtgatcgtcattaagtagcaacaggaagtgaatgccaattgcctttgccacaaaattgttgtctgtctttccaggtcaatttacgatactcaggtaccaattttttttttttttttttttcagaccgagtcttgctctgtcaccaggctagagtgcagtggcaggatcttggctaactgcaacctctgcctcctgagttcaagtgattctcctgcttcagcctctcaggtagctgggattacaggtgcccgccactgcagccagctaattttgtgtattcttagtagagacagggtttcaccatcttggccaggttgatcttgaactgctgacctcgtgatccactctcttcggcctcccaaagtgctgggattacaggcatgagccaccatatccagcccagatatcttgtaagtgcaaccattgcttaatgtcccctaacttagtttctaaggaataaaatgtgtatttcacatctgtcctatctactattggttttaacttttagttttttaatgacaactgattaattactttaacaatttaaattacatatttattcatcacattttttaaacaccagccacgttccatgaactgtcatagatgctaaggatatgagatgcagaattcttctcatcaaggagatcacaaacaagagaaagaaacaaagactgaaatcaggagagggaaaaatgcccatttgacccatgctcagaatggtcttaatatacagaagagacaaataagagactcttaacttcaggtgcatgggagacaacagaggccagaagccaggataacccagggtcagattgtgcactagctccactaggtcgggcatattaattcagttctaggtgtttctgttttctcacaaataaagtcggaaacacattatcctcttgcttatagtgttacaggacgtgatttaatacacacaaagcacagcagtggtttctaggactataacttatcacaggagtggataagggagagttttagaagaaacaagagaactgttatgtgaaccacagggaggagttcacaggctcacagtgtattgaggctagggacatgtaggcagctcctatggtacctggctgtggtgaggcggtcgcctgccaggacctaataagacatgagctattaatgggtactaggcttaatatgcgggcaatgaaataatctctacaacaaacccccaagacacaggtttacctatgtaacaatctgtacatgtactgctgaacttaaaatacaagttaaaataaatagatacaacttcaatactaaaaagaagaaagaaatgaatttagagagaccatcacggaagatcccaagaggagatgcctgacgtgccaaggagtgcagccttatctggaaggggacaagtctgggcgcacgtgtccaggattttctagcaacatccattatagcgatcagccctgggtttgcaatacagttaaccttacgccctagctgtgataaggtcagcaaaactgcctgtgaaaggatatgttaaacagctatggacttttgttggtgtatcattttggtaacttcacctccttcctcccacatttcatagtctgtctcctggaaaatgattttgcaatgtttaaaaaaagtgggcaaaaggtctgaacagacacctcatgaaaaaagatacaaggagagtaaataagcatatgaaaagatgctcaacctcatgtccttagaacatgagacaccactacacaccaatgaagaatcgctaaaatccagaatggcaacacaaccaaatgctgttgaggttgtggggcaacaggaaggctcactcactgctggtgggaacgcagaatggtagagtcacgttggcagacaagtggcagtttcttacaaagctaaacacagtcttactgtacgatccagcaactgtcctctttggtctttatgtaaatgagttgaaaagttatgttcacacaaaatctttacaaaatatttatagcagctttattcataattgccaaaaattggaagtaaccaagacattcattaatagatgaatggataaactatggtacatccacatagtggaatattattcagcaaaaaaaaaagaaaaaaaaagaaacgacctgtcaagacacaaaaagacatgaagaaaatatggtttccttattattctttttagatacagggtcttacgctattgtccacgctagagcacaggagtgcgatcatagttcactacagcctctgacttcaagggatctgcccacctcagcctcctgagcagctggtactacaggcatatgtgagcatgctcagctaacgatttaatgttttgtctacacgggatcttcttatgttgcccaggatggtctcaaactcctcgcctcaggtgatccaaggagaaaatttaaacacatattactaagtgaaagaaggcagtctgtaggatgccaaatatctgacattctggaaaaggcaaaactacggaaggtgaactcaaattatattttacatcacaagtaaacatgagcttagattcctcagtatatataaagttgatttcttttaaaccacatctgatcattataatatttctcacatgatttgctctagtttttagaagtgaaaacaatataatcgttttcagtaaagggattaaatattttggtttaattatgtccatgaagcactagtgccgcctttggatttatatttgatcaaaatatgtagacaactgaaggtaaaaggatttttgagaatgagtcgtcacatgtagacccatggaaactgaccatgggcacaggtaacacccaagcaactctatgggacacaaatctctttccatacagttcttgatccttattcagagcacacagtaatttactccagatgctgcttctcatgcatactttgttatacagaacatgcttgaaaaatacatttttcatttaacatgggcctgtgctatcaattagatggaagaaactgtcacaggcagtgaaaactcttattaaaaattgatttgagtctagttaagtctcaacacccaattccgatctgaagatcaaggttgtgtcagaataaaggccaaaagaaaaaagatcaatattaaatatttcagttctgaggttaatacatttgcttataaaagtatactgaaccatctgtattctggaagacctgctctggtaccgtaagaagactagatttttttttaaaggcagcaatagtattcttcaccttaagacagtaagcgttatatacctacattggaagcacaaaaatatattaggtaaaataatttaagattgtcttaacaaataattgtcattcttcctaaaagttaattttaaaatcctaagagagagagagtttgtgcgtgtgtgtgtatgttcactcttaactaggcacctaaatgatggttgttagtttggtaaaggattactactgatacaaacacattctaaagctactgatggtcgggactggtggttcacgcctgtaatgccaacactttgggaggctgaggcaagaggattgcttgagtccaggagttcaagaacaccctgggtaacatattgggatcccatctctacgaaaacatttttaaaacattagccaggcaatggggcatgcacctgtagtcccggctactagctgaggtggggagattgcttgaggccaggaatttgatgctggagtgagctatgagcgtgccaatgtactccagatcgagtgagagagtgcaactctacctcaaaagaatatcttaaaatatcaaaaacaaaaacctaataattcaacatttaaaaataatttaaatagaatcaactctatccctaagaatagtatttactaagctgaggaggagccactagaggacatcattcacagcaggacacagtttttatttagttccagccatgactgacctcatataaagaagcaaagaccaagaaattaaaatgatagacactaacaactgacttgaatttttaaaaattggttaaaaaggtcaacttggttctactgattaacttcaaatgccttaagcatgtacacatagatataggagaagacctcagaggccctgggggaaggaacatgaatggtattcttgggtcccatcctatctagtggacaacacaaggcttccaaagggaggtgtagaaaaatgaagagagttagagtagagaaaactggggtaagatattgttgtttcaaaaaccaatattcctgtcagccacataaatgttaagaaaccagctctatcttccttaccaaaaacagatttccatgtaaactgaacaaacgtaaaggaagaatgtcatttactttcttcttataactttcatagacaaaacatgtaggttagtagttattttcatggccatggtaaattgcaattgctcagtgacatttgagacttactaaagtgaaatatgaatagattttctattttaatattcacaagtcagtttccctacaattagtttatcgcatatattgcttgaaaacattattatactttcatgtgaagacaattctatccaagttttacgtttattttacaacaataaattgcttctatctaataaacattattggagatttatctgggctatggattaaaaataatgcaagtcaataaaacttcacaaattacactaactatgggttttaaaagaaagttcgcttcatccacatttttgttacttggcatcttcatcaccattcctgccattaaaaaaaaagaagcctttgaattccagtcagttgggttaagtatgcaaaaatggctgcatagattgtcttgttgattacctattctctatcatgattatatctttctataattttgtggaaaatagactaggaaagagaataaacttagaaaatagagtcagggtaggtagcaattctacctgaaacatggaaacaaaagcttaaaattctcattgttaggacaaattgaaagaagaaaaaatacgcagtgatatacataattaaaaggcagcagaaaaaaacagtggagaaaataaagaaaagaagtactaaagagggagaaaataaataaaagcaacaagagatcacttagaacgtggcagaaaagcactagggacagggagacaaggaaagaaaccagattcactattcaccctgcttctaaaacacatggacaacaggcagcattattataaacaagtgaggtaggaaccgggacttccattatacttagcattacccagaatttcatgagaaatcctgggatttttataaaaggattaataatgggaaactacctgaaaactataaattgctgtcataaaaatgtgactaatacaaaatgatttctcagctgggcacggtggctcacgcctgtaatcccagcactttgggaggctgaggcgggcggatcacgaagtcaagggttcgagactagcatggccaacgtggtgaaaccccatctctactaaaaatacagaaaattagctaggcctggtgacgtgtgcctgtaatcccacctactcgggaggctgaagtaggagaattgcttgaactcaggaggcagaagttgcagtgagccagtatctcgccactgcactctagcctgggtgacagagcaagactccatctcagaaaaaaagaaaaaaaagaattgctttttagggcacaaatattaaaatgtatgctgcagaccttgtggaagaatagatgagataaaaatgtaagtaaaatactatcaaattatctggcccaagaaaggttagcttccctccttataggagagttatattgttgatttggtgagatctccactaaatattttaacattcaaatatactttcttaatagcccattctagctaacatttgtcatagcctctttatcaacaaatattagaattattaatgtaagtggatttcatttaatttttctgtgttttttgctccatcttaccctcctaaccccaggttaggataaattctatatggcaaatgacaagaaccaaaggtctaagtactccaaagtgcaaatagtctggccttcagcaactgcgactcgtgtaattcctacagagatacttaatgtggtcttaattggcactgttttctttttcttttgttccacttaaatgatgccaatcaaattttggcatacatgagctaagttaaagaaaagtagcaatgcctagttttgtcgactcgcaattcctttgaaaccatactatgaagagaaaatttaaattccatgtttatcctgctcattttcacttttgcaaagagaaaaaaacaacctgagttttgctatctgtgcaccacagcagtccgtggctgggataaggtggattgaagtgtgaacaatggttcaggatcaaaggactccttaggttctgctcagactgcctccagtgatcagcagcgcaggagtccatcctgacagggggctggagagagctgatgagattcatgtgccatctcagaaagaaaacataaaagcctggacattctatggaaggcaagccaagagaacgtggaatctccgtttgcggaacttgtaagtcgggtaatataccagggagtatgttaacacggctgaatgacctctgttttgaacttcgcctcgcctcctgccttctctctgctccttgtggctctcttgttattgttattcctggtttgttcctcctctccctgtctcatagctccttttggtctccccctccctttatcctgccactctgacaaagcaggcacagcacttgcattcaatcatcagctgaaaatgagtaaaaagctacttgcctggaacaaagctgggagtaattttgaaagcatttccttagagctgagacatcctgagacatggacttttgatgggtaatcaaggtttagaaaaatgagttcacagaaggtttacaatatcaggacagatctttcccaggctttccagaccatttaatgcttgttttgtgaatcaaagagcgcaggcacagaggctggaggaagcaaactaatagcttacaaagctacaaaacgaaagggagacaataaggcttgaaaagaaacacttacaaaaataaaataaaatacccatttcctctctgtctctttctcctgcttctgtgagtactgctagacagacgccatcgacatttcagcagcagtgacatcccagacagcttgtctatagcccttgactcagttttttggtatttcttttagtagaatattccagagcatgtggtcttttacctttccttggcctccagactgtgctactcctggatgatcacttcctctaaactcatcttcatcatgatgttgaatatcattacttctttgcaacccaaagcaaggaattttgaaacgattatctctcacttgacaaagtaaatctatttatatagccactggcctggcactacaaaaaaatcaagttcttaataaatgctgtcaatgattgtattttggggggaaatattaaccgcttttcaatttatgcataacctttccaggcccaattgtgtttcacagttataacctgtcatctctctttagtctcctttcccaaatccagcttgttctgtatatagtagctccactgaggagcagggaggaaagacggatgagtggagtacacatggtggatgctgccatttaggcaaaggcaggcatttaagtaaagacaggtaagaatgggaactcgtgccccagtgaggaaattaccatactccaattaaagggaaggcagagcataaatagtgtgcaagctaaaaatacacaactcctttcagcacaaagctccccgaaacaattctgcaagaaatatgtgtaaggtctgaagcttagcagaaagattggtagcaagcacagctgtccagaatcaacggtagaaaaataatttctttttctttggtgcagtcgtagaaatgctcaggcatcctgttggcgtttgaatgcatggtgccttcaagaagctcacggacacagacctgcaactgcccgtggggtttcctaaagacacaacaggagcgacgtctgcgtgtaaaatgacaagtacagtaaacgtcccgcagccccaggcttcattgtcatctgctggaagtgtcctccatgtgtgtgagataccctgcttatacatctattttagtcctcaaacatggaaataatccactttgtcctttgtgggacttaaagtaacctaatcggggagggacacgcagttatctttctactgttaatgctaacccaatgcttagcagacggggttgaacgatgattgttggctgactcaactcttgcttagcttccatcaaagtacaaactacttgtttccaaggttatttgtgagtgaggttgatttctattttatttaactatttagacacacacacgttaacttatttcttatgtatttatataatcttatatagcatgtgcatatttttgtatatatttctaaatcagttcataatattaatgcatgcttcagaggcatttacttaatttttaattttttaaaatgaattttagttcaaacttttaattttaaaattgatttaaatcactaaattaaattgaattttagggagggataggagaaaatgtccagactcgtactgaaacttgcagaaagatgattcaattataaaatagttcattcaaaatagtgttgtcaaggtaaaataaagttacttctttctaattttatctgcaaagagggagctcatgtttatcgagtacctactttgtggttccagacagttagctaagccctctgaatgcatcaactgtaatctctaaaagtagtcaaccttcattttatagaagaggatgttggccaagctaacagagttattaccgagattccccctggagacttggcagctaagggtaattgtctttggtttctatgcttactacaccccagaagtcaaaataatagcaatgaagatgaaaatgatttagatcacagggctcaacattacatacacatggccagtggttctatacaaactgtaaagctaaattccttagaattaaaaaaaagtaattgaaacattttctaattaattacccaggcatagaaatatctagtacagatctcttaagaatacagcactgatgaaagtgctaaaggacacagaaatgaaatgttaaaatgcagtcatttctgtttagggatttaaaccaagataaagaaacaaaaccaacaggaagatgccatcaaaggaaagcaagacagaaaattgaggagcctcagaaagacttcacaaacaaggtgagtcttaaataaatcttgggattctggataagcacaggaaagaagaaagcagcccaggtaaaagacgtcatgaaaaacgcttgggattaagaaccagggagatgcccatatggggaagtgtgagctcttcctggtacaatacaagcaggcaagtctgcagagaggggtcaggttcttattactttattgaggcatgcacacatctgacagacgaaactgctcttccacaaagagtgattctgaaggtcctgcttggtaaattgcaagaaccagcaagactttcaaggagttactttatcaactagtttaaacaaggtggataagcgataacatataagagggcaataataaaacaaagatattaattctgtaaaaggtcaacagtggaatacattattacttcattatatttatcgcccctgcgagtaggtatgttataaatatcagattttagtgaataactttaataaatgcatttgaagttaaagtgaagttgatatgggcattgacaagaatattagaaaaataagaaagttagtaaaggtgaagagagggaaggaagggaagtaaatttgcatacaagagctatactgagatctttaaagtaaatgtatttgttaagcaggtaaatggaaaatatcaagggaaagtaatggttagtattgtattcattgccacagatgtgatggctgagatgtgagaataaattatctagggtagtatgcatggaaagaaaaaaagcagatatctatgaactaaatcccagaggacatccacaagagagaaagaagcgggagaagttgtaggaggtgaaaagtataaagaggctgggagaatacaatgtgtctgaagagaagttatactaggtgaaaaggtataaagaggctgggagaatacaatgtctctgaagaggagaagttatacgaggtgaaaagtataaagaggctgggagaatacaatgtctctgaagaggatggaactccagggagaggttggcttagtgaatataaacatcatgtaagagagatcatagaaatggatcgtcagcgagtgtcaattatgccaatttttgtgcataggttaccagggatattctgtaaccaccacacagtagaatcactaaacatataataataaattgagacaaatgtgttcatatatcacagcccgaaaaaataatgaactattactgtagacaaaaacttgcgtagatcgtgtaaacaaactattgaacaaaacaccagaaacaagagaatacggagtatgactccttttgtgtaaattgaagcatttaagatgaaggaatctacagagtttatcttgggtgccacagactgttactaaaaagaagaacaggatagctgttctaatggcattcggggaactggttgtttttgagcgggagagagggacgaaagtgagaggtgttagtaaatgttctagctctggacactgtgggagtggtggaggttttcctcttgcgataaagaattgagctgtaaattttacttttggccagtttctgaatgtgtgttatgtttggcaattttaaacaggtttctaaaaaggaggcatgttgacttacggaaaacatgggtagaggtccattgcctggaggatttctatttatctgtctctggcgtaaccttattccacgttctctgcactaaacaaaggtgtttgtataaccagtgatcttttacaacttgagaacgagtacccttgtttttgaccctttgatttgtatgcaccaagaggttgatgatgtccaaatggaagttattattatttgtttgggagtaactaccttgggttatgacatctgagacagtgggccaaaaaagatataataacaacaacaaaataaaaagggacaaccatgaagaaaaggagtatcatgacacataatgatatctcacatatatgtgtatatgtttatgtgtatgcatatatatgtatgtgtatatatacacatatatattaatatcctctataacattgctgggccagagatagaatttactgctagatagtttattcatattgtgatccccgaacaggatgcttaaaaacatgaatgattgttttgtcttaatgtaagattaacggtcatcatctcatttaaggtattctttttatttttattaggcatcatttaaacaactattttaggcaatagaacgtagagcaaagggaagactttgaagaagtcgaggtggatatttcaagaatacttttctcatgtcaacataaactctcttaaatgtttcacgtgttctcctcatctgcagtttcactttctgtggtttcagttacctaaggtcaactgtggtccactgaggtctgaaaacattaaatgaaaaatttcagaaataaataatgtataagttttaaattgctagctgttctgactagcgccatcccactccatcccagccaggacatgaatcattcctttgtccagtggattcacactatctacattagtcacttagtagccatatggcttttcagactcatggttgcagtagtgcagcatttgtgttcaagttgtcgttatttgactttataacatgcaagcgtagtgggccttatttataaatgaacctttatcagaggtatgtctgtataggaaaaaacatgctacatgcaggctttggtgctgtcaaaggtatgaggaatctactgggggttttggaacatacccccctagaataagggagagaactgtatttagaggtgtaactgaaatgcattttaataatgggcatgcaagactcaggctctaacctttgcagtctgaagttaagaataacaattatgtccacaaacaagttaaaaaattatttctacatatgttacctacaaacctacaagcctaccaatctctaaatttctaattatgggttatatatgataaaaataacttcatgattactcctaaaacagtaatcattcttatgaacagaaacattttttttttactattgcagtagaatgagcagaacgtagaactagaaagttctgggtgcacattcttgcactcgcatatcattttagattctccgaggctcagtctttacagtaatacgaggacaaatgcatagatacaatggcaattctataaagtccctactgcagtctctggcatataataattgctcaaaacaaaaaagacagagagaacaaattctttcccaccctttgtcagtgattatagctgacgaaatagtaatatttctccaacaacagtcattaccaaattctgagggccatgaccacgtcattccatgcaaacacacattaaaccccataagtgctctacattatgttatttcagacaaaaaacttgtttaaccattgccactcctcattttaaaaaaggactctatatatcctgaaatctcgcatttacttttattaatttttaactatagcatttcttgttgagttttcttttctctttgactttagtttcagcctcatcagtatattaacagcagatctttgcttttatttgtgtatgatggttgtagacagtacattccacaagagcatgaccaatctgttggactcaccagtaaatccccagtgtgtatgacggtgtgctgcccatagtaggtactcagtttttcttttgaaagaaaaagtttgattgaaaaacagatcaaccaattccttctggtgtcttttaaattatatgtctgtttggtctctctgtctctaaatggtataagagattaaacagcctgaaaatcaatattttctggcacaggaaataaaaaaagctatcataattgaaacgtttatgaaaataccttttacttaaagaactatagttctgtaaaggtgcataaatgaacaagaactgtgaatttgaatcttagagaactatgtgtaatggatatgctttttttacgtgaagtgtgcttttaatatatagtctctcttatcatccgtctaagccaggtaattcctcttgtactgtaaaagtctacagcgtcatagtgtctatgatcattgcactttgccatggcagcctgcttgacatttatgataagaaggtgttgaagtatttgctgtcattcattcaataactattgagtgactaccatttaacattttttatgcctaccatcatactcaacttttgctcaactgttttgaatgtatcagctaataaaataagtcgagaaaatacatttatattcgcaatatgtttccaaataaatttagaaaaagatacttacctatacatattattatattcttagaaaatccaagcactcacacctgagacaccgttaaatccaataaatgattttgtcaaatggattggtatatgataaacatataaaaataaaaataactgcattgacccagccagcttgagtaatgatcatcactgcaaccgaggcccaacacatgattttttgctaacttggcctgatgcattaacctggactcgtctaatgaacaagtgggagctggaaattaggggacagaaatggggagattcgggaagctggtctgtcctatgtctcgggaactatcaggcactgtgacaatgtgaattattgtcatcacctatgtgcggcttttaaaaggcatttttctcagagaatattcttgatggaatcactggtaaacaagagattttcctctcctacctgattctgcttcaaaattaaaccgaggtctgtaatggaatcatcacataatccagcaacactacttgcatattcaaaaaaaaaaaaaaagaaaaaaaaaggaaatcaggatgtcaaagaggttatctgtgttctcatgttcattgctgtgtaattcaaaacagtggaggtacagaaaaaatcctactatgtccactgattgatggataaagaaaatgtggtgtatatatagcccatggaggattactcttcactcttcaaaagggagatcctgccatagcaacaatatggatgaacctcaaggtcattatactgtgtgaaccaagtcagttacagaaagtcaaataccgtaggattccatttccatggggaatctacaatgcacagaagcagagaaaagaatggaggttgccaggtgtagggaagaaaggaaaatggagaattgctatttaaggggtacatggtttgggttatatctgatgagtatgttctggagatccgatgaacaacattgtgcctacagctgacaatagtgggttgtacacttacaagtttgttaagaaagtagatctcatgtgaagtgttctttatttaagttctggaatacatgtgcagaacatgcaggttcgttacataaatatacatgtgccatgatggtttgctgcacctatcaacccatcatctaggttttaagcctcgcatgcattaggcatttgtcctaacgctctccctccccttggcccccacctcccgacaaaccccagtgtgtgatgttcccctccctgtatccatgtgttctcattgttcaactcccacttatgagtcagaacatgtgatgtttggttttctgttcctgtgttagtttgctgagaatgatggtttccagcttcatccatgtccctgcaaaggacatgaactcattattttttatggctgcatagtattccatgatatatatgtgccatattttctctatccagtctgtcattgatgggcatttgggttggttccaagtctttgttattgtaaacagtgctgcagtaaacatacgtgtgcatgtgtctttacaggagaatgatttataatcctttgggtatatacccagtaatgggattgctgtgtcaaatggtatttctgttctagatccttgaggaactgccacactgtcttccacaatggttgaactaatttacactcctaccaacaccaatataagcacaaatccaaaaacagaaaaacaaaaccaaaccccacaatgataaaaacctggtggctttagcttgcattgtttcctctagatttaaataatccagttagaggtcttgatttgtagagaaagtttttccttactttatgaaaaaataataatgataaatgtgttctttagaacagaggaaaatcaccaacgaggtaaaagagaaacagaaaactgaaaataagtaaacaattttactcagagatcactgaacctaattctgtaaataaatttctaagatgataaataaagatattaaatcaataaaactttgaaacaaaatatctcgatttaaacagtaataattggtattttatttcagaactaatatgctattataaactgcttaatcatttaatttaatttttctgattcctcagaatcttgatattcatatactatcaaaataatgctattggaatggatttcttacttaataacttagccttgtgcttttcagagagaagtttctttctttctaacatgaccaaaacttgcagtccagtgtccatgttgctccagttttgctgagggagttctaagagctttcatttcttcatctgccaatgaagcctttggacagaaccctaagctacaactcagtggcttgtaagttttgttcttaccaacatatgagttccacactcatgttcaatatttttttttttttagatagagtctcactctgtcacccacaatagagtacagtggcgcgatctcatctccctaacctctgcctcctgggttcaagcaattctcatgcctcagcctcctgagtagctgggattacaggtgcatgtcaccacgcctgggtaatttttgtattttagtggagatggggtgtcaatatgttgcccaggctggtctcaaactctgccccaaacatatttttgaacatctaacatgtaaagcaatcaaaagccattcgaataaccaaaattaattaccacaatagtctttctaggagttgccaacagcccagttactgctgtattagattggtgcaaaagtaattgcggtttttgctattgaaaataatggaaaaaatgacaattacttttacaccaacctaatagaaattacagctattggagcacctcactaatgtgttccaggaacagacggattcatggaagcttcggtgatgaaaaaggaagagtaccagctacccactgaaacccacggtgggttagaccgtagcacccagactccttttccatgagcccaagtctagtgcaaaggggagagagagaaagtgatgaacgccgcacttcaggcctagcccagcaaacttcccactcccctcccctatgctaagggatctgcagcccctcttcattcagaaacaatggcggatggcaggaggcggggttggggatgggaggacccagtggaagggacctgggtctctaaatattacacggagaggaagtcactaccattctaaacactacccaagactttcacatgagcaacaaacaaccttgttttacataagaccctataatttcagtgtgtttttcacagagcttaacctcctctgaataaggagtcagcttctctttccttcagagtgtattgtttcatcagcttatatatggttaaataagcataaatgctttaattttcctgaaagagccacctctaatttacagaataactacacatcttttaaattaggatagaaatccatgtcttatatttgtacgattgataagtttataacataaataattagggagcatttaatttctgtatcttaggtacatttttctgtctttaaaatataaggagaaaggtgatcgaatacatttttttcataaacaaaattgaatcggtgaaggaattcctaagaatgcttttccaggacattttcaaaattccttgccttttcaaaaggaaataaacacatatttagtaatgcttattgattaccttgattcctgtttattatcctacactttgatacatttcataagattaaacttttacattcttccatatttctgaaagtttactgaaaaaaagtattgccatctgtttgttaataagacacaataaaaaacctagatagtagatacccatgcaaaagttagctcagtatattacttattttctctaaaaactattttcattaaattctagctcagcacttaccttgtaaaagaataattgttcaattaacgccaccctaatctgtttacaagactctcccattagatagttggtgctatatataacatagactccaaatatttgttctgctcacattatccagtgttttatgggtgccaggctgtccttatctctggctattgattacaaataagtaaaatacaagagtctaaccctctagaggcttatgatttttaggggagaaaatgacatagaagtattcaattcttatgcatggacatgcatgttatcatagtggcttatataatgggccattggtggaaacatctatttccaattgtgacaaaaaagaaagtttgattaagtgggagatatctgagcaaggcaatggaagatacataaatactcaccaggctgaagagaaaatgacattttcaagctaagaggtagatcagtttatctaaagacatcttgatgattgtctataagagttgtaatgaaacagaagctttatatgagaatgtctgcttgtatgaccaaaaggtttctttggagctgaaggaaaaattatacactggtcaatttcagtttaacatctttgaaatgaaagtgaaagatatttggaattatgtgaataggcagtgaaaatagtatcagcaggaggggaccctcatagtagagacaagtgtgagaatcctacgaacacagacaaaactgaacgtttctcagtcacaagagagaaattaaaattgtccctattaaatgagcatctggagattgtgagctatgtagaaaaaaaataccaaaaaaaaaaaaaaccccaaaaaacaaaaacagtgaaattgcagatgtaggaggcaggggaagaggtaatatttttttttttttcaattctgaggaggtgtcattttaagcatctccctgataccgcccatactcagttcatttaacaaacatttatttttcatcagctgtgtgtctcactttgctagatgcattggagtgatataaagataaagatgatatgtttttccttcgagaaaactacaggattgtataagatgggacttccagttagttcaaatatcagtgttaattttgatattgaattttatacataatctttgccatgcttcaaagtcaacccacttagataccaatgaaacaagtaagaattttattccagaatttaatttagtagtattttctttctttttaataaaatcatccaaacgttataaatttgcaagatgaagtttactgcatattaaagagatcaaagagaatcagaatatgccatattttcttttataaataaatgagtcaggagattggaagatgtttcctccttaccaacccccaccctctgaaaaaataatgcttgataacaaggcagctggtagtgggtctggaaccatttttagctgcttcaaaggggaatcagatgtactgaaatgtaaagatgtaaaacactcataaattatttcagtggaatgtcaaaacagccagtcataatatgtctactatttaaaaatattaaattttagtggtttttttttggaatgtaagctttctggaagcttttagtagcatttcttcctagaggaaaatgcctaaataggatggtgcacaggggcataaatcccacaggacaggtccaatgtgagggcagcctgagctttcctgcggctgtgacatggatgtgaagtctgtgttaccagggtgagaaaagacaacatgagaagcaggaattccagaagtgtgagtgcaaagatgatagaagaggagagtgaagaataaggcagagggaaaaaagaaaatacttggaatgataaatgaagtaaaataaacaatagaccttttagggagaattgaagtattaattctttctttttaacaaaatcatccaaacattataaatttgcaagatgaagtttactgcatattaaagagatcaaagagaatcagaatatgccatattttcttttataagtaaatgagtcaggagattggaagatgtttcctccctaccaacccccaccctctggaaaaataaagcttgataacaaggcagctggtatttggtctggaaccatttttagctgcttcaaaggggaatcagatgtattgaaatgtaaagaattaattaaagaattaaatactgtgttccagcaagagcagtaaacctaagccatgggattcttactagacgctgtctacgtctgctacctcctgtaatagagaggaaatcacatggaaatggaaaggatgctggtcaggaaagccagtcctgcagagcgaaagcagacacaccccagccaagtcaccctgcagaccattatcatcaagttctttgtgaggaggaacagtgctaagtccataataataatcacagtcatgctgataatagacacttttgacacttattaagcctcattctaagttctttacatgtgatgatttacttagttgtcacacacactaaatatcatattatcattaccacccccatgacagatatggaaactgaagcattgggatgttaaattgccccaagattcacagctggtgcttagtaggacaagaagccagctcctgtcgccctgacagggtgtttatgtggtttacctgatagaggtatatgaaagccttaaatcactattttatgattttgctgtgtctccacccaaatctcatggtgaaatgtaactcccataattcccacatgttgtgggagggacccggtgggaggtaactcaatcttgggggtaggtctttctcatcctattaacttgatagtgaataagtctaaagagatctgatggttgtataaaggggagttctccttcacacgctccctttgcctgctgccatggaagacgtgactttgctcctcattcaccttccgccatgatagtgaggtctctccagccatgtggaactgtgagtcaattaaacctctttcctttataaatgaccaagtcttgggtatgtctttatcagcagcatgagaacagactgttacacactacaactaaatatttcccaggttagccatacaggtattcttatattttttgtagacaattaaaaagcataatgcctaaaaaaaaaaaaaaaaaaaaaaaaaaaaaaaagcaaatactttgttccaaacatacgctttattaactaagggacaagggaagagacttcctcttctacctcagataataattagcttcatgaacttaggtgagtctcttccctactcaaagcaatcttcccttccctcttcccttccctcttcccttccctcctcgcttccttccttcttgccttccttccctcctcccttccttccctctccccttccttccctcctctcttccttccgtcttcctttccttccctcctctcttccttcccctttcccttccttcccctttcccttcccttccttgcctcctctcttccttccctcttccctccttccctcctctcttccttcccctttctcttccttcccctttcccttcccttccttcactccctcccttcctctcttcctccctccctcctccctcctcccttcccttcccttccttccttccctccctcccttccttcctctcttcctccctctccctgtccctctccttctccgttcccgttcctttccttccattttattagttaagagaatatacttgacaatctctaaggaatgattcaaagtgcctttaacctatgtggctgccttttatttttctcccctctcttgagctttctttctcagccatccttcagcctggtcagcactctcctgttcaattccagatgtgaacagaataccaacataaaattgaacaagttcccaagagtttgttaattttgtttcccacatagcaagcctgcaatagtcatcagtccatgtacagatccatttttaacctgtcccaaaagaaagtgtgaattctcagacttggcggccgatttccagaaatagtcccagggctgggagcactcagcctcacctcatcaactgccctcatagacagcacaggaaagtgaccagaggaggggcatgcaggcttctccttcgcaggagaatacaaatcaggattctttgcaaacttgctggtttctattttctggtttatacagattattgttttaaaaagcagaatacagtttcttctggtttcctgttcagcatgtaagaagctggaagtcaccactctgtcctaagagaaagctccacaaactgaaagatcaattcttcttagatcattcagagaggtgggggtcataggacaatttgctgctcccaagattggagacacatacagggaactacagaaagtgatggtaccagggcagaaacccacaagcacaaagctccagagtgggagtagggaaggcagagccgtaactgatgaactgctgctggctcagtgttccccaagagaactcagtcattagggggcccattcatgacattagttttactccaagaggactcaatcatcaggggtctacacattatgagttttacttcctggagcttcactaggttctcacaaggaatattggagaagagcctcctcctgcttccagcttggggaggggaaaaggaaccatttttgcagagcatttcattcttcctaacaagataggcccacattaccctaacatcaacaccagacagaggcattccaaaaaaagaaaactgcagaccatcgtttctcatggacatggttgcaaaaatcctcaacaaaatattagcaaaataaattcaacaacgtataaaaagaattatataccatgtttcactgggattcatctcaggtatgcaaggctggttcaatactgaaaaattaattaacatatcacatcaacaggttaaagaaaaaatcacatgatcacatcaacacatgcagagaaaagcaattaacaaaatccaatacatatttatgattcaaaaaatatcctcagtaaaccagaacaagagggaaaccttctcaatctggtaaagaatatctaccaaaaaaccctgcagctaacattttacttaatgaaaactcaaagctttctcactaagagcaggaaacaaggcacaaatgtcccctttcaccactgatttccaacatcgtagctaatgcaataaagcaagtagagaaaataaatggaatacagatagagaaggaagaaataaaagttgtttattccctgcaggtgacacaactgtctatgtataacatcctaaataattgagaaaaaaaatcaccttcctagaactaataagcaattatagcagggttgtaggatacaaagttaacactaatgcacaaaataaattgcttttttatataccggcaatgaaatggaattcaaaattaaatataataataccatttacattagcataccccaaaatgaaatacttagatataaatctagcaaaatacatacaaaatgtatatgaagaactctataaaactctgaattaaaaaaataactaaacaaagagatagcccatgttcatggatttaaaaaaaaaaaaacctcagtactgtcaagttgtcagctctttcgaactttaaatacctattaccaagtgaaagaagttaatttgaaaaagctacagagtatatgattccaactgtgtaatattttcgaaacagcaaaattagggaaacagtgaacaggtcagtgattgccaggagttgagggagagaaggattaataagcagagcacagataattaaacaatgaaaattatctgtatgatactataaggatggatacatgttattgaacttttgtccaaacccataaaattgacaacagcaagagtgcgctccaatgtaaactatgggctttggttaatcgaaatatgtcaaagtaggttcattgattgtaataaatgtaccattcttatggggggatgttgataataaaggagatcctgtatgtgtggggacagggggtatataaattttttttaaccttccccttaatttggctgtgcacctaaaactactctacaaaactaaatctagtaaaacataaagcagcaaacatcgaagctactatagcgatgctaatttaaagagaaatcctcaagtagcacctgtaaaattttaattctactaatgatcatgttcaaagcatgttaaaagtagatcccaattctttcatacccacaacaaagatgaaatgtcggactgtaacatttactctttaagttagagaagaactctcgtttcatgaaatcttctagagaatcatatcaagtgacacactgattaagcacatttgtgttaaatggagcatgtaaaagataaattttgaagatgaaacaatgaagttaaaggaagagttctttgcacttgtactcataattgagaaaggtaatttcattttctgggggactttaaagtccacagatacacacacataaacttgctactttggcaaaaatacataaatttcgatgaaaataattattccttatgtacagctggggaatattacttaagctacgctttctctgtgatgtactgctctgacaaccataaaattattttcctctctaggtctgatttttgtgatcagtggttcctaggtattgctaatttgaagtgtgatgtcaaatttctcaaacctgagtgatccaaagaatcacttgggactctttttaaccctagattgtagctaaagagcctcctcatttgtgttagtcagctcagactgccataatgaaataccacaaactaggtagcttaaacaacaaaatttttattttattattattattattttttacagttctagaggctgaagttctagatcaagattcacacagagtgagctcctggtgagagctctcttcctggcttgcaaaatgccaccttcttaccgtgtcctcataaggcagagtaggggatggggaggtttcctctggtgtctgtgcttctttttatacggatataaatccccttggatcaggccccactcttattatctcatttaaccttaattacttctttagagaccctctctccatatacggctatactgcagatcagaagtaaaatacctgaattttagggggacacaggcagtccacaataccattctagaaggcagatctgaatgccacaggaaaagcctgatatgcatttttaagtagcatcctgatgattctccaggtgacgcacacatgggaatcaacgaagagggaacatcgtgagttaaagaactcaaaacaactgacgctaattccaactcaaaacttagctactgagaccgcttgacctaatctacattcctgtatcttggtttttaaagtttttataaaagcaacatcagccctgttaaataaaaaagtagacctcaactacataaatagagtacctggtacctaatatagatacaaattaaacctgctattagtaacttcctccaaatatgattgtgaacagtggagaataaagaagatacacactctggtgattacatgactcataccttagtgctggctgctgttactgttttccaacttgtacaggtagagaaagtctacctcctccccaaaataaacaaccacaccaaaaacaaagatggctcgagaacagagtaagcaatatgaatccagactcattcattacatatctcacccaagatttttggccttttaagcctcagtggaaatgatttacattttatttccatggcagctttccattctcaaaagaagaagcactttcagaactacactccacacccagaaggcaaatgatactttataatccattctttgtacgatttacagcagctcccttggaaaggaatttactggtcggtgtggtgtggctgttattatgtctgagtttaggaactgcttctaacttctcttcattaagtagttaaaaaatatttaatgagtctctattacgcgttaggtgctctgctaggaaatggaattatatgcagagaccacagtctctgatctgatgtggctcatgtactcagagaaatagcacatgtaaataaacaatagttatggcctcgcttgataggtgccatgacatagtggagagagatgttaaatgttatgggacccatgaagaggcgtctttgtctgcttgacaaagtcaggaacgctttcagaggagagttaatatctgatctggatttaaaagaacgtctagaaatatgagcttaaagaaatacacggttttattaaaaacttcatacagttattcaaaattgagtaaggataaacccagttaaattcaagtctggatatacttgccttacatgagacatctaaattttatcaatagcaacaacagaaacaaaataaaaatgagaacggattccctctagggtgtttgcctgtggtaagcaagatgaggctgtcctgcagtgctggggtgaatgcttatgagccctgtagagcccagggtagtctggacgtgctctgcaactctctgttttataaatgagccaaagacggcctgtgtgcactgatgcccgggttgtttatttcttcattgcaggctgagagctttagctcataagcctgctggcaccaaactcaaattttacacatccaattattttaaaaatagcccaaactagcagacttgtagccatttagagcctgcctgctttgcataccctgcaaaacttcacctgacagctgttacccattgataagataagactttggagttgtaagatcctgttgaggactgagttctgtcttcccaaaactgctatgttgaaatctcaaccccaggtgcctcagaatgtgactgtaccgggggctgagttctttagagagtaattaagattaaaagaggtcatgcaggggccctaatccaatatgactggtgcctcctaataagagaagataagaacccagacacacacagagggaagaccacgtgaggacccagagagaaggggccttctgcaagccaaggaggggcctcaggagaaaccaaccccactgacaccgtgatcttggacttctcgattccaaaattaagaagaaacagatttctgttctttaaggcatccagtttgtggtactttatcatggcagcctgagactaacacagactccaagctgctggtgtccatggaaggcctctgccccagagacgcctcaccctccaggctgctgagagacaacggctggaccccgggcccttctatgatcccccttccttggggagttgatgtgccattctcccctgcttggtgtggcccccagccactgccgtaagcctctggaagagcttgtgttgtatggggtctcccttctcatgcaagcatcgcctgataaaacctgttgtgtgatcctgcctctctcaagttcttatcttttccatgatcagccccagattcctccaacccctacacactgcctggggtctttgcaaatcaatgtcttactaacaacaaggtccctttgcatttggatcaactcatgtaaagttcttgttgaccaacccaggaggtatttattaaatatttattttggttattttcagcatgatatagccaattttttttctttatactagctctagggtgaatacaaatataatataatatttttataagaatatgaatctcatgactcagaattattaatttcatgtgctattacttttcactatgaaagatgaaaacgctaagagcagtgttaacggactatatcagatatagtttaagatttggaagactaattatttagatctctgtttttctgtgttttactgtgaatgcagaaatttaaattatgttttcagcttttcctgtagaagactgcttaaatgaaataaaggaaaacatgattataagtacctactgtatgaactaattcatataagaaaacaagcagtttatgagacataatgatatcatattacaatcaaggcctatacataaacaatgaaataatcattcagagagtaattttagactaacgtagtgataaaagctgtatgtcgtgagggtcaggcaggccccgctgtgaatgtgattgcaccagttgctaatttgctgtcagtgcagtcataggttaaacagctaatctcccagaccactggcttcctcgcctataacacgcagataataaagaagagtctgtatttcacagagatgtgatcattcagttagacacatagataatgttcctggaacaataactgtggcatactaaatgcttaataactactgatttctaactccctttactgctttattctacagcagtttcattttacagagttaataccaaatatgtataatgtatttaacatgcacgagcctttaaacacctaagagccacgaagttattcaaactgaataaatgggtatgaatatatgttaataatcaaacactcaaaatactaatacttagttttaaataactcgtttatcaaaaagttcatctcaatgcttcaagtaatggctaccaaagccaaacttaaatgtaaataataaaaaatctactttaaacatgattgtcaaacatatattcaacagttgtcagatgcaaaagccacacgtattttgtagttgataagatttgcatttgagtagggtgtctagtaacagtctaagagtacatatgacatttccatgttttaatgaatttcaggtagctatgataaaattctaaacctgttctattcaatattgatactcattaaattgatacataagctgtttaagaaagataaatactgcacagctcacggaaaggtttattaagattttcaaatgtctaatatcatccaaaaatctagggggaacattctgaattacagtattatgtttttactggaaatataacttgccataagacaagaagacagagtatggcacgaatgatattcatgtgggctgactcaatgcctcatgttgtcataaatctggccttttcatttctccctcccacagacacaaaacagcagcatccgacgcccagcagcagcagcagagtgaggtaaaagcgcaaagcttccatcttcaggataaaagattcttctcataagacaatttgtgattccttaaaaatatgaggacttcataataaaaaactatattgaacactaattttttgactgtgtgagggaaacatataagacataaacgtgatatcctttactgagatgaaaacataccagtaatattttaatattctcagaaaactatcgcaaggacaaaaaaccaaacaccgcgtgctctcactcataggtgggaattgaacagtgagaacacatggacacaggaaggggaacatcacacaccggggactgctgtggggtggggggcggggggaggaatcgcattaggagatatacctaatgctaaatgacgagttaacggtgcagcacaccaacgtggcacatgtatacatatgtaactaacctgcacgttgtgcgcatgtaccctaaaacttaaattataataataataaaataaaatttaaaaaaagaggaaaaatagaataattaaaataaaatctaagtaaattataggagattattcggcatggtctaaatacagagccaatactcttcaaaggttttcaagtaaacattccccataaaatcgtgtcatgagttaaagaatttatcagcctaatagacacattctcccttttttaattgcaaagagactccccactttctcttttgctgcactacagtataatttctttttacccaaacactccttatggctagttttttcacatcttttagaacaagagtccattcccaccaatttaatctcattccttatcacaacatactgtttgcgacgctaatagtattttacattttgcattaatgtgttaaattatttacctcttgcagtcaggattccctaataaattactagatctttgaagaacaggaatgagtttgttgccttctcaatgcatactcaatgctggcctggcaaattatatggaatctataaaatatcttttaaatggaagagtacctaaatgcatggatgaatgaacttatggttcaatgataaaaatgataaaaaagaaaagaatcaaaatgaaaaagtaaacataaaaataaatacatattcaaaattaatatatgtataaaaatttttaaagtagttaatcaaatttgctaggggaagctgggcatggtggctcacgcctgtaaccccagcactttgggaggccaagcagggtggatcatctgaggtcaggagttcaagactagcctggacaacatggtgaaaccccgtctctactaaaaacaccaaaattagcccgacatggttgcaggtacctataatcccagctactcctccagaagctgaggcaggaggatcacttgaacccaggaggcagaggttacagtgagctgcgattgtactactgcactccagcctaggcagcagagtcagacttcatctcaaaaaaaaaaaaaaaaaaaaaaaaaaaaaaaaaaaaaaaattcttgccttttggagccagggatagctctatgaaagaggatatggctgagctagatcttataggatgacgaaattcactagatttggttcatgaggaagtgaattccaaacagtaatgtattctcttacattatgtagtgtgtgtgtgtgtgcgtgtgtgtgtgtgtgtgtgtggtgtgtatacatttttcattcaaccaaaggttatcagagaaattatgaagggatatttagaaataaattagaataaattctatgcttgtttaacactcaactttctctttagataattttacagtattgcatttagtcatgatgttctggtttttatttatacattcatctgaaagagcaaagtggtagagctaaaatcagtaagcttggctctgtttccaaactcataaaaatgcaatatcgtggcagaaagattcttgtcctatttcttattttacctgggcttttgggatttcacatggacatagttgcaaaataatactccccaaacttcagtttcacatgactaatgtagaacatttgctgtagataatagtcaatgaatttggtattacacttcacagcctagagaagacgacttttcttcatataatgttggctagctggtagcaaaatcatgtctttcatagatctccatttgtagtggataggaaatttggatcttaataagacatgggaagatgaaatgggtcacacagtactaaagcagagaaagacatcccgataggtgtcttagaagccagaaaacctccccatttttaaacagataatcagagtggttatgtcctgggggcgaacgcagagccaaactcaggagttcttggtttagataagttatttccccctactagcaatgatacgccatgaacagacttgttctgaaagtcttgtttgtatgtgaaagtcagaatcctgaacttttgttccaattatttaactctaattgaattaaatttaatttatgaattttaaatatagattattgcaatgaaaatttgaaattatattggagtgccctgtaagtataacgtatataccaggtttctaagacttcttttaatagactctattataacttattgctgatgacatgttgaaatattttggacacatgggttaacattattaaaattagtcatatcagttatgaatttttaaatctgctgctcatttggaattacattcatggctcattatattgctgttgcccactgctgtttcaaccatcgcatataaaattacttacagtcagaaaatttatgaaagatattaaagagttcctcttctaaaatgattttgcaattttccctacaactgtttcttcaaagttcatcaattttcaaaatgaacagtgacttacaaaaagaactaaataaatatatacattaaaaattgttttctatataaaaatactaaaatgtaacaaaaaagaaccagaatgatagtcatagtgtcatggggtcaagacatagctgtgaaggaagaatgaattttccttccagataaatgagtaaagataggaaatgggaagatgagctgggaagccttaagaacctttaagcagggctaaaatagaaaaagaaaaaacaaaacaaaacatcgataatagcctgtattatttgtatttttaaagaatcatatacctgctgcattttatgttgttcttgaagaatatgcatttatataagaaaattctacttcgaagatttaatgaatgaatgtttccttcttgtctactatagcagtgatacatgatatgatagagtaatgctttttatttcattgatggatacaaaaataaagagacaaaaataacagaattgcaaggtaactttatggtagaaaaaggtggccctcaggtcctattgcgaagaaaagttgcctattttattgccctcctctggtataagccaaacatttcaatagacatagctcataagaacagaaggcatagattagagaaagctcttcactggatacttaagtgtgaaaggaaaaccaagcacctgggtggcctactgtatggttactcaagctccatgtaggagaaaactcagcgctttagctcctgggaaaactgtcaggtcaaattgcacgccatggcaggcacaccatgagaagatgtgtacattttaagggatcattatgaaagttcccagatagcctgcctttttgtatcctagtttttattaaattttgaaaatcaagtgaactgtgaaaaacctctggagtcattgatacggtttggctgtgtccccacccaaatctcatctagaattgtagctcccatgattcccatgtgttgtgggaggagcctggggggaggtgattgaactatggaggcaagtctttcctgggctgttctcgtgatagtgaatgagtctcgtgagagctgatgatttataaaaatgggaggttctctgcacaaattctctctctttgcctgctgccatccacataagacgtgacttgctcctccttgccttctgccataattgtgaggcctccccagccatgtggaactgtgagtctaatcaagcctcttgcttttgttaattgccaagtctccggtatgcctttatcagcagcgttaaaacggtataatatagttatgtatcagaaagttcattacaaatctcacccacaatcagatgagcaaggaaattacagaacaaaatggcaagacacaaaatggattaattaagaatatctgaggtatctttttaaatgaagaactctcaaagctcacataactgataattctgttgcaataattttcaaaacctgtcttttgataagagacagaatttagcaagtggaaccagaccctttctgactataggttcggattttcttctctgtccgcagcccgtcttgctgtgtgatctgttatcatctcactttaccaaagcaggccaacccctaccctatccacacgtgcctgggagttggactccatccttcatgaaggagtcctggtagcagtgatgtggcaaggactgcagaaataagaacagtaagaatagcacacactaatagatccttttcagggaaccatgccctggctacgtgttctccaggagcttacttccataatcctaaggatcctacaaataaggacattgctgttatccttgctctactagggaagaacctggaaatggaaaagttaagaacatgttcaaagtcccccaagtactaaggagtagggcttgtgttaatgacaaaatgagcaggttttcataagctctgcagagctgcaaaattcacagatatagaaactccaaccttttggtgggtggtagtgggccaaaataattctcattatacatcctttggtgctaatttttgctaatggtaatgatctcgtctatttagtaattcaaaataggtccttaatacttgacatgttcacagtcttctgtgggagcaagggatataaaaacaaacatagattgaccctcaaatcatttgccatacctggtttttacgttatctcttttgcagttctgaaactgtatacataatagactcagcctgggctgctgcttcatcaaagtgactttttgttgtagctgttgtttttttcattccagatgaattttcctacttttgtattaagtacactggttcagaaggtgtaaaactcataataaagtaaatattgaaacacatatgttatgataagaggagtgtaggatggctgttgctagttttccttctctctcacacacacacactcacacacatgcagacagaatatgcaattgtggttgcctcaaataacagaatattagtgtggtagaagaaataatgcaagtcagaaaaccaaggttccagtccggggcctgaaggcaactctaatccaggtctactaaaggtctgcttatgaaatgatctgctgacacctcctgttcacacctcatggagttcttgtaggaaataaataaaataatgcatattaaaataacataattgtatgcagagcaatgtatacaaataccacattaccattaaaccatgtcaaccatactgtttcttaactgtgccatcttgacctccaactcctttctccttctttggtctttacaaagccaatcatgatgctatttctaatcagctctgctcctcaatgctctgtgaaagtccaggtgtttccccagccagcagttcctacgctctcctcaaatgggtccctatgttaggttttggatctccaacattaaatgtagtttctgatgtggtaaatcctccctgtgttttttagaatgaacgaacaactagactctggaatagtcccaagaaaaaactccccaggcattgaattaaaaaggaaatccagacctatgcatcatatttgtatgtataaagaaagcagtgggggaagctagggggaaattaaaatatatttatatattaaacattgaagtgtataaagaatgaagacaacactcaaaaaaaaaaaatgaaatacccatctagtggacaaatatgtgttaacaacctgctagtaaaaaggtactattctactgttaaaagcaagaaaaacgcaatagaaagaagatgtattcctctgttttcaaacaatagcagaaaatatacactagtattcaagagttgatttctgcacagatagtaggtgatgcttgtggctgaaacaggacagctgagtgaggccacgttggtgaagcccacgggatatgtgatgggaaaacatgacagcagggtatgaaccctgcattttcatgaccatttttcatcacacttggtcttttttttttttttttttggtttggtttgggtttttcagtgccacctagtgaagtatttattacatatagtgagtcatgttgatgaaataaatgtctttatctccttagacaataaatacgcccagagtttttaaaaccaaatctgatatttgatcctaaaattctttcaaacaaattatcatacatgattctatcgacaaagtatttagaaattatccagtaaattacggtgagtcaaaattgtgcatttttttattttcaacaatttatataataaaaattggaattcattcttttaattttaccatgacttctaagtattcttaaaaagtaaaactttaacagcattgccacattcaaagccacactatcagaaaactgatggcatcacagaacaacttgccacgtattttttttactaggtttgtgcaaaataattgcagtttatattttgaatcaagacattcaatattttctgttaacgatgtcaattaaactgcaagtcaaatacatcaacctttctgaaagatgatccagatcatagtgctaaattttcaatctactccaacattattatttgggaaaagttgaccaggctcccaccttccctctatgccacaacccccacctaccaacaaaaaaggaagaagtggtcctttagagaaaagcatcattcactcgaacagagaggaaaggaaagacaacactctgtagtatggtctgtaggtagctatgtggccaaggctcccggcatggggatttctcagcagacagtgagtgagaaacctccaatcttaacactccccttccactcacagctgaaccaccaactgtcattcccaacaatgggaatgctctactttaaccatgagctgtaacatattacaaattatgcagataacacattgatttgtcgtaagagcaatttagcgccattcctctagtaaaacagtatttactcttccttgtagcaacccctaaaggaaatgattgcacataagaaattgtaattatctggtttatacatgaagtatgaatttggtgcaaaagtaatagcggtttttgtcattacttttaaatgccacaaccacaattacttttgcaccaacctaaaaaataatagaagtctcccaagctagggatggtcaggtgtcacctcgtcatcacatgggcaatgcttatttcacaaggacaatcaatagccagcattccacacagggacatgtcaattactatctagaagcagcaggcttcccaggaggccctcttgacatgtgtccacagttccatcgtgattcttccagtcccacatgcatttattgaatgataagtgcaggccttagtaaccacctgagaccaggggcagaatatccatgatagatctgggtcctgaacgctgcctttgcccgttgcttccagaaaacagtggggagctctgtttcagctctagaaggagtggagcgggtgatgaattatctttactctaggctattcattttccctgggacacattttttaaatagagatttggaaaatgagacaaactaaaaataagaacataaaaagggagaaagtgttgttaagagagaaccaacatttgtgatttttgagtagaaactttgtagttcacagtattatttcatgcgctacatttgattataatactagacaagagattcccattataaagcaaacatcctttgcaattaccaagctctacataataggaaatgtattaatgtcagaaatacttttgcaaaatactatggtattaggttcacgctgaccatgaagatcgtggtctcctccttcaacaagaattgcatcttacttatgtatgcccaagggcaaatgcctagtactaaaaaactataaaataattgctagatgattttttacatcaggtaattattgtgcaagcaagaatacacactcatgaaaaagacagtggaaaccaactgaattatagaactgtgttgtggtctattacgaaggtagctgacacacacattggtaaacactgatcatgtctctttcaccaacttgacatcactcttgggaattaacaaaaattgtgtaatttttgcaaaatatcctagaagtattagaaaaccagaaacgtagggttattataattatcattgcttaaatttgctttcatatttgataaataacaggttacgttagcagggactatgattctccacaacctgaattttctttcaagatactctaaccctggagaataaatttaatcgacaaatgttttttttctccccccaagaagacataggatatttagccatgattccagaagactattgtgaatgatcaaacatgacttcgtcaaggttagacaatcctggttttcagggaatggcttctaacccaactgtagataccatctatccacatcctcttacttacaaagtctttatagagctattgagctgtataatatttcatatttttctttccctttctttgtgtgtctggatccaagacataatttttttcagaagcttcggaggattctaacttgcttttacttaagatatttttcaagaaagttaagttacccaatgacataagtgcacatataattcttcctagatgcttcccaaatcagatttagttgttttggccagttgggttgctgtaattacatcaaacattagcattaggagtcttttttgtagcatttatatgatcaggaatgagctgtgtagctggtatattgttatataagtcttcctctgccctttacccaaaaaacaataaaatctcaccagaaagtaaaatttgtttttatacggtcattttataccttttttctgaacttattttaggccatgcaattgcctttacctatccttctggcagatcctgtttgcaaagttggtgagttgtcagtgtcaagatataaagaatgagtatcacttttccaaaacgcaggttatccgtaccagcaggtgtttgtagagataagtgttcttttgtacaaagatgcatcttgtgcttaagaagttggtagggccccatattgcagccatagatcccagaactatagataaaatttgaatactgaaagtacatagcagagagtggaactttatacagtacatttctttctattaataggtacactgataatgaaatgcatcatatacatgactttagacacactacaatcgtagctattcattctttttactgatgaatcctggaaagtctaatgcagaagttagaaagattaagttttcagcctgtgtctttaaatggaatgacgtcttagttctatgaaatcagacttaacaggggaagataaggcaacctacagggcgtgcctgcttcctgagggtgtgctgactggcccagggcactctggattgtattcagtctctatagaatccatggctctcactcagagccctgggtgtgggatcatgtcagtgctttggaaaacatgcatcaaagcctagagcctttcccaccacattcagcagcatatgcttcagatgggtttgcattttgtgttctggttctgactttcatccttttaaggactatttctaaatacttctcaatgtccttgtttttgacctgtattccttggttcatggctgctgtttccaactttctgttccatcttcagtgataagacaatatctagacaggagtagccccacaagtccaattaatccctacctctctagagagccatccatgaacagcaacaacaaaagttattttataggaataaagaaggtgggatccaggaagtcacagaaagacattccaagactctcaatcatgccagaaggtaagtggaatatgcaaaacacatgtggacttttaccatatctaccacagatatgaaaatactccataaaatgagaatcatgtaagacttagaggtcagctgtgtagcatggcgcctagagttaacaatactttgctgtgtacttacatttgctaaaagggtagatcttatgttaattatttgtatcacaaaataacaataaacataaagcaaaaggaaattttagtgttgatgtataggtttatggcatagattgcagcaatggtttcatggtgtacaccccacaaactctccaatgtatatattaattatgtacagctttttgtaggtcaaaaaaatgtttaagtaagatgagaatgctgctgaattttcacataagagctcactttctctctctctctctctctctctcatacacacacacacaccatgaaaacttctgtcttttaagaagtgtcctaagaaaaggtatagtactaaaaatgtcttaagctttccatgtttgagacgggattagcttgagttcaaggagtcatctaaaataccccagggaacatactgtatttttgttaggtctttgtgagatttattaacaaaaggtgacgtttgtaaaatcattttctttgtgatgatatatgtgagacggtgtttttttaaaaaatgatgatctgaaaagttgatcagaggataaagaactctctctcatgagtaacaaatcagaagccaccaaacagtgattctcaaagtatgttccagggaccctttgggggatccctgaggtactctcagaagccatgaggtcaaaactcttatcaggacaatattgagaagtcacttgtccctttcttattctgttcggagtggacaatgtggttttccaaaaggtacatagtgcacaacattacaacagattgtatgcaaaaaaaattacaagaatccagctgtctgctgttaaagcaggcattaatatgtttgctcaaatgtaaatcaataccacttctctggctaaattgttttcttctgaaaaaaattactttccttaaaaatatgttatttcttataaatatgcaactcataaaatttaatgatttataactattatttaattatgaataaatttctaaaaatgcctctgtcttcattattgacagggtaaatataagtagataaaacttacataagcaaaagctccttgggggcagtgttgccagatttaacaaagacaaaagacaaccacaaaattgcaacaggatgttaaattccatattaacagcaaattagtttttagtgtaagtataattcatagaatatgtggcaatcctactatggggttcttacaaatttttcagactataaagcggtcctgacagcaaaagtttcagaactgctgccgtagaaaatctttaggtacaaatttttcatttaaatcaaaattcgtgcataggttaccgtcaggttgctgcccatgctgctgccattgttttttttttttaaatttatttaatttttttatttttatttatttttgtttgtctgtttgagaccgagtctcgatttgtcacccaggctggagtgcagtggcgagatcccggctcactgcaagccccgccttccgggttcatgccattttcctgcctcagcctccagagtagctgggactacaggtgcccgccaccacgcccgactagttttttgtattttagtagatacggggtttcaccgtgttagccaggatggtctcgatctcctgaccttgtgatctgcccacctcagcctcccaaagtgctaggattacaggcacgagccaccgcgccaggcctgccattgttatttgtgactgcataccatgctccattttgtgtcttcatcatccggatttaaataagcaaatattgttcacagtttatcgtacaggtagtgcttttttttttttttttttttttttttttttactttcagtgctgggatacacttgctgaacgtgcaggtttgttacataggaatacatttgccatggtggtttgctgcatctaccaacccatcatctaggttttaatccccacatgcattaggtatttgtcctaacactatccctcccctttcccccgaccccctgacaggccccagtgtgtgatgttcccctccccgtgcccatatgttctcattgttcagctcccacttatgagtgaggaacatgcggtacttgattttctgttcctgtattagttttctgaggatgatggtttctagcttcatccatgtccctgcaaagggcatgaactcattcttttttagggctgcatagtgttccatggtgtatatgtgccacattttctttatctagtatatcactgatgggcatttgggttgcttccaagtctttgctattgacccagcaatcccatagccaaaggattataaatcattctactataggcagcgctttcttttccttatttccttttcacaaagaagtaaagtcagcctcattcatcccattataccggaactacagctgagcttcgttaagtaatgcatgcacacaaaaagacagacctagtatctgagccataccctccggcaccaagatgtgaggcaaatcacatgaactgccaccccatcctctctgccgctctctgttggattacgttgattgtatgatactctatcattttttgttactataaaactgattaacctggctgaatcatcgcgagtagaatacagatatgtaacttaactgtgtgagtaggacattttttgtaggatctgtcaccaaatgtatatatcgccatgtaatcagtgacgtacagttgttttgccatttttagccacactgatagatgatctccttacaggccatatgacaatccattaattaaaacaacaaaaataactaaacccgatgtgccgtggaatgtattcaggtcatttaatcataagcttcaagaacagagtctataatttgtatcttgggtattggaaaaagtcttgaagtcagatgatttgggttttaatctcaactctattgattgctttcggtgagtaatttggttactgacaatatctatgtggctttgtttttgtcatccctataataagtataacgtcacctgccctacacacccccagaaggttggaaggaaggtgtaactacatgttaaagtgttttgccagatgtaaagtcctgtataagtgtaagatgcgagctttctgcgctcgtcaggccctcatggtgcaccatggccccacgctagctctgtgtgcttatctagtttgtcagaatcagcacttcttttaaacatttttgtaataacagctttgagatacaattcccataccatgaaattcactctctaaaagtatacaatctggtgctttttagtatatgtgcagagttttacagccaccatcataatcccttttcagaaacttttatcactttgaaaagaaatcctgcaccgcattcagtcactccggaagagaaatcctgcacccccattcacagtcactccggaaaagaaatcctgcaagcccattcacactcactccagaaaagaaatcctgcacctccattcagtcactccgaaagagaaatcctgcacccccattcagtcactccggaagagaaatcctgcacccccattcagtcactccggaaaataaatcccgcaccctcattcacagtcactctggaagagaaatcctgcaccgccattcacagtcactccggaagagaaatcctgcaagcccattcacagtcctccagaaaagaaatcctgcacctccattcagtcactccggaagagaaatcctgcacccccattcacagtcactccggaagagaaatcctgcacccccattcacagtcactccagaaaagaaatcctgcaagcccattcacagtcactccagaaaagaaatcctgcacctccattcagtcactctgaaagagaaatcctgcacccgcattcagtcactccagaagagaaatcctgcacccccattcagtcactccggaaaataaatcctgcaccttcattcacagtcactctggaagagaaatcctgcacccccattcacagtcactccggaagagaaatcccgcacccccattcagtcactccggaagagaaatcctgcaccgccattcagagtcactctggaagagaaatcctgcacccccattcagtcactctggaagagaaatcctgcaccgccattcagagtcactctggaagagaaatcctgcacccccattcagtcactccggaagagaaatcctgcacccccattcaatcactttgaaaagaaatcctgcacccccattcagtcactccagaaaagaaatcctgcacccccattcagtcactccggaagagaaatcgtgcacccccaatcagtcactccggaagagaaatcctgcacccgcattcagtcactccggaaaagaaatgttgcacccccattcagtcactccggaagagaaatcctgcacccccattcagagtcactccggaagagaaatcttgcacctgcattcacagtcactccggaagagaaatcctgcaccgtcattcacagtcactctggaaaagaaatcctgcacccctactcacagtcactccggagtttctcctccctagatcccaggcaaccactcacctactttctgcgtcaaaagattttttggttctagatacatcatataaatggccatccaacatatggcattttgtgactgggcttctttcacccagctaatgttttcagggtgtacccacgtggtagcatttgtcatcgtagtactacattttaaacatgtaaagagctcagtggtgctccaagaagcaagactttggtagagacggccgcttgctcccaaatatcatgctgaggaagccaagttgtcatgacacaaagccaaggattatcagtagtttagagttaattcatttggaaaggcttctgtatttgatcccagagctgtgagatccatatgaccaggatggacggacaaaaaaggggacttttgctgttaatctacgtgagccctgatgggcagaggcctagatcctcctattatgctcttggagtttatcaacccactcttgaagaacatagtacagaccttttgggaacacaatattcttgggaatttttttttcagtttacctaaattattaaccaatccgagaagaggatgttaaacaagaaaataacccactaatgatgaagatctggcagaccccaaaacgatgtcattgcaaactgaagatttttaaaaacatcatcaaaaagtttacaaatgactcacagagagaaaaacctaaaaatacaatggaattagcaatagtattacagtgggagtattttaataaaagtacactgtaatttttctgtgcttctatattttatatttatataaagttttatgcctataaagtgacaaatctgcccttttggagtgtatgtatgtgtataaataaatatatgtaattcaatagctagaatataatatacatacacatatattaatatataatatacatatttatatatataaatataaaatacactacaagagggcagatttgtcagtctataggtataacatttgtggataaacagaacagtcttccaatttatagatattgtaattcaggcatatgtaaggacacaattatctcaacagattatgtacacatgtacacaatcttaagctatcttaatggcatttgtcagaacttttgagctgatatcatcagaaaagagaaagcattcgctagggagcacaatttaatagagcacacctgctatctcagaaagaaataccttctgcgtgggcctggccccaaggatgctgaaggacgcccaaggatgctcaaggaggccagcccgactcatatggctttccttttcttccctactctctggcttactttgaagcaatttttgctataaacctctgcctttgcatggatggtttatcaattgaaacttgttttcactcattcacctttactctcttgccagagtatttacaactcattaatatttttgttattgttttaaatgttgccttttatttcagatacagcggggtacaggtgtaggattgttacatgggtatattggatccaggtggtaagcatagtacccaataggtagtttttcaacccctcccctcctccctctttccccattctagtagcctgaaatgtctaattttcccatttttatggccatgtgtgctcagtgtttagttcccagttataagtgagaacatgtggtatttggtattcggtccctgtgttagcttgcttaggattatgacctccaactccatccacgtacaatttctttctttctttctttcctttttttgaggtggagtcttgctccgttgcccaggctggagtgcagtagtgtgatctcagctcgatgcaagctccgcctcccgggttcatgtcactctcctgcctcagcctcccaagtagctgggactacaggtgcctgccaccacgcccggcttatttctgtatttttaatagagacggggtttccccatgttagccaggatggtctcgatttcctgacctcgtgatctgcctgcctcagcctcccaaagtgctgggattacaggcgtgagccaccacgcctggccaatttatttctttatgtgttttctctcttataggactagggtagaagatacaatattaaaaacataatctcccatatataacaactttgaaaattatataatgcagtataatctatataaggtatataaagaactgcttgaaatatcaataacatagtcaataactacattttaacaatttttaaataatttaaatgaatttaattttaaccaaaatcacagggggaagtcaattatttgttatctgaaaaataatatgtagttatagagaaagtatcttattttagtttatttattgctatttttagaataacaagttacttttgtagcgtcttccaaggatgaacaatagaattcatttgcttatctgcttgtagatttgctttgcaatcattataaacttaaagattttgatgaagtatatgtgtttcaatccattgccattatcattctttcgatgttcaaattttttatcttgtaacagtaagagctctccaagttactcgtaggttaaccctaagtcatccaagatagcatctctgttctgtgaaattataatatagttccaaatcattctgttcatgatttgccaaagaccttgattcagccattttctgaggagccctgatctctttatttacaataaggtatttggagacaataatctaaatgatcgcagtagtactcattgttaataggttagttcatgcttctaggacttttcagtggagctataaaaatattttccctttctttaaaggaaatacatcgtgagttcacactcctgcttccaattcaaacttagggttactgagcttttacttctttacttttataattaactctttgttgttgatgtttataataagaattgagaaacttagatcttaacaatgttgatgtaattatttgttttatcttaaaataaataaaagtttcagaatatcaatgccaccattattaacattatttttgaaaacagctgaaaatttcctcagtgttttcatagggcgtgccccactaagtcagtaaatctgattaccatgttcaagattcacttgacaaggttcctttctgtatatataaaccgcaactcagtaagtaaggagatttgttttatttgactgcaaatttttaacgatgcttttgcatttcattttaacctattcataattatgtgaaaccatatacacatattttaaataaaatctacaaacatgttctattaaaaaaaatctagttttctccctgttttcagcacacacaacttcccatttcctgtgtgtaatatttatttgcttgtattttttaaatttatccttacaattttaaatttaatcatatatatacatataggtatggatactctcagccatttgtatacgtgaagtttcagcctaggtgcatccttcttgtactttctctaccttgtctttttctcttaacaaatctcacatgtcatgatattgtatacagagatattgcattctccttcttacagcagcatcggacactgttgtggatatcctgccgtttagtggctgcacaagtggatactgagaataggtacaggttatttatttattcctttatttgtactttgttatttatttatacttttatttgtactaatgccagaataaaaagttttgagtatatgccacttttactttcaacagcatatatttttgaatagattcctggaacttatctgctgtgtcagatcatagcacctgtatcattttattaacatgcggccaaatttcctttcacaaggggtgtcaccttttgcattttgcacaatagtgcatcagagtgccagtttctccagactctcagggagaaattgtaaaactgtgtaaaaatgtaaaatgttacttattggaaaaatgagaaatggcatatcatgattatcattttcatttctcttaacatatcatacaaatttgagcacggtcttatattaaacatcaatagtgggttatttaaacctgcttagacaatcaaagacagaaaattctatcaaaatagggaaatgtgaactattttcaaatatgcatttatatgtaaaactgtattacaatttgggtcctcttgtacttttctgtcatgagactactatttatatatcagcattaaagggaaatataatttaaaatatttgatttagaggaaactgacaaaatacagtaggtatttttagaaataaattatccatctggtaaaatgcttatctttttataaatgctgttaaagatgcgacttaataaatgctaaaatgagagattattatataaagaaagttgtgctaattctgtagggcaatgtaatattgcatatagcttttctgttttgtgattattcctattattgttattgttattaaaagtcatattactaattgctataaggctaatagtcatatattccagaatttggaactgtatgttattacagactagttttaattgactctgattaaaaagattagttttcaagttgaaaacttgctgaacatttcgtggcctgggcttttctcggacctactgttatctgacactattctataaacatttcaaattaagcattgatttgcattactttcattcttcctcgaagactccatcagggtgtgctcagacaaaagcatggcttcccccagcgaagccacgggaatacgcagtggaagacctacctggcctcgaatcaccaggcatgcagccgttgctgactctcagggccgtgtttatccaacagagctgcgtaagatccagcagaagcagcactttttgcattgctttgatcacataggatttagaatgcttattttctcattagttattctctctttgtgagaaaagcattaacttcattaactggctctgacaaaccaatttgcttttaacagctgtactcaaaaccagacaccatgctctgcgtcatggttttcatctgaatcacataactgagtataaatatagctgtcaattgcttcatctctccaataattctggagacattttcttgctaggtatcaataaaacctcaaataaaatagaccagagcctgtgatgtcatttggcacaggtataccatgactccggtgtaacatgcaactggaggtggctacattttttttttttttgcctgctatttactgccttgatgtatgtggcacccttatatttttctaatccctcttctgcatttattttgttatcctaccactacgacattgcaaatattataacttctccagagttcatattttctcttcaggtctaacttttttttttaaaaggctgggtgcgatggcttatgcctgtaatccaagcactttgggaggccgaggcagggagatcacctgagatcaggagtttgagaccagcctggtcgacatggtgaaaccctgtctctactaaaaatagaaaaattagctgtgtgtggtggcaggtgcctgtaatcccacctacttgggaggctgaggcaggagaatcgcttgaacccaggagttggacgttgcagtgagccgagatcgcaccactgtactccagtatggaccacaaaggaagactccatctcaaaaaaaaatgaaatgaaatgaaatataataaaataaaatgtagtaccaacctggataagacacttgtcatacatcctagcaagtaaacctccaaattatttgatgaagggatttgatgaagttagtgtttacccattttacagataaggaaacagaagctcaaagaagtaacttgttttgggtcacaaagctggtgagaaggtaaaactgatttctcaaatgtacagttcttgcttaccaaagttccccttttatggaatctttgaatctaaaagcccatattgaatgcagaaagctttattttttcagcaaaatgctaattctggcttcagttctaatctcagccaaaataaataaaataacctactcccttgtcaggcaacgttatcctccattgccagtgttaggtgccagaaaaatgtgtggcttttgtttttctttttagaaatgttacataatgacctttagcttagcatattctgtggaaaaagctaaaaatggatttttttgtgggtgaattaacacacaatttgaattattttgcagtattactgtatttgaggtttgccactgccacaagtcagcagacactaaatattgcattcagctttcatatgcagtatttctggaagatagtatgcatatgtgggatgtaaaatatatcttttaagacattttcagtctaaatagacttcccaatctctttcactaagcccatggatcagcaggaatgtttttggagtgttcccacagaatcatcatttcatttatgatggcattacatttttagtcagtcttcaaaaactcatctttgaaattgtgtgaaaaaaatataagcaaatatctttcccccaaaatcctctaatatttcattagccttacagaatgagttaacatatttagcaaacttccaacatttttctcatgttacactggcttataatgttaaaagggacttaggaaaaaagagtttgatgtaccacaggtggactgcaaatttaaatggtaaaataactgagaatattgtttattaagattatagtaggggaaaatatcctagctctatccttgaattattgtgattttacggaaacaaaatgttttatctttagtcacttagaatacaatactttctgatagttttaatctggtttattttccatatgggttaagcattatgtgtatgaaatagttttcccaaactcttttctgggtcaccttctgcctcaagacaggaaccccagagaggttgggtgtgcggaaatctcagggctggatttctcttcccatctaccccagcccaaactccgccccgtccaggtgctgcctgcagatgcccatggctattgagccgctcaccggggccctcttcccctcctcactcgccaagcagcaagctgaacctcccccggcttctttctgtcatattattttcaatacgattatcgtgacaccatatataagccctatgaatatataaacaccgaaagtggttggcgtgcaatgtaaagcatgatggactcaagttaggaatgaagtttgacaggaggggctgggatttgctttaaactgctgctggtttgctcagataatgtggtagattccagcaagaagtaaaataaggaaagatttctgcccataaacatctcaccaaaatttcagaaatcaccactaaaaaacttttccatgcaaccaaacaccacctgttcccccaaaactggtgaaataagcatgaaaattaaaaaataacaacaaccgcgaaaatctcaaaacctcaggccgggtgcagtggctcatgcctgtaattccaggacttaggggaggctgaggcaggagaatggcttgagcccaggagttccagaccagcctgggcaacagagcgagacctcatctgaaaacctaatggatgggaaagaaatgaaaacagattattttaattaaagataataagcactataacagaagtgaaaataaaccttgagaggggccagacatgggagcacctaacagtgtacaaaggtcaggaaaggcttcttggaataatcctgagttcactgtaactgcggatgcttaccaagtgtctaagctgtgccaggtactaagggctgtccacttaccttaatcatcccggaccagtgaggtaccttctgttattatccccattttacagatgataaaactgaggcaaaaaaaggtaaaggctcacccaaaccagcaacacaggaagtctgactctccgccactctgctagtctgctatttaattttatgaggctgtagactaaactgaacagctatgattcttgcatacaatagggttaatagcacaggtaaagggtctgaaacatgaaaagctcaaactctttaaatgcctcattttacttagcaaaatgtttcacaaactcgattgttagaaactctaaggacatttttgtgtttccccaaaatgctattgtctggagagttgagaattatgagaactgatttttttaccaccaatttaagccaatagtggtgccagggctcaatttcatgaatttccagctgcatctagggactggaagtcccatctctgctttgccagtaactactgtgtgacttagagtgagccagttcgtctctctcatccccaggatctactggcacgtgctgatcataactacccccatgcagttcttacagcaattacagtgggtactgcctttgaagattttaatgtgttaaagtgtttttatagttttgcttattttgtaagcactgccttcacctttgcacttctaagtgggctccacttggatcaaggtgtcccacgttatcaaaaatcggtaggcgtcgtggctcacacctgtaatccccacactttgggaggctgaactgggcctattgcttgaggtcaggagttcaagaacagcctggccaccatggtaaaaccctgtctgtactaaaaatgcaaaaattagccgggcatggtggcaagcacctgtaatcccaactactcaggaggctgacttgaaccaaggaggctgaggttgcagtaagccaagatcttaccactgcattccagcctgggtgacagagtgagaccctgtctaaataaataaataaataagataaagaaaaaaagaatcactcttatatcaccatgcttgaccaaaaataataataataagtggaattctcaataaatcctgacaaaactgtacagtcagcaatatgaaatgccagggaagggatggaggctggaggcgccgcacctgtagctgcactctgtccatttctataggatgaatgttggcaggcgatgaatttccagatgaggcctgactgacctcagatgtggaggaagaaatgctgtgagccacactctgttgccaattgaagcaaatgtggtcccagagcctgaagtccccgtgtgcaatgggcgccctctagcttcttaccaagtgaaatatatgctcatttctggacaatgaactcaacagtttgggcaagtaaacactatactgaatccacattcttagaactcttagttctaagtcttcctcaaactttctgaataaaaatatggcacaacttgtttcatggaagaaagaatcaagttaaaataccttttttttgaaatattaggataaacacagtcaacaaaacccatgaatatgttaatataaattgtcgttctccataacagaaaataaaagatacaaacttactaacaaaaaaaaagttttaatttttaagttttctcttcagaagaataaccattaaaaatctcactagacactgacgttttatagaacacagttctgagaacaatgggatatttgaatagatcaccaaatcaattttttaaaaaagcacaattattgaagcctcctttatgaatgctgttgcaaattagaagataaaagggtgctgtcatttttgcccagtattttatgttattgctaacgcaatttttttcaatgtaacttcttcactttgctccaatgcaagagaatggagattaacagactatatcaccactgtatcttatgcggcagaagatagtttgaatctatttaaattagggaacatataattcaatggatggtcatgaaaaaaataagtgaaagtacaaagtaaacatatggtagccatacatattttaaaatattcaagaaatataacatgattatattattaaatatttgtaaataaagaaaaaagtttttttcacagtatatttctatcactctaatagaaatatattagcatttttgaatatttatctaatgtttcttcagggcacctgcctccatacagttataatcatggcatatttgcaatttataaccagtgttttacaaattgatagtctatattttagagtaggtttaaggtgatggtaaaatgtagcagaaataagatttcatatatacccctcacatgcctcccatagttttccctattatcaacatcctgcattagtgtggcacatttattacaattgatgaatactgatacattattgattcaagtccattattgacattctatttctttgtgttatacagctgtgtaagttttgccaaatgtacaaagtcatgcatccaccattacagaatcacatctgacggtgtggactgccctaaagatccccaaagcttcacctgttcatccctcccttcctccaccccctggcaaccacccatccttttagcgtccccatagttctgccttttccagaatgtcatatatctggaattatacagtttgtagccttttcagattggcttattttacttagcattgtgcagttaagtttcctccatgcccttgcatgaattaattgtttccctttagccctgaataattttgattatctgtatggaccacagtttatacattcaccaaccgaaacacatattggatgcttccagttttgactataaacgttcatgcacaggtttttgtatgaacataagtttcaattcatttcagtagatacctatgatggctggatcatatgggaaggacacgtttaattttgaaaaaaaaaaaaaaaaaaaaaaaaaaaaacccacaccaaagtgtcttccaaacgggctgtaccattttgcattcccaccgctaatgactgagagttccagtggattcatattctcaccagcatttgatgtcaacattttgaattttaaccattctactaggaatgtggtggtatctgattattgtttcaatttgcaattccttagggacataagatgtggagcgccttttcatatgataatttgacatctgtttatcatctttggtgaggtgtctgttaaggtctttagcccatttattaggttcattgttttctattgagttttacatttaattatatattttcggacacaggccctttatcagaaatccgtttttgcaattacttttcccagtctgtggcttgccttttattcttttaacattgtctttcttagggttcttaatttgcataaagtccaacttaaatgattttttcatggatcacacctttgatgttgtatgtaaaaaccattgccaaacctaaagccatctgagtttcctcctttgtcatccttgtgtggttatatagtctcgcatttcatatttaggtctatgagccatttttagttactgtttgtaagaggtctattgtcaatatctaaatttatttatttaattttggtaggtagatgtccagttgttattgaatcaaagtttttcttttaaaaaatctattgttacttttattaataaaaattacagtagttataaaattttgtaatagttatatgtagtttactctttccttgtaacgttacataaaaattgacttttattttagctaatatatgttacattgggatccactgctgacttttaaaaattacttataaggctttagaggacacagaaggaaaaatttatatattaatcttaaaaatatacacaaatcttcaactataaataaaataatacaatttaactatagttggtaagatgcattaacgtattccatgtccagctttaagccagggtgtattacaatgtatccttgaaaattcattctcaggcatgggtcaatgttacagtgtcagagcaaatccatttttgaagggcagcactgctgttcacttatagaccaaaaacctgaattagctacctgtaacacattaatgcttcactgcttccaaaaatagggaactggaattgaataagcagcaaggaatcttctccatcacattggtctttaatgttccacttacattgaaattcagaaatatatttgagaagtttaaaaacataatatgtcacttgttgtctataagcatattcgtaatgcattttactctatatttatcacgcacgtatctgaatgcatgcacccatttaaacaatatacgtgtgtgtgcacacatatgtgtgtatgatgtatataaaaggcatgttaagaggggacatagtaacttggaaagagcacaggttttaaagtgaaacagacctttcttaaaaatcatatttgtgagaaacagctatgagaacctgaacaatggaatttgcattttcttagtcataaaatgggaggtgcagtaatgtatagttacttcacagtgctttctcaatgaaagatgaaatacttgttgcaaaatgactcaacagtttctaacaccagaaaagcccttcataaatatttattattctttcgttttattctcctccaaatatggagttttcaatcaatgaacactcaacgtctgccttgattaataagagtcctacatattaggagagaggtaaaaataggaagggctcgtttacctacttttcaatatatctttaaaaataaactagtgggtagatctcacgaccctacgaaagaatctacatatataaaaatgtaacacaaaaatgaaaggttctttgggtcacagtgatactggcaacagaagccctggctagagaaaaagtggttggctggttcgtggctaggagtaagacaccctaggagtttcccagtgtgcagtgagacatgctcactattttctctgttaaagctgatgccaacggatagcaaattcctcactttcacaggcatccatggaaaaacgcatctgtacctggaatcatgcaccatgttaaaatccattgcagagcaaactagctcatcatctaggccacacaggagacagtttctaggaagatcatttcatcaggtgtcctctatcccctatattttacatttagttctctcttttctccatcatctaatcacattcttgcctattctttctcagaaagaaactttctcccatgtcgcctgaatccccttcttatgacccccttctactgcattccatccacagctgcatctacagagacttttcagcttccctccacttaccacctgcaagtcaacttcatcagacaccctcacccaggtataaatggaaagatttctactgaaactttcttcagctcatcagaggcttctagaatcaaaatccaatgaacatttttcagtttattatgtccttgttatatctacgggccttggccctggtcgcacaagaccacaagcccctgctcccaccacttctttccctctggagggtcctttccatgttcttttctgtcttttcctctccggccatttatgatggtaaattttctgtgtcaacttcactggggtaagggttgcccagatagctggtaaaagattgcttctgagtgtgtctgtgagggggtttctagaagatattagagtttgaatcggcagactgagtgaagaaccacccttaccattccacgggcaccgaccaacccatggcaggccacaaagaacaaaagataaacggtgaattttctcttttccagagctgggacctccatcttctcctaccctagtacatcagcacttctggttctcaggccttcagattcaggacaggactttgaccactaactcttcttgctctcaggactttggccttggctgagttacgccaatggctttcctggatctccagcctgtagatagcagatcatgagacgtctccgccttcataatcatagctaagtcaattcccataataaatatatatgtgtatgcatataaattatacatgctacatataatatataaaaatatatgcatagttatatttataattataatatttgtatataatacaacatatgcatatatatgtatatcctatctgtacactgctagttgtctctctctggagatccctaacacaccatccctgagatgttgattctcctctgcccctacaggatagcctcattcacgtacatgaagtaggcatcaccctgtgtgccctacatccttatctataattcatacccagacatcttctttgagctccaaattcatacatccaactaccttttggacttgtctatttgtatatttcatagtcacctaaaattcaatatatgcatcccccagacctgtttctaaattatttcatcagacctgctgttttctgtctctatcccaacccgtccacttattaaactaggcccccgttatccagcaagcctgggttctgcctctgtggtttccttcctgcggctgctgagtctgggtgttgccatctttcagattactaaatgtaaaggcattataactaggcttgaattttccaatcaattttccacgttgccacagcagtgaactttctaaaacacgtatctgaaaatattactttcttcttttatatttgtgagtggattttagaagaaaatacaacttcctagcatcagattgaaaaagaaaaaaagaaactttcattatatgcagcagcccacatttctggcctctttttttctaccaggtccctatgcacactctgctctcactgtatttacctgttcgtagatacttggataaaccatcatctatctctcaagtaatgcctgtgtcattctttactgtttttccacaattaaaaagacttaaacattatactcaatgaatgtaaaacgaatgattgagttctgtatgagaaatggtaaattaaaaagtctcttatctggagtagaagctataagcagatgattctgatacaaggaattttgaatgaaaactcttgtaccctggaaatttaatgttcaagaaaatagagtgttaatgtggcagagagaaacaagaatggttaggttttgttgttgttgcacggggattggacgggatatcccagaagaaatctgagcaataattcagccatgacaaaataaaggccgagaaaacaactttgttttgggtctggaaaacaaaagaagggtaattacatttattgagcaaatgtaggccaggcactcccaagcaatccagtactccctttaaaaaacattgtgggttacagccaacccttgcaatatattaaataaaaggcacagtgtaaagaaggaattacagcttgttctcatagtttatttgctttgatgatgatactgttttggatggtaccgaatgtctaggattggagactcctacaagagcttatgttgggcctaacatagcgccgtcaaaaattggcatttaataaaaaatgtacgttgagtgcaaaaatgaagttatctttatgaaaactatcgaaaaaagttcactttttaatttagtcatgtataagtctcatttttattttaataatatcaccccaagaagcaaatactctatcgtattttgtcgttcattgaatattcatgttgtatatttagacgcatagtctatttctttgttatgctataacattcctgactttcatataaatatgaaatcaatgtaattgcattcatataaagcaagacataagccctcagaatgaaaatgccatgcaaaaataaaaaatgaatgcctttcatgtcacactgaattcaatgcacaagcttttctttttaaatatataattaaatatgatttgattagtaatagatgcaaatggctttttttccccacagaatgatttcaaaaatcatcacaattaggtgtttgattttccatctacctgtctacaaagcatttctcttttttaactgatctccagttgtcaaggtaattacagaaccgctttgaaagcagctgcattcccaggtgccttcctgttagttcacgggaaaccatgcaacaacctgatatatggagagcatactgccttggtcttggggggacatgtgatgcgcgcaggaggtaaagtatttctctgtaccttaaaatacatttagaatcctgttaccttggaaatttctcttacctccatatttgatctatctaagttaattttgcataaagttttgagacgcaattgtatttttttatttccaagtttatcagattatgagtaattaagtatattttgttgacttttcacattcatttaatgtttttaacttcattaacttcattaaacttccataagtttgacttaagaaaagtggtcattaaaaaaatagcatcttgccccaattgtctttcttacacagactgactcaagggattcctctcagctgacttgatttctggaaatcactccattggcagcaatgtaatgttatcaaccctaccatattccagaatgccaaagaaattataacggaagaccaaacacccaggtgacttggaatgcgaggggaaggaaaagggtaaaagaaattattccagaaacaagaaaaatgactctctaataatggggtatattggttaacctaaacaaaacacagtaacagttttctaattgtgatttatttctatccatcttcttttgcttttttaattgactctgttaaataggtttccactgattcccagtcttccaataactctttaacctacagataattttgcaattcctccctacccaagaaagacagtcatgtgcacagcctcccgcattacgtgatgctggcactcttggatcaacaaagacatgaatggccgggcgcggtggctcacaccggtaatcccagcaccttgggaggctgaggcaggaagatcacttgagttcaggagttcaagaccagcctgggcaacatggcaaaaccccgtctctactataaatctataaatacaaaaattagctgggtgtggtggttgacacttgtaatcctagctacttgggaggctgaggcaggagaatcgcttcagcccaggaggcagaggttgcaatgagccaagatcttgccactgcactccagccagagtgacaatctaagactttgtctcaaaaaaaaaaaaaaaaaaaaaaaagaaaagaaaagacattacttaggtgaatggccattttcaacattctcttaaaatggtaacttttgagtcacatttctgttaatcaaggacaagagtggaggagaaaagtggctgcagcattcctttttgtcatcctcagaattggaacacccccatgtttggataggcgtgggttgctcggtagaaacggacttttccccagttctccttttctgcttggtgtggccacatgacgaaggtctcagcaaaagaagttcatgggatgtgctgtgtgcaactttccctgtacctcttgaaagcacatttctcagccttcacttttgcttctcatttccatggttgtggtttcacggccaactttgatcatgaggaatacaacacatttcattggaagaagcatacacacacgcacacacacacacacacacacacacacacacaaacccggtccctagatggcatagaaagctgaacatcaccactagcttagatgactcatttcttggctattaaaaaaactgtaaactaaaggtattgcatttttaggtcactttgatacatcagcttattctctatctttaactgtgcggaagctgttaaccaaaaactcctatttttgcaggataaagtttattttttgaaacattttttaaaaaccagaaaacacaaaagcaggtgatttttaaataggtaatgaaatcatagatgttgggatttaaaaggatctctaacagtttacctagacaaaggtgacaaatatactctcctaactcaccttgtctattatccagtccacagtgtcacatgtttaaaatcaatcttaacaactttttcttctgagcccggaggcagtttaatcatctttatcaacacagtgctctacaaaccaccaccaattggtccaagtcgacacagaaatggaaaactatttgctctccttgaaatactttgatcctatcattttacatactagaaaacggagacccaggacttggctcaagttagtttcctgagtatctgactatgagcatttcaacgaattcattaaaaagaaatacaccaaacaaaggctgcccaaattaatatcaggatttataaaatcctgccttttgaagtagtccttgacaacaaattctcaaaactagattcactattttgaatgttttaaaataaaatgtggttataattacctaaagagacactgacctgggtctggcaacatctatgtggagatcctgtgtatcttaccttccacggactcagctcagaaatgtccaccagctccaccaaccctcctgtaatactgaaaatcctcgaatgcagaggcaggctatctttttatagttaaaatccaactgactcaaggctgtatgtgaaacccaatctcttgtcttctcatggtcccccggctgtgagtgcctttggtgtgctgtgtacaccatttcatccactacccttaattctcctccccaccaaaccccatgcggactactgtcctttcttttgttttcacttagatcctctcattcttcacgaaggatttgacctgatggtgatattttagtttgcagaaaaacaacttgaaattgaatgctacctgcccaaccatccctatggtcttccctggctgactctctgcaggttccaggcaccaccatgtcaccccacactcaagatgctgccatcaaatccaggcttctcagtttaacatacaggacaatgttggtcccaacacttctcaggatcaatttatttatttatttattttttgagacagggtcttgctctatctcccaggctggagtccaggctggagtccagtggtacaatcatagctcactgcaacctctcaggctgaaatgatcctcccacctcagcctccctagtagctgggatacctggcttatgccactacacatggctaattttttgtattttttttttttttgtagagatggggtatcaccatgttgctcaggcagactcaaacttctggactcaagcaatctgcccaccttgacctcccaaaatgctgggactacaggcatgagccactgctcctagctggtcacattctttagcaaactaaaagatctagaagtagctttaacagtttaatttcaaaattactaatcaaattattgtcaattgaatgaaataaggaactgacatatgctagcactgacattaatggggtgtcttagaaggcacaaaatctaacatgcattgggattttaaacatcatttgttttttaatcttaagatacaaagcatgctattctatgtagcttggtctcaatgtgagcctccctttcaaggttagtaactcatctgctgtgtttctgcttcagaaggacctgggaaaatccttccctgaaacgttatgcatatccctacactcaaatctcacattcttttttttttcttttggcttctgtgaactttaaggaagagcctactcaaatcccgaatcctgtctcaaagacttgcatccattcccatctcctattggttcaacaatgtgaaggtgtagaaatagtaccaagaacagatttattgggtgggaaatttctgcccagatatatgcagaactctggagaagattaatgaagtcagctttccattccctgggaagcactagtatcttgggcatccggttctcctgaaatggacttctggaatcacagtgagtttcaattggggaaaaaaaaaatgaaagctgttttctgaggtaccaagcctagcaatcgatcttaatgagatgggtctattaccccatcacaagatgctcagaagctttaaaatttaaagtgaaactagataggcatcgtttgaacagtcatctcagaagggtggtaaagtgctttacacacctaaccccacctccttcacaggatagcccactgcaattatgctctagctggatgtttgtgaaaatctagctgagaagctcttcttttaaacctcttccctaggaacaggtgagatggcaagttcctattccccagaagggccaggccttccctcccgtctctttctgctctcttgtaccttgcttatgtatgctggctgcttggtgacatttcaccgagtcagaacatgaagcacgttaataataagctcacattttcaaaatgttaaaataacaccactctctaggtaccaattacttctttcaaagatagttttcgaggtacctatgagccccgtaccttgtgaacacctcactgttgctttgtacgttttcagttgtcgcctccctttcccatgtttcacatgtgtgtctgtggaactcagctctaaaatctggacagtctgcaaccatcataaatgtaacagttcctcattccacttcactccaaagactaagatttcatatatcagctctgggtaaaagtgcttcattttgtgtaattttcattaattactcctgacaggcatttataaacatttataaggcttcattttgtattattttcattaattactcctgacaggcatttataaactgaaaaagaatttttttttttttttttttacaaatgaaagcaaaccattttattcaaaaataaaggagggagagactgcttaaaaagagttttgatgttctttatgtgatttttttagctatcatatttaagaacacattaaacattctaaattagattatttttgatctagcactttagaaaccagcttagctctaccaatatagcatgaaaagcatcagtgagatcataactatcttcagcacatttcccactatttttaggattctagagtgacgttaattgtgcctcatggcaatgctattagtgtacagaatatttctaactgctcagagtaacgtgtaatcgtcctatgtctgccatgaaaagacttctggatcatctatttacaagggacatgattgggttagctgggaagacacaggactgggttagcataaaccaaaacaagctgcctaaaacaagcacaaaaaatctgatgactggttcagctggaattgacctcaatgtgaaggagtccatttagcctgtcacgctgatgtctgctggcatgagacagtctggccaaagcttagtagaccttgcgatctaaccgcccagtgttccacattatatccctgctgtctcgtcagtaccaaacttcaggtttttaatattgtgtgtaaattcaacatatttattatattagtcacttgtggaaacaatcgcgatttatttatttttttgaggcagagtctcgatctgtcgcccaggctggagtgcagtggagaaatctcggctcactgcaacctatgcttcccgggttcaagtgattctcctgactcagcctcctgagtagctgagactacaggcatgcgtcacgatgcccggctaattttcatattttcagtagagacagggtttcaccatgttgcccacgctggtctgaaactcctgacctcaggtgatctacctgcctcggcctcccaaagtgctacgataacaggcgtgaacaggccaccgcgcccagacacagtcactttttaacattagaatgttcacgtaataatttgagaatctggaacaaatttcctgtttaatttgtggctttatagaaattactggagtgataatagttgagttgtatggaagttaagagcgaagctgtatatgacatttaaatatcatacaccgttctcaggatgtgttgattttaccttattgctaagttgccataggcaacatttaccataaatattaaacaatgtgataagaatcatcataaatacctaaaaattaggtttgcaagttttactattgtagtgatgtattcgaactttattgagtgctagtcattggccagggaaacccatgagccagcagcgtccgtccctgttgaggcagtccagtattttctgagtaagcattgatggggttaaaagctgaagataaatagaaggttgccaggcccaggtggtgatgatggtgttcatggatgtgggatgctgtcttctaggcaacgaattcctgtgggatggagtaagccaagcctgctggaggggccaccagggcccctgaggaacacagagccagaaggagagcacgcaagtaagactcagagatgctggtaggagccagcccacgcaattccaagtaggccatggcaggaatttagctatttatttttaggaatgataggatgctttttgaaaggtttcaatcgatgtgaaatatgatcacttttacatttgaaaagatcattctgacttcagatggcagattggtaggaataagaatgaatgcaggaagaccagcttacgggttattgcagaaatctgagaggagatggctgttcggtcagggaagatgccagaaaaaagacaggtgcagtggcatgtttgggagatgctcagaaggaaaaaacaaatggacctggcaatggatggaacatgggagggacggggaatgtcgtgggccatttgggtttcctctccagcgcaggtgcatggagaccagatttggacatgctgttgtcaaggacctcacaaatcagggggcgattctgaaacaggtgaagctagccttcctgcctggccacttggttttctactctccatctgcatcccagttcctttttcctgttacaattgcctccaggaaggatcattgatacctcactttgggtttcagcagcttatatctctatggagtgttttaattcttcatgataaaaatgctgcttttgtcagaattcaatcagcaatggagaggaataagtctctttaggggtgagattcttcacaggagcctgcaccctttcagggaaaccataagaaagttccatttcagttaacaaatgcaaaataatactgagattgaaagaaaattagaaaacctattagcttttaatatactttaagccagagttataaaatacgaaaattatatctaaaagactgaaaagactttctttaaaaaaagtcaagtgtatctttactgtgtaaaatatgaagaaacttttcaacagttccttactttaggaagtgaatttctttttctatataaaatgattgattttctgtaagtatatttttgaacctctaaatgcttcccttatactcaatgaattaaataaaatataattattttagtttaaatttctcgaatttacttagggaatgtttgcatcaaatggaaaaacaaaataacgcagacattaagatttaataagtatgctatgcatagatccaatttttgtattaattcttttgaatttacgacaacattttattatggggatactttatatcagaaaagttaggatttctcccaggaaaatgaaagttattttatggttcttttaaaattaatcttgaccattttcataaattttaattgtaaaatagtatagaatacctattttaaataatgtttaaggttatgaagatgtccaaaaataactgtataacaattttaagagcattgtaagctggcaagactacacggagaggccagggtacagaggacatatcgcatccacactgtgctcatattgcttgctacagtctcatgaggaaagtctcgagcagcaccccgaataatcgaattatctctcaacctcagttccttctcggtacaacagagaaaataatacctacttgtctaaatagcaaagaataaacgaatagtatatggtaaaataatcctgttcattttttcccataaagtgtttaataggatagtgatagtgcaatgcaaacaacaaaagtttttttccataagtttaattagcggaaacacattgccacaaaatattcacaagatgagcatcgcaaagtcgaaaacctcaaatccaaaatgatccaaaacacccaaactttctgagtgctgacataaagctcaaatcaaacactcattggagcacttaggatttgggatgtgtaactaatacgtataatgcaatgattccaaactccctgcaaaatcaaaatttatgaaataattcttgccccagcatttcagataagtgatattcaacctgtatctgctttatgcttctttatgtaagctaatgtgcattctgaatttctaaaattgagattaagcaacatttttcaagtgtaatttttataaaggattttttaacaatcacttatgggtcatgaaacatactttataaaatgctgtcaaaatgcaatctctgccatatcctgggtgatttgtaaaggttaattttgcttttccttcctgcttagctccatcagttagaatttggtgacggattcgaggctgagttcaaacctgctaccagacagctaccctcagtgctattcctagaatttcttagctcttacaagctaaaggcatcaaattggtctatatttctatcaaagaaaatcactaggttctaactgaaaagaggaaaatgaaaatctagcagatgccttgatatgccaagatataatttgatagcattatctaagaattcacagcatagtaatccatctgaaaatctgcgaggttttttttttttgaaatgagatgaaatacatttttaaaagcacattgattctatcatttaaatgactgaagaaatattatcagttgagaaataaaatacatctttaacaacgtgagaatgaaggcagaaaaacaacagtattaagatacttaaaatgtgtgtgtgttttggggaggtgggggaagggggacagcagtatcccagaacagaaaggaaggatggaaataagaaagaaaggaagcaaggaagaaaggaatagaaggaaggaaaaaggtcagatttaataaatttctatacagcaaagggtcaatttcaaaggtgtttgacagcattaagatggcacgtaagtctccgtgccccacgttcaggttagatttcttttcatttctcgttacgtttcatagctctacatcagagtcacactctttttataaatgaaatgggagtcggacagtgtaaagatgacgtgttcagtttttagtttttcatcatatcttaggctatgcatatttttcaggaagctgataaataataaggtggccttatttttactacagtgaccagctgcctttgactgacccaaaatacagaccactgagctatggctaacaatgccttatgtcatactgactcagcgatgaatcaatcaattccacaaacatttactgaaatgtaaatggccaaggcacccaggaccttaaaaatcataataagaagttaatctgtgggaaaagagtaactacaaaagcatctaaacaagagcaggatgtgatgtaatgtgtccccttatcactttagtcagtaaagataagaaagccctggtgagtatccacttccacaaacacacagaatatacacttttggaagatttccacttaaccacttgattcttcacttttttatgatttaaaactctccgtagtattatattatgaagcaccatcactaaaacgtatttttcaaattaataatcttttttaactctaacaaagtattttttaacctaataatcagcttaagtgagggttgcagtttgacttcaaagtaacaggtaagtacaattattctcatgggattccactgagcttaagacaggaagactccgaaagcaagtaccttgctcaaacactagtccctaataaacaatagagactttggccagacacatggctcacacctgtaatcccagcactttgggaggctgaggcagctggatcatctgaggtcaggagttctagaccaggctggccaacatggtgaaactccgcctctactaaaaatacaaaaaaattagcccagcatggtggtggcgcctgtaatcccagctactccggaggctgaggcaggagaattgcttgaacccaggaggtggacgttgcagtgaatggagatcgtgccactgcactccagactgggcaacaaagtgagactccgtctcaaaataaataaataaataaatcaaatcaaaacaaaacaaaaaatagagatttcaactgatcatgtttttttttctgacctcctgtatttgatactttccctgactgaactggcttaaggcagtattgtttcttgattgtacattcatcgtagagttctttgcaaagtccccctttggagccctcatcttgtatttaagcagttatgaacagtgaaaactctgctgctgcatgtttatacttcactggggttaaatacgcaaataggcccttgcttggaatcaagatctggtctttgtattattgtcaacttatgagcatatgctggctttagtctcttatgactttaagttggataaacttaaaatgttggataaacttaaaatgaaaacaaaagtccaaacttaaatgtgtaaataataacagtttagagttgaattatggaattacagatgatttaattttcagttttctgtttccactctctggttatgttataaaatattaaaaaaaatcttcatatactatttcaccaaatacactgaaccatggcatttggaggctttatgaataaagaaggggttaaaatatataaccatggagtagaaaagtaagagataaaattcctttagaaaggtgagagacgagggttcatattaagttcttggaaactgatattcacttttgttgtgtgtgtaagtcatccataggaacttacataattaccccaatgttgtataaaattataacctctataaccaagcatataataaaattattaataattcatatttatgtaacctatacctgaaggtcagtaaaattgctaaacagcaaagatgctgcgtagcagctccatcagtctttctgttatttcacaaatagtgagtcagttgttatcagtgcagcctggtgcattttccacctgagacacacgtcatctcatgttcacttcgtgaaattctattcatcttacctttctccacttcatgccccttctccaggaaaacgttctagagcctctttgggtaacttgggtttctcatgaccctgggtttcctgatcataaaacaccagccatccctgtaatcacacgctgtggtcataaatgtgcacctcctggctgtgcttcaagagaaactgtggtcagaaatgcagttgacagacagcctccacctgccacccttggggtcctcgactgcatatccacagaggcctcgtgcttgggccacctccacgtggtgactgcaccctccaagctgctccaggaagcagcatatgctgagaaaaccgcgctcatctcaccgcactttctcagttccatgctgcaagaagcagcagcagcaaagctaagaagccatgtttgctcatttcctgccaaagtaatttcacaaagcccctgactatgtgacgatgtgcagttctctagaaagttgttttgaagacaaaacaggatacagcacgtggtctcctacatgtgttgcctgagtcattatatttcttcctgaaagataaatgttcctagtccttgccttttcctacacaaaagatcatgtctgatgggcttagcaattatgcttctgcaatctataaccaaatgtattttagtaacctataactgaatatcctctgacacccaaactttaacatgattttgcatgcatggaaacctctgctacctgtagatacagtgtgagctaaaacactgtgctggagcggtatggcagagcctccctgaaagccttctcccacggtttagtcctcatgtgacagtcctcagcaagacttctgaataaaacaaccttaactctttacaagcaagatttcattttttgttagtcgacaacactgtggtttgagactcttcggttcccatctttccttcctcctattcttcagagtgctgcacctgcactgtagcctgaagacttcctaatgattctgcctgttcctcttctgtccttcacaagagatgttcaccagcaaatctcttggacatcaaatcccacagtggtgtctcttcctcctaggactcaaacaggttcacttatcaaagatccgttttctctattacattttctatggacaaagattaagtcttccactgttctaaatatttcccaagtcttacacagtgctttgtgtgtagtatatattcaacccataccaatccacaggaattacaaatgataacaataaaatgatattattaaatgaaaacatcgaccaggtgcagtggctcacatctgtaattccagtaatttgagaggccaaggcaggtggatcatgaggtcaggagatcaagaccatcctggccaacctggtgaaaccccatctctgctaaaatacaaaaaaacaaacagtcaggcgtggtagtgtgtgcctgtaatcccagctacctgggaggctgaggcaggggaatcgtttgaactcaggagctggaggttgcagtgaatcgagatcatgccactgcactccagcccggtgacagaatgagactccatctcaaaaacaaaacaaaacaaaaaaaattctggccaggcacagtggctcatgcctgtaatctcagcactttggtaggctgatgcaggtgaagcacttgagtccgggagttcaggaccaccctgggcaacatggtgaaaccctgtctctaccaaaacagaaaaattagccagccatggtggcatgcaccagtagccccagctactcaggaggctgaagtgggaggatcccttgagcccaggagattgaggccgcagtgagccatgaatgagctactgcaatccagcctggatgacacagtgagactctgttaaaagaagaaaaaaagagagacagagagaaaagaaagtaaaagaaaaagagaacatcactgaaagcttattattttgcagacactttacctgtgatctctcatttgacttgatgaggcagaggttatgaacatacctgttgactgctgaggggatggagtcccagagaaacacagtgacttgttcaaagccacacagcgcatatgtcatgaagccagaatctcaaccaaagcagttcatccacaaaggccaggcgtttagacactgccagcccctcacaacgcccatccggtaaacgaagagagttaaggaagctttaaaatcacagaaaataaataaatagaaaaggaaggccgtacatattcaatgcagccagcaaagagacgtcaattacatgaagaagatggaaatatgttccctgatagaggagggaagagtgtaggaaaagctgcaggtatcgttaattaagagcagaaaacatacaaggaagcatgagcagtaggaagaaactagaaacagacacttgagccaagtcctggaagaaacgacacaccggtgttccacacgggaaatacacaggcatcattacgcgagcagagagaggacaacctgctggagtggaggactcagcaaggtcagtgggaggcccccaagaaatgggaaatggaagaagtggcacaccagagcccaaaagactgaggcatgaacctagccctcaaattagtaaattattttaattctttaatcagaagaagttgaagttataattcaactcaaactgtagagattgaattcattagaaatcttatcagtcgtaaaacaaacctggagtcagtaagaaaagataactttagttattaaataagtatacatgaaatggaacaaaaatgagcatatcctgactactgaaataatatctttaaaaatttaaatttcagaaatttaggacacatcagaaatgtcagattctatggagatccaactcaagagcaagtcacgccactggtgttcaggcccagaacaccatcagccagaaatcctacactgaccttcagacagatgcatgctggtggctgttagcagagtcaagaatatatatcctaaaaggtatatcatataaataaatacagcagatcatttattatgttagaatatcaggaagaattcaaatgcctccaaaatacccacaaaaaccttagtaagtaacctcctttccttcataataaaaataaatgtatatataaaaaaattaactctactttcttaaacagaagttgtcacaggtaagcaaaatctatcctgtaggtatggtagcactcacatgcaccatgaaaattccggtgttttaaacagtgttttatttgtattaaccaactccaaatttgggagatttctcatatgaatctgggtttctggaatctcctaaaaaataaaaacaatgggccgggcacagtgactcatgcctgtaatctcagcactttcggaggccgaggcaggcggatcacgaggtcaggagattgagaccatcctggctaacacggtgaaaccccgtctctactaaaaatacaaaaaattagccggacatggtggcgggcacctgtagtcccagctacttgggaggctgaagcaggagaatggcgtgaacccaggagatagagctttcagtgagctcagatcgtgccgctgcactccagcctgggtaacagagcgacactctgtctctacaaaataataataacaataataaaataaaattaaaacaatgatcatctcacattcaacaatgccaaggcacaggctctcccgttcagtattcctgtgccggctatacctgccctgccccacgcactgatactcctcaccacacatcctcactccaactgtagtgctttccttataaatgagttgaagacaatgacacatctctttaaaacaattaaaaccttccttccttaaaacataaaacctaaaagtgatgtaaaactttacacattacaaaatttaaaggaaattcctccttctttaatatgcaaattgcaactgtagaaaatgtgacctgttgacatgttaacatgactagaccatcggtgcaagccctgtcctaaatgtttctgtccccaatgtgtggccctgtcctcaatgttcctaagtataagaatatctaggatatctgctgagaagacttggagttgcgaagtaacaaaagaagtgtcactttatttaaaatgtttcttctgtagcacagttccacagaataaattccagcagaagactaaatatattgttttagctgttgaacatctgcagattcccaggaaaatgaggagttacgcccatggagttgcaactcatggaagcccagttagcgaacattcctagcatatcttaagtatgtcataagcatatttaaataaattgatgagataatggtcttccaatatttatattctataaaatgaacacgtataaaaggttcagaagataatggtcaagtcattgttgagctttcaaatatttttcttcacttccttcccctggacatgcacaaggaaaacaagcacaatatccttacagataacagttttataatttttaaatctgctcaaattttaattagcatacaagcagataacattttatatattttattttgtctgtctaggctgctataagaaaaataacatagattggttgaattaaaccacaaatatgtgttgctcactgttctggacagtggaaattcaagatcaaggtgccaggggatctagtgtctggtgaggggcctgatcctggttcagggacacacattcattccatgacatactttatctattataattgtgactcgatgttcgaaacagaagcattccaaattttataagcataaatactgataatcaatacagagaaaagtaagcaaatccaggtaacagttaagttttgtcacataaactaatctgacacttcactgaggaagcagataattctaaagtctatagtacctgagtaagctaacaatgaatgcataccctgataatagtgagggcattttgatggatctgaacatggagcataatgactgtcatcaaaaaagaaatcactagaacaagcacctagaatttaaaatatttagctttttcactcactgtgggatgcgtccagcatttactttgctgcttactattttttctgtgtcttgtttgtttacgtagcttaattcacccatttctctatgatatagttaatagcggcttttctagtgttatgaatttttgtgctcaaaagaatgtgggtgccttggcatggggaacccttggagttactgtaatgatagatgtctgtcatcttcaacaaaatggatttcaaggcctagatttaagataaacactgaagaaaaactttccctgagtgctttctacccaagaatcttctcacttttattagaagtacagcttcttatcactcagcctcagactgatttgactttccaatgatgaaaaacaataacaatagcttttcttatttatgttctatgtaataacttcaagggaaattggattaagaatgcctcattcacaatagtgtgcagaatattgagtgaacaagtgtaactgtaaatttctaaatcagtcttaggcagtgatggctaaccagtctgcctaaaaatggcttgtaacaagccatgtgcagctgtggtatgcccacacttaacctcttcattttacattgcagtggaataattcaatagcaattttttcaagtaaaatatagattttagcccaggcatagtggctcacacctgtaatcccagcacttaaggaggtcaaggtgggcgatcacaaggtcaggtgtttgagacaagcctggccaacatggtgaaaccctgtctctacaaaaaatacaaaaattagctgggtgtgcttacaggcacctgtagtcccagctactcaggaggctgaagcaggagaaccgtttgaaccaaggaggcagaggttgcagtgagctgggattgtgccattgcactccagcctgggtgacagcgcaacactccaccttaaaaaaaatatatacatatatatatatatatatatatatatatatatatatatatatatatatgtatacatatatatattatatacacacagacacgcacacacacacaaatttagtcattccagattttcttcttctgttgaaagaaatattaaattttcctcatagaaataatgtttttgtttcaatgagtgaaaaattatttccatttactatttcctattattctcagtataatctatatttgggtctattgaactattgtttattaattctattttacatataactttagcgaaacctcttataaggtattttgcctatgagatatattaactctgttcttcctcaatgcagttatccagaattgtactttccaggaatatacatcacatgatgtgaagataagaatgcatcttgctatcagcactgaatgatgagattgatccatctacaatagaccatgctagtcaaaatgtatacattcaacaatgtagctatgaaaatttcactaaaacactggtacctggcaccatctagtaagttattgacaaaatacatttagaaaggaaagccattggctcattattaaatgtatgacaagagtccatgaaaatggtttataagaaatttagttggccgggcgtggtggctcatgcctgtaatcccatcactttgggaggccgaggtgggttgatcacgaggtcaagagaacgagaccatcctggctaacaaggtgaaaccccgtctctactaaaaatacaaaaaattagccgggcgtggtggcgggcgcctgcagtcccacctactcgggaggctgaggcaggagagtggcgtgaacccaggaggtggagcttgcagtgagctgagatcgcaccactgcactccagcctgggtgacagagggagactctgactcaaaaaaaaaaaaaaaaaaaaaaaaaagaaagctagttttggtataattttggaatacatatatacaaacagtttcaaatatttgaggtggaatgtgcactttatataacaaaatttattttaatgaataaaatcgtatgtttgtttgcaaattgtttcagcaaagttatctgggccttactgtatgaagatatagctccatcttttctttaaaaaatattgacttggctgaatgttttccagcaatgagaaaaagtcaattcaggaatgaactaaaactttaaaataactctagcaatcgagactttagcagtctctggagaaaacatcactttctccaatgaaatcctgtatgtatttttcaaggtattaactggcgtcctacggagaagtatttgaaaagggggcttccataaatagcttaaatttattaatctgtattttaaaatgtatggctttgaaaataaatcacagcatcacagccctactcagagtattccatgaatgtttacaacattacttttatggtagcatttatttggtttatgtcacagagcatgaacagtggggattgaatataagtgagtgaatgaatggtttcattcactacaattgtaacgattgtgttatttctcagagcttgtaaaacccaataatgtttattaaaagtaagcaaaacaaacaagaacaagtgaaacatgcacttggaagagacctctgttgcaccaggaattagacacaatggtgcagctgtggagaaaacaacaacaaatggcatttttttcctacctcgtctcttttcttggaaggaggaagaaaagagcaattccaatgtactacttcttcccactccaacttagaaatcgcaggtagactgtgaaaacagacctttatttcttcattaagtgtctgaattagtcacaaaattgagcttgaaaaccccacagaaagagtgctctgtgcaattattatgagatgatgctcctcctttctcccaataaaggacgaaggttcttctgcccagatgctgattttcacaatacattatagctgggccaattccaatgttacttactgatatatgctatctacattgcacttatattaaactattgctggtcataaaattatcgtataccagaaaggaaaaaaaaagtgaggcagcatgagctaatgaatatttcttattaattcagactctacataagcatgctgagtaagaatatttagtcttttcattttttaatgagttcacttaatcaatgacctgaaattgcactttctgtccacgtaacagagattcttacagcacaaggactgttatttaactttgagtatcagtgattttcacagggctggatcagagcccattctaaaatgtgcttattgcatgtggactgatactgtaaaatgtgaatgcttggttaatgcaagaataaaaataaaatactcatattcaaaagcacattcacatctaagatgctttgtgtgtctttttaaaaaaatatataagttatgggatacatgtgcagaaagtgccagtttgacacatgggtatacatgtttactgcacccaacaacacatcatttacattagggatttcccctaatgctatgctatccctccccttaccccaccacccgaaaggcccgtctatgatgtgtccctgtgtccctgtgttctcattgttccattcccacttatgactgagaacatgcgttgtttcgttttctgtttctgtgtctttactgagaatggtttccagcttcacccatgtccttgcaaatgacatgaactcattctttttttatggctgcatagtattccatggtgtatatatgccacattttctttatccagtctatcattgatgggcatttgggttgattccaaggtttttctatactaaatggtgctgcaatacacatacgtgtgcatgcatcttcataatagaaagatgtataatcctatgggtatatacccagtaaagggattgctgggtcaaatggtatttctggttctagatcctttaggaattgccacactgtcttccacaatggttgaactaatttacactcccaccaacagtgtaaaagcgctcctaattctccataacctctccagcatctgttatttcctgactttttaatgatggtcattctaactggcatgagatggtatctcatagtggttttgatttgcatttctctaatgactagtgatgatgatcctttttttcatatgtttttggcagcataaatgtcttcttttgagaagtgtctgttcatatccttcacccgctttttgatgggttttttcttgtaaatttgtttaagttccttataaattctggatattagattaactctttgtcagatggatagattgacaaaattttctcccattctgtaggttgcctgttcactgttcactgttcactgtgatgatagttttgtttgtttgtttgtttgctgtgcagaagctctttatttcaattagattccatctgtcaattctggcttttgttgccatttcttttggtgttttagtcatgaagtctttgcccatgcctatgtcctgaatggtattgcctaggttttcttctagggtttttatggttttaggtctaacatttaagtctttaatccatcttgagttaatttttgtataaggtgtaacgaagtgatccagttacagttttctgcatatggctagtcagctttcccaacaccatgtattaaataggaaatcctttccccattgcttgtttttgtcaggtttgtcaaacatcagatggttgtagatgtgtggtgttatttctgaggcctctgttctgttccattggtctctatatctgttttggtaccagtaccatgctgtttcagttactcttgtcttgtaatatagtttgaagtcaggtagtatgacgcctccagctttgttctttttgcttaggattgtcttagctatacgggctcttttttggttccacatgacctttagtttttttctaattctgtgaacaaagtcaatggtagcttgatgggaatagcattgaatctatatattactttgggcagtatggccattttcacaatattgattctttctatccatgagcatggaatttttctttccatttgtttgtgtcctcttttatttccttgagcactgatttgtagttctccttgaagaagtccttcacatcacttgtaagttgtattcctagatattttattctctttgtagcaattgtgagtgggtgttcacttatgatttggctctctgtctattgttggtgtataggaatgcttgtgatttttgcacattgattttgtatcctgagactttgctgaagttccttatcagcttaaggactttttggactgagacaatggggttttctaaatatacaatcacgtcgtctgcaaacagagacaacttgacttcctctcttcctaattgaatactctttctttctttctcttgcctgattgccctggccagaatttccaacactacgttgaatagcagtggtgagagagggcatccttgtcttttgctggttttaaaacgcaatgcttccagcttttgaccattctgtatgacattggctgtgggtttgtcatacacagctcttattattttgacatatgttccgtcaatacctagtttattatttttagcatgaagggatgttgaattttatcgaaggccctgtctgcatctatcgggataatcatgtggcttttgtcactggttctgtttatgtgatggattacgcctattgatttgtgtattttgagctagccttgcatcccagggatgaagctgactggatcatgttggataagcttatgatgtgctgctggatttgatttgccagtattttattgaggattttcacatcgatgttcatcgggcatattaggcctataggcctgaaattttctttttttattgtgtctctgccaggttttggtatttggatgatgctggcctcataaaatgagttaaggaggattccctctttttctactgtttggaatagtttcagaaggaatggtacaagctcctctttgcacctcttgtagaattcggctgtgaatctgtctgtcctgggcttttattgtttggtaggctattaatcactgtgtcaattttggaacttgttattggtctatttcgggattcggcttcttcctggtttagtcttgggagagtatgtgtacccaggaatttgtccatttcttctagattttctagtttatttgtatagaggtatttatagtattctgtggtggtactttgtatttctgtgggattggtggtgatatccctttatcttttttttatcatgtctatttgattcttctctcttcttcttctttattagtctggctagcagtctatcaatttgttaatcatttcagaatatcagctcctggattcactgaggttttgaagggattttcatgtctctatctccttcagttctgctctgatcttagttatttcttgtcttctgctaggtttgaatttgtttgctcttgcttctctagttctttcagttgtgatgttagggcatcgattttggatctttcctgctttctcatgtgagaatttagcactatgattttccctcagaacactgctttagccgtgtcccagagattctggtacattgtgtctttgttctcactggtttcaaagaacttatttatttctgccttaatttcgttatttacccagtggtcatttaggagcaggttatcagtttccatgtagttgatgcagttttgagtgagtttcttaatcctgagttctaatttgattgcactgtggtctgagagactgtttgttatgatttatgttcctttacatttgctgaggagtgttttatttccaattatgtggtccattttagaataagtgctatgtggtgctgagaagaatgtgaactctgttaatttcgggtggacagttctatagatgtactaggtccactgagttcaagtcctgaatatctttgttaattttctgtctctttgatctgtctagtattgacagtgggtgttaaactctcccactattattgtgtgggagtctaagtctctttgtacgtctctaagaacttgctttccgaatctgggggcttctatattgggtgcatatatatttaggattgttaactcttcttgcattgatccctttaccattatgtaatgcccttgtctttttggatctttgttggtttaaagtctgttttatcagagactaggattgcaacccatgcttattttttgctttccatttacttggtaaatattcccccatccctttatttggagcctatgtgtgtcttcgcacatgagtctcctgaatacagcacaccgatgggtcttgactctttattcaattttccagtctgtgtcttttaattggggcatttagcccatttaaatttaaggttaatattgttatgtgtgaattcgaacctgtcatcatggtgctatctggttattttgcacaatagttgatgcagtttcttcatagtgttgttggtctttacattttggtatgtttgagcagtggctggtaccagtttttcctttccatatttagtgcttccttcaggagctcttataaggcaggcctagtggtgacaaaatcccccagaatttgcttttctatggaggattttatttctccttcgcttatgaagcttagtttggctggacatgaaattctgggttgaaaatacttttcttcaagaatgttgaatattggcccccactctcttctggctagtagggtttctgcagagagatccactgttagtctgacgggcttgcctttgtgggtaacccaacctttctctctagctgcccttagcattttttcctgtgtttcaaccttggtgaatgcgatgattatgtgtcttggggttgctcttctcaaggagtatctgagcggtgttctctgtatttcctgaatttgaatgttggcctgtcttgctagagtgaggaagatctcctggataatatcctgaagagtgttttccaacttggttccattctccccgtcactttcaggtccatcaatcaatcatagatttggtattttcacacagtcccatatttcttggaagctctattctttcctttcattcttttttctctaatcttgtcttcatgctttatttcattaagttgatcttcaatcgctgatatcctttcttccgcttgatcaattcggctactgatacttgtgtatgcgtcatgaagtccttgtgccgtgtttttcagctccatcaggtcatttatgttcttctctaaactagttattcaagtgagcagttcctgtaatcttttatcaaggttcttatcttccttgtattgggttagaaaacgctcctttagctcagaggagtttgttattacccaccttctgaagcctacttctgtcaattcatcaaacgcattccctgtcccgttgtgttcccttgctggcaaggagttgtgatcctttggaggagaagaggcattctggtttttggaattttcagcatttttgtgctggtttttcctcatctttgtggatttatctacctttgatcttttatgctgatgacctttggatgggattttcgcatgggcatcctttttgttaatgttgacgctattcctctctgcttgttagttttccttctaacagtcaggcccctcttctgcaggtctgctggagtttgctggaggtccactccagaccctctttcctggggtgtcaccagtggaggctgcagaacagcaaagattgctgcctgtgtcttcctctggaagctttgtcccagaagggcacctgagagatgccatccggagctctcctgtatgagatgtctgttgatccctgctgggaggtgtctcccagtcaggaggtatgggggtcagggtcccacttgagggggcggtctttcccttagcagagcttgagtgctgtggtaggagatctgctgctgtcttcagagccagcaggcagaaagagttaggtctgctgaagctgcacccacagccactccttcccccaggtgctctgtcccagggagacaggaattttatctatgagccgctgactggggctgctgcctttctttcagggatgacctgcctagggaggaggaatctagagaagcagtctggctacagtggctttgccgtgcagtggtgcgttctgcccagttcaaacttcctggcagctatgtttacactgtgagggggaaaccacctactcaagcctcagtaatggcagacatccctctctccaccaagctcaagtctcccagctcgacttcagactgctgtgctggcagccagaattcccagccagtgaatcttagcttgctggactccatgggggtgggacccactgagcaagaccacttggctccctggcttcagccccctttccaggggagtgaacagttctgtctcgttggggttccaggagacgctggggtccaaaaaaaacctcttgcagctagctcggtatctgtctgaacagctgccgagttttttccttgaaacccagggccctggtggtgtaggcatctgagggaatttcctggtttgttggatgcagaaactgtgggaaaagcatgctatctgggctggatagcaccatccctcaacggcgtagtccttcacggcttcccttggctaggagagggggttacccagccccttgcacttccccggtgaggcaatgccccacccttcttctgcttaccctccgtgggctgcacctactttctaaccagtcccagtgaaatgatccatgtacctcagagggaaatgcagaaatcacccgccttctgtgatggtctcactgggagctgcagacgggagctgttcctattcggtcatcttgctgagttccaactgctttgtgtgtctcaatttatgtgtccatgaatacattaatgggagacacttaaagaattctgaatctttgaattagctatacgctctcttccagatatgtggggaaaactgtcttcttttcaaaactaaccatagacacacacctttatcatgaggtgtactgatgaagcacaatgaaagcaacactcatagtttctgcatttgccatccaatatcaaaacaaaactaaaacaacaaaaatctttcatgattcaagtgcttcttcgtccaaaatttaatttaaatagactttctttgtgaaagaataacatacacacatataattttgttttaatatcttttagatcaagaactattcctaatgacctctatgaaattcaggtgaaattcggttttaatattgtgcttcctcagtaaataaaaggagaaagggcccctggaaaaccaggttttttaaaagtatacttgtaatttactataaaatagaatccagccaaaatgcactaacatgtaaggtgcatagttcattctttcattcaataaatatttttgcagtctctatagcactgtggccaagaactgtatcttatcacttgacctcttccaaggttactataattctcctaaaaatacagttactgtctccttttacaattaaaaggtggagatcattctcattattttcatatatgattggtgtccctgtcctttttatgtaataatgtgattctgcaaagtggcaataacaggtcacatttttattaaagttgcgggatgaaaaggaagctggattttagaaatttaagtcctgggttgtagaaccatttccactacatattgtctgtgtaacatccggcaggtcattaatttctctgaacgttatctgaagaaaaggaataatgcaggtatcctccagaggcatcaccagagtgcagaagggagagcacctcttggccatcaaactcactttgagacagaaagttgtgtccactgtgaattcattatgatatggtagacatgtggctcagtgcatttgaactccagttccccttgcctatacaaaggaataaaattgtctaaatacaggcaacattttgaagatttaaaatatgttaataaatttacatgaccaagagaagtattcttgattttcttctctcatactccacaagtgcttatcaacaattgctggtctcatctccggcaataacaagctagtctgaggtcgcaatgtccttagactagatcatctcagtcgccttctaaagacttgcaaacttgctgtcattcattccccgtgttacagctgttgtgatcgttccagtgtaaatcaaacaatcccacagcacatcaccaaatcaaactcgtaaatccacctccaccaccacagcctcagtccaagctgccgtgatctcttgggtggaaaaatacaattatttactgcattatctttcaacatccactcttctctcaccagtgctccacatgccagcataattgaccattcaacctcctctttattgctagcctatccctcttagaataattgcagaaagtatgcaggactgtcgagttatgtgcactaagctgtatcagctctgtaggctacactactccagtccccacctcgtcttctgaattccaggcacccttctagttcctctacaaaagcacaaggcttcctcttgccacagggcattgcctgggttctcctctcattcttttcttttctcctggcttctctcctgctcactcttcaggggagagtcagaggcatttggccaagaccttcccctgtcccattccccagactagattacctcttcttgcaaaatcctcttacagtttttccttaatagtccttcgtttggctggaaggtatatattttttcacatacagtttctaataagtaactctctcctactataccaagatagcaaggactgtctctcaccttttttgttggcagggggtggggtgtggcgttgggttattgtccatccagtatctagcttactctgtatatatatagcatttattaaataaatatttttggatacatgaaaacaatgtaaaataatagccttcagtcataagtagctagaagtctgataatctctttctaaaacttaactaaattttcagaaatatatgttaatatcaatatgtatgctaattcaagtgatattaagatatttaccaaaaataatttaaatattaatacttaaaacaaactattttaatttcatgtacatttccacaaatgctttagtcacatacttcagttatgattaaataatttttccaggaattaatagaatgattatttagatttacttatgtagaaatcctccaagctctcagctaagttttctaattcgatgaacacagtgtgattctatctccatggtgacagatattagatcttgaatttttatttctttaatattgctttgattacgaacaggccaaaaatgattatatgataatttgtatatacacacacatatataacgtgtataatttatgctaatcttctgcaatgtttccttgggttttttttgcactgatttttaatacatttattgaagcgagattttcttttgaatgtatcaaaatcaaatatagaatgtaagaaaggaaaaaaattcacttagcagtctgtgaagctcctcagatgggctgacttcatagctgctctcttgggagactaaaattatttcaataatgatgccccaaaatatttaggagagcttatttcagaattaccttctaaacctgtggcacatttctttccatcctctcaagtcggggaaatgttcttggacactctgctctcaggaacccaacaggctcccagctccaagcgtgctcccctccttcctcttccctatgccaccacagcacccaccttgccatccacagcccatccacaggctccagtgtggcccacggcatccttcctccgggtgtgaaattgcttttccctcaggcaggatccagtatctcttcttcaccaggtaagtcttactcttcacacctcaacacttcagtttctctatgaaagcttcccctgaatgctaagagaggacaaattgctccttcaaagtgcccttgcaccctaacacagtgttttcatgggtatgctgtttgattactttatctgcctgtccttaactgaaagctcattgagaataaaaaagatacctgatttagagctacattccttggccttgcattttccctggcacatagcagacctcaagtgaatatatatttaataactaaatatatagtaaatgtatcaagtcctaggaaacaagccttagtgcaattatgatattggatggccagagaaaaatgacatgggtctggtttctatgtaaattttggactttcggggatcacatatttggtggacccagggctcggctttaggactgtgtactcattaatgtgtgtaaaaagttgactgtgcaagtgcacccgagttagctcagagctgcttctagcaattttaatctatactcaaagtcccccacatcttaccacaggctgataaaagagcattttttgttcttttttgagaggaagtctcgctctgttgcccacgctggagtgcagtggcgtgatctcggctcactgcaagctctgcctcccgggttcacgccattctcctgcctcagcctcccgagtagagtagctgggattacaggcacctgccacgacacccggctcattttttttttttttttttttttttttttaggacagacggggtttcaccgtgttagccaggatgttctcgatctcctgatctcatgattcgcccacctcagcaagggactacatcatattcttcactgtgaattaaataaacataaatccttccacaaatattcagagtattaatttcctgttttattataaaacctatctttggctgggtgcaatgcttcatgcctgtaatctcggcattttgggaggccaaggtgggcggttcacgaggtcaggagttcaagatcagcctggccaacatggtgaaaccccatctctaccaaaaatacaaaaattagctggacatggtggcaggtcctgtaattccagctactcaagaggctgaggcaagataattgcttgaacctgggagggggaggttgcagtgagctgaaatcgtgccactgcactctagcctgggtgacagagatagactccacctcaaaaaaaaaaaaaaaacaaacctatctttacaagcagaaatggcggcattatagaaggcacattttactagatcattattttgaaatcaccatgtgaaaaccaccatgtggaaaaatattaaatcaatacatttaattaaaatgattaacctttttaaacagcatcttttcattaattaaattgaaaattgtacataaatgtttatcacataaaggcacaatgttagacactgcaaaagatatctttctgcaataaactgttccatttatacagtttataaagagtaaggacaataaaacatgcaggaagagcagtaattgcagaatgaaaaagtggcctgtgaggaatatgtacacactaagaatttaaaaagtcaggtgtggttgctctgacggaatcaggaaaataatcctcatgccaacggcgaagtttaaacatacatacatatatatacatatatatatgtatatatataaaaaatcctcttgccaatggtgaagtttaaacatacatacatacatatatatatacacacacgtgtgtgtgtgtgtttgtgtatgtttgacagaattttgctctcatcctccaggctggtgtacaatggcgtgatctcagctcagtgcaacctccgcctcccaggttcaagtaattctcctgcctcccttagcctcttaagtagctgggattacaggcacccgccaccacgcccagctaattttttgtatttttagtagagatggggtctcagcatgttagccaggctggtctcgagatcctcacctcatgatccaccaaccttggcctcccaaagttctgatattacaggtgtgagccatcatgcccggccttaaacctatattttaaggatacttctgaagcaaaatattctggaaactccatgttttttacatggtgaatttccatgtaaatttacatggtgaatttttacaggtgaatttccaattttatttccattattggcttacttgtgttccatgtttctgttaaattctaggattcaattctcagataaacatttcccaagtgtaaaactttacctagttttcctaagtcttataagggtataattaagtctttaactccagatgcatagctcgatttcctgtattttatgtttacatttccaaatccctacttgctttttattttcttaaatactaccatttccatgtgaactgtcacatctttatagtagtaactgtgaccaacctacatgagtgtgtttctctgcttttgtttctatatttaaagagggtgggaggactaaatattttgtctttaaaatgtattaaacacctatgtggccctgactgtaccaggcactgctttcaactgttatgtaaacttcatggaatctagcctgagcttgccccctgctgcccttccccttgtgggtactgccttaacacgccctctgctctcggctgtggtcatcacccagccaggtgtctccatgctcattaatttatttccaggaaggtacatgaaagacatgagccctgtatcatatatctttttaacattttcatcgcagtgttgaccatcttcctttgttgtgtatcgtgtaacacaaataatgatattaaaagcataaaaaaaactattgcatccactttacaggtgagaaaattgaggcatagcgaagttatggaaatttcctaatatcatgaggttctggctcgggccgtcgggttcccagcttgagttgttccccatgtcgggcgtctcatgaggctcctcctttctcctcttccatctcacccataactgctctctcccctccttcttcttcgtggcatcacataagacattctcttctaccctggctgagcaaaatgcaccgcgtcttccaaggtaaatgcgacaacaccaggaagcccttcctgattaaatcaccccaaatcaatctctctccctttgaggttctcctaacattttatttccttatgatagtgttaattatatcctatcttaaaaagttgtatcttgtacatactgcccgcttcatactggattgtaaattcacggaatgcaaataatttattgcatttttccctgctattgtgtttgacatcatcggaagttcaatgcacatttttacatcacttttaggtgaaaagatagacaacgattgtccacctcagtccttattccagtgcctcacatgtaacagacatgtggtcatggctaggtaaatcaatccatggagcaaagactgcatatgaaactagtttacatgactacattttaaggtaaacattcaaataatattaactgaaaatgaacggtagaaagaatctttagtcaaggataccatctatgaacacaaatttctattttagaatttagttgacttgttgataaaactaatttggcaatgaaaagaatgtttcatataaaattaataataattgggcatttcaaaatgtttatttcatgaagaaaaaagaacaagacacatgcagaggaagtaatgaattattttaagttgaatatatactactttaattaaatcttactacctctcgatatactgtacatttttaacttatatgtttaagatatgactccaatttttatctttttgagcttggcagatctagcaagcagttgttttctattttgaaaactgtttttgaatatgagataatcttatgtagaaaaagggtttgagaagcatgcattattttaaatacataacagattcattttagccagcattgtaaaaaatactcaatatatcattaagacacattttagaagagactatatttaggaattgattcctcagtgttaaaagaaagttagtggaaaggggagttcatttgaatctgtctatgctcccagttggggtcacataagcaggtcggttttaacagcttccagagaattcccagagggccctcacctcagaccaacaagaccatcttggcagacaattgcctattggctattgctaggctctgagcaaatgagtcaggaagcctgggagggcacaaagcactgacccaaatctctggactcttctacctcctccagatctgctgtgaattgtcccctacatccaccatcaacttgagtctcacagtacagtcaggtcaaagaaagagttggggctaaggaagcatttgatggaagacaaacgacgatggctaaaatctcagtagcctacgatgatgaaatgaaacagcatcgcagagagagaagcagtcatgggacactgcgttccgagcctcttttttttttttggtttgttttgtttttattatctgaactgatgagctttgtgagtagcacatgaggaataatccttccctggcatgtctgtagtgaaaattgacagacatgaggtttgtcatatatctgacacccactaagcacttagaattactgtcaataataataaagggctgacctaaaaaatggtcccggacatgatcttccggctaagataaaacagcttgttatcagaccaagtctcctgcagagccaaattagaaaagcgggataaaatatattacaagataaacataattgttttgaggacaaaggagagattatcagggctgcaacaacttgaggagccagaataacggagagaaagaaaacacagagtggtgagcccaatacagatccactctttcctccaggcaccaggcaggaaatggagaaactaagtcctgtagtctcacaggagtgagagatcaggaaggaagacagtctctagcaagctccaaagcccacagctgaaggtcactgaagggctacacattagcaaggatgcacctggaaatgcaccagccctcatagtgagaggtgacagcaggctggcagtcctcccagccctcgctcgctctcggcgcctcctctgcctgggctcccactttggtggcacttgaggagccctttggcccaccgctgcactgtgggagcccttttctgagttggccaaggccggagcccactccctcagcttgcggggaggtgtggagggagaggcgcgagtgggaaccagggctgtgcgaggcacttgcgggccagctggagttccgggtgggcgtgggcttggctggccccacactcggagcagctggccggccctgccggccctgagcaatgagggacatagcacccgggccagtggctgcggacggtgtactgaatcccccagcagtgccagcccaccggcgctgtgctcgacttctcacccggcgttagctgccttcccgcggggcagggctcaggacctgcagcccgccgtgcctgagcctcccacccactccatgggctcctgtgcggcccaagcctccccaacgagcaccatcctctgctccacggcacccagtcccatccaccacccaagggctgaggaatgcgggcacacggcacagggactggcaggcagctccacctgcagccgtggtgcgggacccaccgagtgaagccagctgcgctcctgagtctggtggggccttggagaacctttatgtgtcttcctcagggattgtaaatacaccaatcggcattctgtatctagctcaaggtttgtaaacacaccaatcagcaccctgtgtctagctcagggtttgtgagtgcaccaatcgacactctgtatctagctgctctgatggggccttggagaacctttatgtctagctcagggattgtaaatacaccaatcgacactctgtatcttgctcaaggtttgtaaacacaccaatcagcaccctgtatttacctcaaggtttgtgagtgcaccaatggacactgtatctagctgctctggtggggccttggagaacctttgtgtccacactctgtatctaactaatctgatggggtcgtggagaacctttgtatctagctcaggcattgtaaacacaccagtcagcaccctgtcaaaacagaccactgggctctatcaatcagcaggatgtgggtggggccagataagagaataaaagcaggctgccccagccagcagtggcaacccactcgtgtccccttccacactgtggaagctttgttctttcactctttgcaataaatcttgctgctgctcactctttgggtccacactgcttttatgagctgtaacactcaccgccaaagtctgcagcttcactcctgaagccaacgagaccacaagcccaccgggaggggaggaacgaacaactccagatgcgccgccttaagagctataacactcactacgaaggtctgcagtttcactcctgagccagcaagaccacgaacccactagaaggaagaaactctgaacacatccgaacgtcagaaggaacaaactccagacgcgccaccttaagaactgtaacactcactgcgacggtccgtggcatcattcttgaagctagtgagaccaagaacccaccaattccggacacattttggcgaccacgaagggactttcacctatcgccaagcagtgagacaatcgccgagtggtgagaccgtcgcctatcgccgagtagtgagacaatcgccaatcgccaagcagtgagtagcatcagacccctttcgcttgctattctgtcctatttttcattagaattcgggggctaaataccgggcacctgtcggccagttaaaagcgactagcgtggccgccggactaaagaaacgggtgtcaggctttctgggaaagggctctctaacaacccccaactcttcggagttgggaccgttggtttgcctagaaccagcttccgcttttcctgtacttctgggctgagccgagggtctacagagaggaaagccatgcagctccggggtcccaacaacatgttggttgaccctgtggccatgaccggaactctcaaaagcatgtcgcccaagccagacttgcccatctatcctatctatcctgacccttgccctctgggtcctaatgccggccagacaaacttcctctcacctctcctctctgaggttaggcccgcttctaaaaattgctacctgtctctggtgcttttctagtttctcctataagaaaaccagcttttatttagattggatcaactgtggattgcattggattggattaagcagctcaaatttagactggattaaggagatcagccccagtctaactgcctgccagaaacaaaataaatggtctctggggaaatcaaacctcaaccagactctcaaattatttgtacaatttttcatacaaaagattctatattttaaaaaaattacccagcataccaggagaaaagaccaagtgatcaaaaactgagaaaaaaaaaaaaagtacaatagaaagagactaacaggaagtgtagatattaaagttagcagaagttgcctttaaaataactgtgattaatatgttcaaagaaataaagagcaccataaagaacatcagcagagaactgccatctacaaagactggagtcacatggaaattctgcagttgaaataggcagtcccagaaattaaaaattaagctaattaatagcagattaggcaaagttgaaaagaggattagagaactagaaaaaaggttaatacacaatttttgaaagagggataacgaaactaatagtaaatgaagaatgactgtcacaaaacgtggaatatgggcaaaataataaataacatttcctcataaggagaaaaaagaaacaatggaatgaaagaagtatttgaagagataatgacagataatttactgtaactgattagagactttgagcagaagtgaaaaggtagaattcagatgaaagaaaccaaattacaaagagaaaaattttaatcatagaaaaaggactggcaaagaagcaacaataaaagttacagaagattttgcaatggaaaaaaattaaagccagaggtaatgaatgctgtctttaaagtgctataataaaatgatgaccaacatagagctctatacaaagtgaaactatcctatagaaattgaagacattttaagttaaattaaatctgagtaaatactctttagtccttttcaggtcgaataaaaattatattagatgaaagcatgcaggtaaagatggaataaacagcaatacaaaatgtaagctgatgggaaaattatatgtaacaataaaattattgatttgtgggatttaatatattagcaaaataatttgaaaattaattcaaacttttaatgactattttcatcattacctttttcattattatgcgcatgtaatggttgtacgtatacatggagtacacatgatattttcacacaagcatacaacgtgtaatgatgagatcagggtaattggctatccatctcctcaagcatttgccatttctttgtgtttaaaaacatgccaattccactcttttggttatttttaaatacataataaattattgttaactatggtgaccctattacacttccaagtactagttcttattcattctgactgtattttagtacccatcagccattcccaatttttccccaggcaattcccattggcagtgactaattgcttgtgtagagatagatttctctcacagagtgttgattttaaaggttacataaactgttaaagtcacagaccaaacctgttacagacttaacctgttaagctcatgtttcaaattcataactgtgatatttactggtttaatgataaaaatcacacctagttccttctggatgagccacagcttggcaattttccaggaaaaatcaatgtttttatggacgtaacctttttagcattttttttgatgctttattttctctaggacttttggataaacactgttccctctcagtaatttatatcataaaaacacagcactaaaatccctttttgttttattcacatgtatatgaaataccgccacaccatattccttaaagcatcatgcctgtgagagagatcctccatgaatagctgtgcggttccccatggcactttctgtgctcctccaggatgatactgggctgcagctgttctgcacacaggtctgcacgcacagtaggatcatggcaggtgttcaactttttctatccagtatctggcatagtatttgataagagtgcttaactttgtttgatgaataaataaatgagaacttgcatgcatgaatctgtactgtgtaagagaggttacatctatataagagcgcctaaaaagttataatagagatacccattaaaaataagtttagttaattttgaatgaatgctttcatctcttttaatccatgaaacattgcttttactattatatatgacaatatcctacagaggccaatagattaggtgcgctctcttcttccacattgatttttctgcccatcgtgagccaaccagcttttatggcttacttgaagggtatgtaattccttcagtaaaaaatgagttttctccacttgtctgttgttttacactgaaatgagtactgggaactgatgcatagtttgaagagcttaatgttcttttactcactttctctgcaaaaataattacacaactgtaaaactgtgagcttttcaaagcatcaagttcttgatatatatgtatatgtacatacatgtatatgtggatatatatgtatatgtacatgtatatgtggatatatatgtatatgtacatatatatgtatatgtagatacatatgtatatgtacatatatgtatatatatatgcacacatgaatttctccttgtccaagtgtctaacacctaaggaaatttattttgatacagaacctttcctagatgtgtaaaagaagaaataagctttacttacaaataattgtactcagactcatgatcacgatctcatttactgaagagaactatgtcttatgaactatgccttcactaggtactggttaagagattttctccacttatgacactcttcataaagtaaacattaagactttgcatttatagtagatgctaacacaagcacttttcacattatgaacttgtgggtaccattttgttaaaacattttgcctttccacaactctgtaactataaaaaattatgaaatttattgaaatgtaaaaactgttgtccctttaaaaactgaagtgtgaatacttttaaactcacttccagtgatagaaggagattgtgtgtagactttaaagtatacccagcaacatcaactagctactttcctgaatcgtgaatgcagcaccatttaagcaagcataggaaaaagaaaactaacaaaaggagcaaggtaaagcaaaatctaatacatgttcagtattctaaaatgcctctggcttccctctagctagagtggataataatttttcaaagacgggcttattttaaatggctagtaaaatgatatcaaacattttcttaggcatatatttaaatagagaagaaatatattgctggtgttgattacaactcaatggccgtcagaagacagtaacttttaggattccattaaatgctgatactagccaaaaagaaaaaggaaataaaacatcagaccacagtttcaaatacagtatagagagcacacactggctatgctatctagagacagagataaagaactatctcataaagacagagataaagaactatctcttcctctagatagtacagccagtctgtcctctctgcactgtatttgaaacagtggtctgatgttttctttcctgtttaagaaactctactctggccgggcatggtggcacatgcctgtaatcccagccctttcggaggccgagtctggcggatcagcagatcgagaccatcctggttaacacggtgaaaccccatccctactaaaaacacaaaaattagccgggcgtggtggcgggcgcctttagtcccagctactcaagaggctgaggcacaagaatcgcttgaacccgggaggcagaggttgcagtaagccgagattgcaccactgcactccagcctggcgacagagcaagactccgacacacacacacacacacacacacacaaaagaaactctactctgtgcttgattctgttcacaggctgctgctcaagcttccactgacgcgaatgtgatgtggcattaaaaacactccagggtgccctttcacttggaaaaaatatacatacacatatacattgcctttaagtatagtagagccaagtacaatatactatatataatatacattatataaacacgttatgtatacattatacaacgtgtactacatgcacattatataatgtgtaatagtgtaaaaatagaaaaataaaaaatatgttgtccttagactatctttaatttgtaaatgtttcaaaaagagaaactagaattttcattgctctcaatgagaaaagaaagaaaagtgcaaaaaagggaattggatagagccttatcagagttatgtaaaagaactacatttttctatattggaaaataaatctaatttttatttctaaatttgtgttttgcctctgcatatattatgccaataagaatgatgcctcagtgatctttagccatgttttttctgcctaattcaaagtattaaccataatatctcactcttctcagggactctgaaccaaaaaccaatgatagtaaggaatagactatttcttttttaccaatactaagaattaaagggttaagttaagtaagacaaactctctgctgatcagtgcctgcgagacaacagtgaaaaacaaatcagcactcattccccaggttaggaagtgcataatatgttaatgtcgactctataatatgggacttgcttgcattattaattgctaactcattactcaaaaagtgttcattctacaatactattaggcaagtgtgtttgcactgtgaagaccaagcaaaaataacctccgcaattgttgaatggtacaattagaaacacatgatttctaaattgccattatcacggccaaaaaaatgataaaaataattagttgccaacttgggaaaaaatatatatctttgccatgtcaaagagtatcaagaatactttggcagtttctggaatgcagcgtattaataattttcagaatctatcaggagcctgatgccactgagacctgccttctgacaccatagaatatgtggcttttgtctaacccacacactggacctggaagttcctaggttactaggctaagcaagtgcttaagatactgtctgttctaaaagtcaaaatggctccaaatgcttgtctatgctttttaacaatattacatttatttattttgtggtggtaacatgtatttatgaaatcttcaaagttatataggtttatttagaataacatgcaattttatttggtaaagcaagtgaattttgctcagaattctttatgctgttttttttttcttttagatgagaccaggataactcatctgtggtatgtgttacaagagtagtgtctagcgtcatacttgaaagtggagagatggtgaccatggggacagaaaagttctgggaagcagacatggactactggatttccatgaaaacaaaagtcacatccagaatacattaaattctaaaacatacatgctcaatcaacatgcgaagatactgaaaggactttgggcttattaattttatgttattcatccctagctgttcaaaagtactcattaagattgttctggtatgtagaatgtaaataaaatttatagctttatttcatatatttgaagcgctagcataatacctggaattatgacacctctccctatatgcttttaaaaataaaaatataaattagaaatatactatttaaaataaaaatgtatactgttaatatatgttgttcaaagttgttgacttttacaacattataaagctatattcacgatgaaatcttaagaaaatgagaagcactgaatagatagattttttgttgtttgttgcttttatgcttttggttttcttttgcttatctgaggacactagtaactaagattttggaaatttttttcctaaaataatttttaaacatttcttaataaaaggatatgggacataatttgagcttctcataatgactaatctttacttggcagaactcatcgtacacatttctgtgatacaacaatgctctcaggccttctgagctctgctgagttggtgattaaaacacacctggttgctgtcttattttagtcttcatatctcacctgtggcctgccttcttccctgctgtcaatcaattgcatgtttctctgaagcctgtgttcttgtctccaacagaaattcccaggatctgctattctctaaggttgtaagctatgccatcaaaagtattgagttctgaatgcatcatttcttcagttgtgtgttgagtgcttactgtttacaacatattattaggtattggctgagtaaagatgaagatgaaataagcaatgatctctaatatgaagaactcacaaacaccaggaggaagagccaaatgtgaagtacgaagtcgaacaaagacccagaggaagaagtgagtaattctttctggtctaggtcagacaaaattcacagacaaactagttgggccaccttggatatatgaatacaactattccaggtggagaagggatgaaagaaaagcattccaaacagaaatgagcaaagctgttgagcaaaagcaaatgagcagagctatcgagctgtaaacctgcatggtaggtccagggaagtcactgtggtatagcgtgattacagagtgaaggacacagagaggactgtagtgcaggcttctctcttgggagcagatgcaagcagctttccaagggtagtgatggcggaactgggccttcaactgtcagcaggagagggcataagtatgtaggtcagtgtcagattggaacaggcctgaattttaatataaatatgcaatgaaaattgcagagaaggttttaaagcagtgaagtgaggggataggatctgttttggaaatacttagcgtattgaggggaatgtactcagcaatgaggcagtggctacagaaagaccgtctagggggcctctggaacaaggcagaggggagaaagtaatgaccaagggaccggtggggaggctgaaagttgggcagacattctgagggacttcaggagatcggaggaaaggcagctgctagtgcaaacgcctagatagatggagatattggcaaaggcaaaacaggctgcaggtcatgcaatgcggccaggatgggaccagtgaatttcttatggaccattgcatctgaggtaccggagggacgtctaacagtagggacatgctggtagatgtttaacgagcggctttgctggcataacggattcctgatttataacatttgccaatttctgtggcataaataatactctcagggtagatttcatgctcccaacaagaatcttcctttaattgtgcctcttattatcttatctagttgcagtaactaaagtgtccaggagggtattacagaatagtgaaagtggtatatttacagtggtaattggaatgcttttaaattattccattaaattgtcacaaatattttaaaaaatatactcttccgtattcattttccttgttatcgctttgttgtttttgaggtggagtcttactccatctcccaggctggagtgcagtggcatgaccttgactcactgcaacctccacctgccaggtttaagcgattctcctgcctcagcttcctgagtagctagaactacaggggccggccaccacgcccagctaatttttgtatttttagtagagacagagtttcaccatgttggccaggctggtctcaaactcctgatcccaagtgatccgcctgtcttggcctcccaaagtgctaggattaccagcgtgagccactgtacccggcctcttttccttatttttgatgacatttataaagctcaatccaaaatgtgtgctaaatttttatctacgaattttaatatttatacttagttaaaatattgttttctaaaatctaccaatacacgaaatatcctgttgtttaatcattgtaatactattgaaatgaatttccatatttattgattttttcatttgctcccaaattctatgttaatatttatttagaagtttcgaatcagcatttatttatatgtgaggtttgctgtagttttctttctatatgtgttttctcaggctttcctgtgaaattcataaaactatttagaaaatttcttattggtctacatgctggaggggtttgtaaatcactggtgtcatctcatcctgcgatatcttgcataatgcatccgggccatttcttggtctcattcctttcttagggtgaatggaggatgctgaggtctcagcattgagaggaccaggcagtcactgaagtgcatacaaatgggccctacagaatctgccttttgctgctgctgaaaagcaaggttaatggaatttccgcaggaacatgagcgttaatatgatttccccatttgttccctctcctctttacgcatacatagcaaattaattaaatacttctgcagcatggctaaatccttgttattgtcatgataaaaaattaagcataataattttagtgctaattatgtatttttggcataatgtttcattccaactgaaatacccttaagcacaggagaatggccatttagtgaaagtgaaacataaaagagaacgcttttagagtcttggattatttttcaattataaatagcccataaagtgactatttgtagcacttaatatttatatataatcacacttcataatgaaagtagaaaataacaaatgacagaaatatttttatgatttttgtgatccggagtcttaaagctctgaaaagaccttagtttaaaattattagttactacttccatgtaataagcaccaattgtataccagatctcttaatttttccaacaattcctagctatatgcaacatcatttccattttgcaaaaaaggttagcatgcttaataaagttaaagaactttatcaaaaagcttctagagaatggagcagtttgctaagattgcctgtaacaaaataccacaaacagaccagcttaaagcaacaggaatttattgtctcacagttttgagggccaggagtctgaaatcaaaatgtcaggaggatcacgttccctccaaaccctgcctgtggaggacccttcttgtctctccacaccttctggaggttgttgggaatctctggtgctccttggctggaagaatcatcagtctcctccatctttacatggcctcttcctcatgtgcctctctgtctatgtgtcaagtttcccctttttataaggacactggtcatgttgaattaggacccactccaattacctcattttaacttgattaattctaaagtgatcttttttttttttttttttttttctctgagacggggtcttgctctgttacccaggctggagtgcagtggcgtgatctcagctcactgcaacctctgactcctgggttaaagcgattctcctgtcttagcctcttgagtagctgggaatacaggcgccagcatgcctggctaatttttgtattattagtagagacaggatttcaccatgttggccaggctggtctcaaactcctgaactcaagtaatccacgcatctcagcctcccaaagtgctgggcttaaaagtgtgagccaccacacccaccctgaaatgatctgtttctaaataaggtcacattctgagttattgggatttaggaatttgatgtgtgcgtttttttggaggggggcacaacttaacccataacaggaaacaagaagcaaatatgtatttgaacctggtctttcaacttcaaaacctacattttactctgctgcccatgtgttgcctttgtaatcaaaactaaaacctttccatttaacatttgaaattgttacctgcctgttcacatggctatctttcctccccaggctctaagctattttagggcagacatatcatcatatttctgatgttacccccaccttaatagataagtgtctaggacacaattccttagtaaatcttcatcatgctgaagagaaatgactctgtaaaaggaatgtggatggttatagtggtttaaatattgagactacatattataattcagtagttgaatgtttttcatacttgatgccaaagaaatgagataaaactaataaattttgggatctggaatatactggattccttgttgtatgtcactaacaaaccttagaggtgtaaacataggtgtgcctttttttataactttaatagggatggaattttaaaagcttggggaatttggaattctgagcatcctcatttagtttttcacagtgaaagagtgttactaattaattgcagaaacatcctaaaatgtagacacgtaggaacagaactcaaattggcttgagttggctataactctgtaattctgagacaggaaggtataatatgataaataaaaaggaaagagtagataaagggtgatttctaaggcaaaggataatcatgtcgattcaacaatttatctgtttattcatttgtctattgatgcattcattttcattccatccatccaaataatgctatacattgtcaatatgctaacaacaatggaaaggcctggtaagactgttctggttctgtggcttcctttggagtcctctcaaatggtggcaattgtttttgcttcatgctaatgtctactgtagactagctctggtggcacagaaaccatacattctcagtgttgcttcctaaacaatgtccctttccttacttaagtataaccagtgaagctgggtactgcgatgcatgtctgtagtcccagctactggggaggctgaggctggaggatcccttgaactcaggagttggaggccagcctaggcaacataggtagactttgtttctaaaaaacaaagcaaaacaaatgccattcttatctcatttctccatcacagaacatttcagcacctttttctctctttcagagctcctgttttccttcctggacactgacacgtctacatggatcttccattccttctttgcatggaatgatcttgcatgcagccatccactcttaaggcctgactgtaaatcttgctcttactaaactatatgaactgtaccacttgtacagcctcaaatccagagatcccacatctccccataaccagatccaccacttgaacactccctgtttgccacactgcccacagcatggcccaaccttgctcctttctctcaagggccaacttccctgtgtgttactgcaattgtaataatgaatgtagttccagtatctaaaaaacttgcttcaggaatacataagtctggaataatatatacccactgacatcaagtaagtttggttttggtaggagaacttgataggttaaaaaaaatcataggacagtatattaactattgttaagtaaaagcgggaagcacaagggagagatgcttaacccaagcttcaagattagatttagagaaggttcaaaaacgaaacctcctctctaagggtctcagggagactttctggaaaaatgatttctagactgaatcgtcaaagacaattttctattcatttctaaacaaatatagcaattttgatcattatgcaaataattttcatcatagacataatacttaaaattttatgtataacacacaagactctgttccttaacagtattttctcaccaagctataagcttttctaaaaaaaaaataattaataattaaatctctgaagtgcatatattcttcctaaatcaatgcaacattgtctttgttaactttgttgttgttatttccttttaatagtacgtttgctgtttgaacactcggtctaacttcagttcattcaaaaacagttcattttgaaaggaacaataaggaacaaacgaaatacacacatgatatggattggctgtatccccaccaaatctcaacttgaattctatctaccagaatacccacatattgtgggagggacccagggggaggtaattgaatcatgggggctgatctttcccatgctattcttctgatagcgaataagtctcacaagatctgatgggtttatcaggggtttccgcttttgtttcttcctcattttctcttgccacctccatgttagaagtgcctctttcctcccgccatgattctgaggcctcccagccatgtagaactgtaagatcaattcaacctatttttcttccctgccttgggtatgtctttttcagcagcatgaaaacagactaatacaacacacaatttttttttttctagcatttgcagctaacaaaagcagtttcctctcctcagtcaaaactttgaaataataaacttgtgatgctgattgaatgaaataataaagtgtgtaatttctaataacaatagtggtgatatattatcccatgcctttgatttctaatttgagaaatagatatcaatgtattaacttataagatccttaaaataaccctttcaaataagcaggagagatggcactctcatttcacagacctaaagtagtgtgaggtatgttgacctgaccaaggttaaatatccatccccaaatgtaaattcacccctggtcctcttgtaaacgaatgctttgaattgagtttcatctaaattttattacttgtatttttaaaaatatacttgaccagttactctatatctttctattttgcccatttgaaataaaacttatttcccaaaacaatgcaacaaaaaaagaaataaaacacagaaatgaaaatggaatatttaagaccaaaattatgtacttgagacatctgtagcatactataacacaatcagaaaaaaaatgttaaaggatattattaactcctttggaccatcatgttatatcacatgaaaaactgtagtttagcttttcttctacttcagtttaaaaagtaatgggatgactttcataggccagtcactgtgcttgccacaagagctagaaagatgagcctgcttgtcccccaaactcacagaagcttctgatgcagtgagagagacacagattaattaggtaagatttggagaatatggtgggtactaaaattatggctgctcttataataaacatcattgtcatctctaattattttaaaatatatgtgatttatttttatataaattatatataaaatagatataaggttctttagaacatttatcaatattcacaattgcatgtctttaattagatgcaaaaatcacagaaaataaaaagctagaataaatgcttcctcaaacttcccctgtatctctttacaaatcccactccaataaaaagtcaagttagataaataaagcttttgtaaaacggaattatcatagttgtagggatgaatatttacatgcctgagagctctccaatctaatttatgccacactcaccttgctcaaacacaatgatgatttggatttgctatttgaattacgaatactatgctgaattcctagcagtctaaacagctgaaaatggtgttggaggttaggggctggtgcctagatattagctctaacaggtggatgcagctctgtcatataaggtcatggaaatcactgctatcagccaggcatgaaatctgagttattttattagtgatggtggctgatggatgaccacagaataccaaactccagctacaggtgtggctgcttagttacaatgtatctgccaaaagatgcaaggaaaactccacattggttcaagattataaaaaatccactttagatacatttgtttctatattaaatcaactcaataaaaattaactatgctaggaatctagacacctaatttcctctgaaatatttacactcgttgacaataagcattaattagtgccagtgtgggtactggtactcagtttatgtttattgaagcaaaataaagctctaagtaggtggaaaatttttttcaatcacagaaataggttgagtattaaatagaacaaattgtattgtccaagcttatgaaaataaggaagaactacttttacttttgtagaagaaaaaaagaatgacttttttcctagagtcagtgaagatcttcaaaaaaacaataatttcagttgtttctaaatcaaatgttaaaccaattgttagtcttccaagaaagttacgtgtaccagaaaaattataaaatggtttaaaaatgtattaaactctttacttatttctaaagaatccacgtaacatgaactaactctacacaaagacaatgttaggattaagtaaaaagtgttagaacgtgccttccagactaaggtattaaaaaatccaacgtactgtatctgtagggagaacttaaaacttaaaacaataagaatgacaacaaaaagcacaatgattcagataggacaaaatgagattaaataattctaccccatgtgtccaagcaaggagataaactgtatactgtggtggatcatgtggcttcattactgtgtagtcaactagacagacttaaccccagaatagcatggtcaccctggaagaattttttttttttccttaaagatctgttgagaatgcaaggaggaaaatttttgataatcctaaattggagtaaattgtacctaattaagagaagacagagtggaagctcaaatttgagtggaacttctaaattatataaaccatcagtttttttttttacactaagtgcacaatatataaaattacaaaaaaaaatctcattgataagttacgtcaacgaatataaatgtatactgtactttaccacacttctgtccatctcatttaattattttagacatttggttatttgtaggaatgacatgcaaactatttcaccatcagcatggcccaggtgatagccagtcatagcaaccactaaccagctttctttaattccaaacaatggtaacaataattctcacagttcacacagtggatactgtaagccaagtatatttcctagtgtttatcacaataatgctcctacatatgcaaatgatctccaacttagagacaattaaagttacattcaaagagttttttgtaaactgctcaaagtagcataattcataagctgaacccaggtatgcatggatctgacacgcatatgctctgtccatccacctccatggaggtgttcactgtgataactagaaatgaaagtctagggttggttaccgcagaacagatcagtaggtacccaccaatggcttgtccttcccttttatactgtggagttaggactagagggtggcagtctaggtcgggctgacgttctcagcacttattgcctagctggggccatgtagctgagctgtggtcgcagaacaggagtgcaaatgtcaaatacatttccatatctggccatggaccctcctcacgtgatactctactctctctctctcccactctgacactggatttgacttccaggttgaccttaggtactctatgtagcaaatatagagatgggtagaaatggaaagttagtcatagctatagacttaataaacggtgaagtttaaagatatagctattaagaccaatatgaaagcatagctacagatggatatgttccttatttcagaaataaattcaagtgatcatcaatgccttttcttgaagtctgtttacagatataataggctaaataaatatatacatctgtttttgtatgaaaattataaatgaacacagttgattataactatttcctgatgtgctctccatcctaaagaaaacatttattcaaattcaacatcaaaccttatttgtgaaattaaatatcacagattaccaccaatgtttagataagaaattgacaaaattatttcacaaaaataggggaatggcattcttttctactcacagaaagacagagggtgtaaactcatctgctctttatgggaactaaggcgtgaggataaattgttagtaacttcagacgtaagaaatcaatctctcaatcttgacaaacttacatatctaaagaagatattctgactttaaaaggtttgcttatcgccacatttatacagactgttgaggaagctaagaaaaatattaaagtaatgtaaaaatgccttccaaaaaatttccctcttaattagatttttttttttttttttgagatgaagttttgctctcgtcacccaggctggagtgcaacggtgccatctcggctcactgcaacctccgtctcccaggttcaagcgattctcctgcctcagcctcccaagtagctgggattacaggcatgcgccaccacgcctgctaattttgtatttttagtagtgatagggtttctccatgttggtcaggctggtctcgaactcctaacctcagatgatcccccacactttggccgcccaaagtgccgggattacaggcgtgagccaccgcacctggccagattttttttaaaaagcatgagaataagacagggagtagagtgacagcgaagcaaaagtttggaagtccccttggagacagaggtggagctgtaccagggcctctctgaagtgtctgttatcatggcatttgcataacttgcattaggatagttcttcacagcctcagacccacttctacagggatcatctcatctgttcctgaatgttaagttggtaggacaggtgtgatattacagaatagacaaggagggacagagatcataaaggaacttctatggtcatacagatgataaaaggtagtattaagaattgaatactttagtagtaagagttcagtactttcctgccagccttcaacatttacagattacaaagtatggcggatgtctcatttttgcaattatttctccatacccctcatcatgcaatgaggggatcgtgatctccactcacggcattatgacttacagtgcttccctgtagctggagaaaaatatatttgccccattaactttgaccaaatgaaaagtgagtaaacttgatttatccatgtctgagcatgtctgaggttagcgtgcatctttcaccctgggttctgagtcagaagcactgtggagcagggcacagcctggaaccgtctacatagagtgtgaacaagaaggaattccttgtgaagcttatacacaggtgctggaggaacctcctcagagccagcaactgtactctctgaaagcttttatctttaccttccaaatgacatttgctagcaggcattccccaagaagaatgaatatagaaatagataaaggatgtattagcaaagttaccaattgcctttattgagataagagcctcaggaaaatctttctgctcccccagttccctaaggtgaactggcttaatgtaaaaaattaattcccttatttcatgtcttgaggcattgcctttccaccctatgtcattgaaaattgatgttgttgggagttattttagaagagaaaatctcttactaaaaaagaggaagaaaggggccctgcacaaataaggcacttcagaggtccgaagccaaaccaaatagcagataaggaagctgaaacagaagcttctactgccaggagagatccactattaatttgctggtccaagatacggaacacaggaacatgttgttgaaatatttataaggaggacagctgaaaccttatttaatatggccagagctgtccagcacatctcaggtacgcatacaataaaaccgtaaatatattaggaacatattggtcattatagtcattgagacaagatgtaaaactctttaacgtgcctacaagtaaagaaatattctataaaattcaaagaagtttgaaggcgtattttcttatcatgttagggcaagtggcaaatacttcttggcttgaaatgacttaattgtcttaagatcttcattgttgttatctacaaggaagccaccagcatctacagataactactgcagaaaaatctataataagcattgtctaaatgatgccttacaatgactggattttttagaaaggtaagctgactttatcctgtattaataaacaataaaaagaaatcttttattataattatataaataataacgctatcatataatgatatgatctaggttaaaatagattattatgtatgaatgtaactataaaaatagataaaaaagaagatattcagactatttgtaatttagtaaagactgaactatttttaataataaaatattgattctccaactgaaattctaaaaatgaactaaaagtataatttgaattctaaatatctaataagggaataaaaattatatgatgagaatagttttggcttgaattttttatggagacatagctatattaattactttaagaaaatatcagttctaattatgtgcttaaaaatactgactgcacaccaaagcaatagaagaaaattctcttttcttgaaccatgacctgctgcaaatttttcatactcctttaattttttttacatttcaatcaattccttttttgtattcaactctattttattaagaattcaatatatcattttaatttaaactcatatcaaaacattatatattaaacccacttaaaaatgtggtgaacctccattatttggaattttaaaactccattcagaatgtacaggagttagcaagtttgatcctaacaaatgttccataaataataaaggtaagtattaatcctatttaaaagataagcagtgggtaaaataaaaggaaagaaaaccagaacaaatattaagtgacctcatgatttcatttagctagctttgcaaaatagtgcgaaaacatgaaaataaaatgaatataatcacctcattcaaaagtaccttaaaatgacgtgggtttctgtcacattaaaaacagtgattttctttcacttctaaatgttggcttgtatgctaatgaaaaaatattgttagacaatttaggatgattttggtgtaccggagaagttggaatgaaacacaataatttccaatgtttgagaaagcagcacacattttaaatattgaagaatgatttttaattttaatgatttaattttaattttaatgattttaattttataagtattactctgggggatttgggatatgattgtatttgtaaatgatcactaatgtacatctatatacatttctaaattacaaattgacatgttataatctattcactataaaaagaattttatatagaaactggaaagatatgtatcagtttattgacagttgttaacttactcatcaacttagttgttatcatagacagataaacaattttttattctttttctttccacttatgtctgtattccaaatctggttttacagtggtaactctattccaaagtcctcacataatcggaaagttagcaacaagtactctacccctaagccttttaactttgattgactactacctttttcataaatagtacaaataaaggtacaatagatataagacattggtgtctatataacaggaatatgcattaaatggttatatatacaatatatatataatatattattctagtctttactcttgacaaatagcattgtgtgtgtgtgtgtgtgtgtgtgtgtgtgcgcgtgcgtaaagactaggatctccaggaaggaaggatcatcaacaagttcatgaatttgtcccgcttcatttcttctcgtggtcattagcttctgacttgattatgatcaaaatagctatcaataaatgaacgcttttatttttttctaaatctctaatttgtcaacagaatacctagcttaaaaatgttaaaaagtgaaactaaagttaaatctctgcaaatgaaatggaatcagaacatcaccaatctgtttatcctctttccaaactatgtctcctacttgggaatgatgatgatacatgggcttaatggtaacatttatgcacaaaatattgtttgcagttaattttgtaaaatttgaatatagatctacttcttcctcaatatttagttgtacctccttttttcagccaaggatctgtcagtatagtactctgatagcaaaaggtaattattgaagatttactttgactctgacggtgttcggggttcagaatcatgcttgcgcatgtcagattctttgccagagatgtaatttgttcttgtgggtctatgccagatacgagtaaggcttcctgtggtgctgtccagaacattaaagcaacaacccccatgatatctgtggctggccaccaaagtcctatctaactcctgctaagctaatgtggaacttaaaattaacctgtaccaaagtattttaaaaatcactgaaattagtattatgtcaccgtgttcacaattctcaaaaaagacagaacaacttcaaatataacttgaaattaagacagcaaccatggacacgttaactttacaaataaggcaaatactaacgttagaccgatgaagtttacctttaagaaaaaaagaagaagaagaagaagaagaaattttcacagggtgggttctcttgaagcaatgaacccaaaatgaattatctatgagcaaagagaggttgagtcctgtaaacctaattttatagataaagaattggaggaccactctgaacatagaatgagactataatggtccccagaattatcctgattatgatgattcatcttacctttatgcccgactgccaatttacctaattgaccaggaaacagagttaacagaaaaattacaattacgcaaatgataattatcttttctctaaagactttgggaggcaaaatcatgaatagtcaataaaatctaaccatgacctttcctagtatcttccttttttaaaattatcttccttataatgctttaacatatacttatacttctgtcccttgtagaatgcataaaaagaatggttgtctcatatccacgatctgtgacttgtaaatctgggaatcaatttacgctgccattgcaagctcaccggtccaatgctctcaaacactggcaggtgaaacttgatggtggacaagggttcgtgttctaattgccgtgtcaaattccagccaaatgaggctggagtagagacatttggaatgttcccgagatcaatgctgggagatggaaacatttttatgacgaggatgtgtctaagctagaccagagcagagccaatggacaaagccaggccttatgaaatatggagcccagacaccaagctgacaggaatggttggagtctatttctattttggaagcctgagaaggatgcggtggtgggaggctatatctcacgttcaaaattgatcgagctgaaatgacttgcaggattaattcacactaatactgagcttctaaaccgcaggacacataactgtcactgggcactgcactccactcagcacgccttgcaggtctaagagttggaaggagaaaatatgcttcagttagaaataaaacctaataaattaacctaagacaagggactgtgacttagagtctgtttataaatgatttctttgtggactgggaagaaaacagtcaaggaaacagggagagaaaaaaaaaaaagagttctttctgtgccagaggtgaggcttcttgcttgttcctggctccctgggctcacagtgctgctagtggctgttcttcctgctgtgattacaacatcatccgatgccaagccctttaccactcttggttctgtgtgtggctgaagacaacagcggccaatggcagcagggctgtcagctgctgaaacacagcactgttctctcaaggaccaggtaatgagggagaaccacttgaaattagcaaaacggagacaaatatgggcttaagattgcagtcaaccatgatgtgttctattcacttggatgacttctgtacataatattgtattattgatctatcctccagtttgataaagacctttttctaataaagaccttttatgaagggatagtaaattttcaaattgacataaaggggagtatcatttctccccaaatagaaaactaattttataaatccagaaataatatgacattttaattaaagtgaaatcacaaaaataactcaaaccgtgaactttctccccattatatcagtatagctttatttcattgtacatgagtagatataattcatccttttcttttggaaattgctaagatgcaagttaaattttttcatgtggcaccatatttcaggaaatccagtggtaaagtttgaaaatcgatcatttgctcttcaaccatattatttttattcattcatatgtttattcatttactcaagtaatatttattgtgtttggagcacttttttttacctgggaaagacagttaattttaaagcacgatccttgtactcaaggaactaattgatagtgtcggcaggagtgggagaggtagacaatgggcaaataaacaggtaattataagataattctgctagtgataagtagaaaatatggaaaaaataaataacaaaaaaaaatgcatttgaacgtatcagaatgttaagggttagggagtgcgggggacgggctattgattctgagacaggaataatacggagtagttgctggagaatagaaaattgcaggcaacaacttcacgtgactaagcaaaaggaaactgttgaaacagttgtgaagctagggcctgatacgacccagaaaacccagggtgtgtgccaagctggctaagacaaactggattcaacatggtgctgaatttgacctaggtttcaacaaggacctcattaaatgctcattagcatcctaaactccatgtccgccaacatcatgagagttctggcgccagccattttttggtgtaaaaatggatggcactacacttccaaaaaatttccaccttttttccagcaatcttcgtgagtattccaccccttggttaaagaaaacagtaaacgtagcagcctcaaaccgcttgagagtgactctctcttgagtaaatcctcactccctttcttgagtgtgtacttttccctttgcaataaatctctgtactttcactattttctgaatcttcctcactattttctgactcttccttgaattccttcttactgtggtgtcaagagcttggacactggctagtgttgaggtctcactgacatctggcgactttccccagcccacctgtatcaatgttattatatacagtggtcagagaaggcatcagggataatgtgagggtgtgtccttgcccagaaaagggtgttccaggtgaaggccctgggaggagatggtgcttggtgtattcgaaaccaacaacaaggtgaccagtgtccctggtgtgaagacaggaagagggaggcattagaggggaccctaggagtcttttcagggcaaagtaaagagtttgacttctactccaaaggggtggaaatccatggaagcattttgagctggagatttatgacttgatttcagtggtaaaagtctgcaccgtgggctaaggaggcccaagggcaaagtggggagatgggtgaggaggcaactaccctgacccaggtagccacggtggtggctgaccggaacatggtggagtggcagagggctcgacaaaaggatgctttctcaatctatcttgaaagtggacttgacatgatttgccagtggattgaacgtggaggaggagagacagagtgtcaagaaactgatgtattatttggagtgtttaaatgtggaatctccataagagacgccagtactgtcattaacaattattctgctccatcgtcaagataagggatgcgatggcaaagttatactacaaatgcgtcattttcgctagcaatgcccgccatacatttttaatcaccgtttattaagcaatgtcctaaagtcctctttgtgggattatgaaaattatccttcaggcatttcagaagtgaagtctgtgacgatgtgttttcttttatgagttcatatgttcaggaggctggaaaatacctagctgaatgtgtgatacacatgataagcatgctaaggcatatgggcagaagaagagattgctttctatagaacagggaactagaaaacatttgtttgttcttttaaaattaacatttaaaaatggatccaaagttaagccctgtaaaccttgtttgattaactctggaacacaatgttatactttttcctgctgaggtgctcaaaggaatgtggcatacttgaatgtagaaaaaaaaaaaaaaaacatgaaatctgaggagttgggctgaaacttgaaatcctccactttcaggttactgagttttagttttctcatcctcaagatgaaatactcgccagatgcgctggctcatgcatgtaatcccagcactttgggaggctgaggtgggcagactgcttcaactctggtgttccagaccagcctggacaagatggtgaaaccctgtatctacaaaaaaatgaaaaacttagctgggcatgctggtgtgtgcctttggtcccagctactcaggaggctgaggtgggaggattgctggagcctgggaggcagaggttgtagtgagccgagactgcgtgactgcactccagcctgggtgacagggtgagaccctgtctcagaaaaacaaaagagatgaaagctgatgatctaaagcctcattcctagctggggtattttgttatgttaattaattgattaatatatgaattcaataactcactaattagctattaaacaacactatgctttctttattgtactaaacactttatgtacaaaagtgagcagaataaacagccactgccatcacagagtatgatcttattagcaaaatggcatatttttgacatcccattcttaataggccagtgacttccaaagattttacgctgcagattgtacaggaaacattgccaattttagagcaatttaaacaagaaaacagaaaaaagtcaaagaagaaagaagcagggatgaagtactgaaacaggaacaaacaaacaaatccagattatggtgagaatatacgataaaaccaagcatcaaatgccctgagctttctgatagctctggtaaaaatttaagagagatgggatgcaggatattttcaaaaagaaggatcccctttacaaggaaattatcaggtaagtattcctatgctggctattaaactacctaattggtaattccttcaatagcttactaaacctatgggaatgaccattgctttgtgtcagggttcaggaaaaaaaaaaaacaattagatatcatttcatccaaattcttgctataaggatgctcccctacctctatttctctccttttcagggaaagggtgtcatttaaagactaataggttatgaacaccttttcttcccctgctttcttctacttcatttaaaactaggatgtaaacaagacttggggatacagatgcaagaaagagagactaaatccttcatagagatcaagtgggaagttcgtgaaactgactattggatccatgaaattgagcaatatccctctagtattaaattcaacatatcaagcactattgtaagcatgtgagtcacatcaatcatttaatctttctaatgacaccatgcagaaagtttcaaatatatgttctttttatggttaaggatttatttccaaaggggtcaggtgtcttcttcagggacaggctccagaacccaagctgagactccataaacaccactctttctatgatgccacctttataaagaataccccaggaggtatcatgtttgccgttttgtcatacatatccttcctccctgctttggtaaatatctgatggctgagttacatgtcagtacacttagaaatacctgattataaatagttgatttaattcatcccatgaattagtttgttattctttcaaaaagtaggttttatggttgtaacagctttgcaaatggttcttcatgactacactgccaattatatgttacttaatctaataacatggttgatattgcctttcacaagagttcaggatggcatgcatgcctgtgagtataaacaactgcatgtgtggcgaaaaccttatacgatttcgtttttgaatcattttaatgacatttaattgtccatgaggagttataatgacataactatgttggaaatcacattcgataaaattgtagttttaaaacttagtatctgcatcctttccttggaaaatagcagccctttttcccttagaaatgtaactaccatttttttttctttttggtctatttacaaaaacttaagaaaagtgaaagaagaccatagagaattgcctactgcactcttctccacagagataatggctgttactgtttagtaatatgttcttctagacctctctatatgggtttatagatacatctgggcgagtgtatacacagtttttaaatataaaggaaatcttacaatgggtactattcgtcaatttactcttcacttaatcctgtgttgtgaaaaccttttcataccaataaatatgaaagtttgtattattccctctttgaagactacacaaagctcacttcatggttatccgatgctgggtctaactcagctccccactggctatctggttagttcttgattgtttaatgttttaaactccactgccataaacatttctcagtgtgtaccatttcctgattgtatagttttcttcaaattgcctagatataaaacttgtggataaaactatcgcaatttattaagacccgtatatgtattgccaaattgccttcccagaagtgtttacacttcccctcacctcaccagaagatgaaactctctttctctttaacctcctataaatgtaagtcattttgttaagagaaaaagtgtgtcttgtgttcatttactgtgtgttttcatcatgactaaagatgttgtattttcaatattatttataattatatattctcatttgtgagtcatctattcaaaatgtagcaaaattactcagtgttcctctcctgctttgtacacatatgcgaatttaacctcagcttaaaatggtaattcctcaccagggtttgaagtgcctgccaccttcataatgcatcttaaaggtcagctggcaatcagtgacaaattctacattcctgaatagttacttgtgaattcaggatttcatttagcttaatttgtgtgtttttttcctcctaagtgctcaggtctgaaatagtcaaattttaaccatctaattggaatgaaaagaaagccatggttcccggcgtgtccctaggaggtgaggatagaagagtgctgggaagaggaggcacagactcttttcatgaaggaatgcatctcacactaggagcagagacctgatcggagacggtcggtggcttgaacgctgagtgctaaaaaaaactggctgcaggcacactgccttcatcacctttgttttcaacacttccgtttccagcacatgtgataaaaataaatgaagagatcccaaagctaaaacttcaaaaataccttgtttccttttttgaagttccccactttacttaggagcactttcagaattgaaaaaaaacaagaggaatggttttccaatcgtacaagtctacactggaattccaaatgattgttttcttcaggaaaataatagggaagatgccacctacctgtgtccttctcaagaactctgaggtcacatggagatgaccacaacaggcaaattgtggcctccaatatttggtgcattttaagctttctccacaccgaggaactggaggaacagtggaatgaatgtgtgcctggacctgagccatgaaccagaaaccatgaggacaagggtaaggccactcaggggacccatcagccttctccatctactcaactgccacccaaacctcacgccacatccctgccactctcagggtatggaggctggtgggtgtgtttgtgtgtgcaaatgtgtgtgtacctgcaaatctatgcacactcaacaaacagcaccagtaacaccagcctctgtctcttcctggctttgacagaatttaagagaggctaaacaagagcacaaacctgagtgaatcagagcatactagaatactttcttatgctttcctgaacatgataggcagagattttatgtactaattatgggaagagctgatgctgtgacacagggactagagatataacagtccctgcaaaactgatctcataacattagattcccaggaaaattcagtgtaagggggctagaggaacttgttttgcatttggtggctggttttccctcactttcctaggcttgtcttatagctgaatgcacacacacacaggtacacaattctaaacacgagctgattgctcttcccataagagaacaagaacaattctaattcatttaaataatgtccagttggtaagagagaaaacaatttgttgagtgtgtacaaattgttgtttgtatttaaatgacagagtgatgagccaaggcacgccatccatgctccgagtgcccattgcactagagtagacaccaccgcaggtggccatgtctacagggttgtcattctcacctccacactggcacacagagaaatcctaaagagaaattagagcttaggcaagctcatgctactcatgaactaggttagttgcctccagaaccaagtttgctgcacctgttcaccatggcctggaagagcatacttacactactagtgtggcaggctctcatcagagaccgcaactgtaagcccagcactttcacacacaatgactacagttaagtgatggctgagcaggtgcttggacttttttcaccctctttttgctaagtgacttgagcgaggtttgcctgacaacccttaatgaattatatgcaaaaaatgtcaattttccatcaaatggcagtagtaaatcattcagaagtgaaaaaaatagaagactgaattctaatttggatctttaacaaactctttctctcactgctaacatcaagaccacccagggactgggattcacatgggaaatggttcaatgatggtgttatttttgaaagcagaaggctgtctaatgccaaaaaaaaaaaaaaaagaaaacgttcctcaatcactccatcttctgtacttgaaatttagtagagatagagaagttttcttttgtattgtgaatttttattgttaggaatcttcatggaaaataaagattttacatgtcctaataaaaattttaggacaaacaccctgaaataccacatgcaaaattatgataagcaatatagagccaagatttgacagtttactggcaagccaatgtgagaacggacagagatgcaataaaaacaatgaacttttaagttctgataataataataataatagttatgcatgaaagacattgtttagaaaacaaagggcattgggggccagcaaagcaaactgcatattgaggagatggacccaagactagttcaggctacacatttgtgtttcacacctaaacggactggacacaaaggccaaaactctgtagaaaatcctgtcttgaaggtagcactcccaccattacctccatggcttgtctagtgatgatgaggttgacagaaaacagtccagatattaaggtcagaaaatccagcacctaaataagcctctaacctttgctttttatttgggccttagtaaattatgtcacctctaaactgatctctttatttttaagattcatatactaataagaattatgtaacatagcacaagcggaagtatctagaacttagaaacctagaacatagaacacaggaacaaccagaggaaagtccgctgagtatgaccacacacacacgtacacgtacacacacatacaaacgtgcgcacacacacaaacgcacacacactggatgcacgaatgcacaccattcatggaacgaacacttccttaaaatattcaattacagtggaaagactgtcacctgagataataatttagactacaatatgtctgtagaatttaaaatgcatatattcttaaaagataatcagacattatttttttaaaaatgaataatatgaaaacctaaagatataaagtattattaatattttctctagagtaaaaaattgttcaccaatctcagataattttcaaatatgttatgaattttctatgatttgtctgaaaaacagtcgtatttgtagtacaaagtaattttccctgaaatcagaattggtggacgctaatgacttcacagttattttcagatgagaaaggcttcctatttgtctcagatctacaaactgatataatctattagtacctctgtaactgcatgacacaaaataagtggggcacaagaagaggaaaaagcaactacccatttcaaatctattatcgcccttacactctccatgcaaagagaaacagaaggaaatacgtgtgtgtacccatgtgaacacaacacacctgcatagaacgtggagagcttaaggcactatgaaataatctcttcacattgggtttacgcagtatcttcccccaaacccagaaaactctcagacacccataatatacagcaatggtgtttcttcttatcttaacatatggagaaattgtgaaagaatagctcactgacttgtaaaaagtacaaccgttatttagaaatgcagaccaatttcctcattgattaggtcaaagtaatttaattgcttacaaatgtccaaattctaattttaaagtaggaaaaatattgcatatttagcaaatgtgtgagggccaataggttttcatactatgaggataaacacttcattcaaagcaaaagaggcgctatagccaaaagtcattcttaaataataaatatatttttttgtgagtgtaaggtgttatttccttataccatcttgtgcacataaactgttctgttaattttttgaaactgcctgttaggatccccaaatataaaaataaaatggaactacatttcaattaatactacttcaatacttaacacatgactatttccatcttattcctgataatctatcaaaaccttcctttttctgatatattattctttcaaaagcattcttttttcactgttttggatgaattcatagcccataactatttgtttgtacagtgcccctttcaaaacttagattaagaatctagccagaatctttttcaaattcttctgtaaaaaaccacatcaccttttcggttagataattctcaaagcaattttcggatgaaataaacttagttctacccaatagtctggagtgttcttatttcatagtgcaacttgcctaagcccaaactatttagacatcttcctataacatactccctttgttgtgataaaaataaatgaacagatcccatagctaaaacttcaaaaatacctagttttcttttttgaagttccgcactttacttaggagcactttgagaattgaaaaaaacaagaggaatggtttaccaattgtacaagtctacactggaattccaaatgaatgttttcttcaggaaaataatagggaagatgccacctacctgagtccttctcaagaactctgaggtcacatggagatgaccacaacaggcaaatcgtggcctccaatatttggtgcattttaagaacactggctatttagtctgtaagagtaaaactaactatttaaagctggttataaattatatctcctgctcactctctctaaatcacaccaaatacaaagactttctcattctctcatgccagcaatacatcagttataatactcagtaaactttggttaaatacaaaacactatagaataagatacaggatctagcaactactgacagctgacattggacatgccaacgcttgagaaagagccaacagtaaactgactttaaaagcatcttgactcatttgtcacttatccaatggtgatgatcatcattgtgtatgttttccagggatattggcataaatgcatggctacccttccttatttgtagaatccagaggaaaaaactaaagacaagaaactcattttggtcttctgggcttattcattggtttttgctgtttaatttttaaaattatagtttgttttactcttgcattggatattaataatataacagacctactaattctgattgtattgtcttttatttattccaagcagatttcttttttttacctaatagattccttaatattccataagtgatttctaacatgtttctaaaattttattaattgatgatagtttaatcttatttttataaataatagatgttaagactctatattttttcaaaatgtttttgaaacatgttttaaaattcttatgccaactaagacaagatgtatttctattatcactatctgctcttatgccactttgatttaatcaaattagtttttgcaactttatacaaatagtgaataaagaaaatataaataaaatctttaagagcgattacttgcttcaccttcttttgttggataatgtctataaactgatacagatataaccaaaaatattcaagtttaaattagaaaacggaatgtaaacagagctgattacaacctcatctaacactggactccaataaccctgtcattccatattttaaatatgcaaggtagtaggactgatattttggtaaggcaaatgccttgccagaaacagaaaggtaaacattctggtaaatcacctgtcaactagacaatgctatgaggtttctgtctggatttggcttctgattccatcatggtggcgctctccttatcgatcctgagcaatattttagaagcacctggttataaagtaagctcactggaaatactcttcccagatctccatgtggctgaagtctcattgtttaggtttcagatcaaagccctcagtgaatctgttcttcatcactccacttattacctaccccaacaccttgtttaatttcctatttggcattcctcattattagaaagtgagttatttgcttgctcatatgttaaattttttatctccctcctccatgagtatattcattggaagagaccaagaacactcacccttcttgctctcattttaccccagaacctggaccaatgcctgggacccagttcctatgcaataacacttgttaattaactttttaagatgcaatatttctttttaaaatatttatgatttggagctgcctatttggataagatttctcttggccagttttactttagagatcacttagaatatgcactatggtgacaggtcactaccacatcatgctgaattttttggtacaatctgccgaggtgccaaatgtcacatgaaaggtttctgtccttcaagaaaacaaaaccagaacccaaacctagggaccacccataagatgtgcatgtgaccaacaatttcccccatctggaaagactcatcctacccaactcaagcccagacctcataaatgtgcttcaatggcgcctcttttgtaatattgctaagctcagccatgtccctcataagcaggaaatccaggaagcccagctttgcttgacgaacacacttttgcaggatgtctgcaatggaacagtttactttgcagaaatatttctgagatttgaacagaagagcaaaggtgggcaggactcacggagtgctgttagggacctaaggcctattttatattcttggtgggaaaccaagaacaaagctcagagaataagtttttctctagctctgtgtacatatttatttcttgattcttcttatcgcctacatagccttctcctggatccaacaaatgaaggcttttgatgtttttctgagcttcagatctgaaatgaatgccttgggaaaccgttaaattattgactggatttcaatcaaacatcactctagctaaaatattagatccaaaacgtgatgcatggaccttctggttgttttcaacactgagtaaaaatgttgccacctttcagaatcttgaggaagccccaaaacatttctgacttcactgttcagagaaaacattacaggatcttccatcttaccttacttttaatgtgtggtatatgaaatacaagagtacacgtaatagaatagacagagtgggctctagccataaactcttcacaaaagaaaccacaataacaaatccatattttatttctagtaaacataacagaagcttcagtaataccagaaggagattaaaatactgcaattctatttcaaaaataatttacctatttacttctctgctcaagcattttttcccggtacgaaagccaaacaaatattaaataataaatatcctggttgaatttctctagtcttttgccctagatttaactcatgagaaagaaatgaacgtttatcacttacttttaagggtggtgggcagaatgtctacattttttcccaccaccaccaccccaaatagtttttgaaagactaattacatgttgttatgtttaaatgctgttaaataaatgcatgtaacaaaattaaagcaatatagccttctccaaataaacataattttaattaacaaagggaatgtcaatatttagcatcaagactgatgtccagttttgagtgaggatttcttttcatgaaataattaatttagtccttcaactagcggtcgtcgttgtgacagtagctagtgtagtagaagtagcaagaagaaaagcccattggactaggtaactgcaaaatgtcactaactctgagtccaaacgttttgctaagctctaatgcatcttgcattagtgttttgatgatttgctcaccagatacatccagttatattttccactctatccgtctgtgcactctgtactctagccacatgggacgtcatatttttattgaagtgccaaagatatgtcactaaaaaagacttttgaagctattgttgacctgatttaatagtatgtgttctttgttttctgaagaggaagaacttggaaaaccaggcatgtcctcacaattttggtattcatatcacatagcacatatcagttgaaataatatgttttgtttggaattaaataattccatgataaaatgaagtcattttaggacaattacagcataaatattagtactgggccaatcacaacaaaatatcaaatattaataatacatttatatttatatgctgaagaattagcatagtgttacatgaggcataattacaaatatgttcttaagcattgattttatatatgcattttataaaattagaatagtatggtgaatgaaatatttattaacacaataaatactgctataatactcacattaattaattattatcagttataggagtatacatttttccctttttaagagtaggactataaagatatgtctccattgtgtttggtgttcagaaagtagaaatttaaggtaatatggagaattatttgaaaaatcaaatagtaaataaaactaaataacaattgctctatctaaaagtctgttctcctgtaagaaatatacatgtgtatacatatgtattacacacacatatatatgtatacacataaaagctactaacatagacatcaatatttccattttaaatataaggaatttgagtttgagaaacttaaataatttgaccagagtctaaaatttgctaaataatcatagataacgctttcttctacttttatagctgaactataaaaaagttaccccaagatgataaaagacaaggaaaacatgtttcaagaaatctaaagaataaaaattgcacagagtatattttttaactgcagtagaattaaacgagaatctatagaaataagactgcttgaaaagcccaaatatatgaaatcatacaacatgcttcttaaaatgcataggacgaagataaaatcataagagaagttagaaaatattttaaactaaattactagtaaatcactataaaatgtttggcaaataaattattatatggagggaaacatagcattaactacttatttataaaaaagagagagccaaattagtgactttatattccacttaacttataagaaaaaggagactaaacccaaaataaatagaagagtgaaaataagagaaaaattgagtaaagtaaaaaaaaataggcaactggcaaataataaattaaaatgtggtctttaaaaaaatcaagaaaattggcaaactcttggctagaaagattttaaaagggaattaatacaaatcagcaatatcaaaaatgaaaaatccatttttatcatatattcgtcagacctgaagtggacttagaataataacagcagctgagtatttcttatctgaaattcttaggaccagacgtatttcagatttgggatttcttttttcgaattttggaatatatgcagacctataaataatgagaaatcctggggatgagacccaacactaaatacaaaattcatttaatttcatgtacatcttatatacataacctgaagacaattttaaacaatattttaaagtatatatgcaactcatcaaagaaggtcaggtgtggaattttccacttatgatgtcatgttggcacgaaacaattttggattttggaacatttgggatttggaattttataattagagatgctcaacctgcattaataactgtacctacacatttaaaaagcagagatcaagtggatatcttgaaaaacataattcaccaaaattgacaccagaagaaagagacaatctatacagccctaaatctagaatatacattgaattttttatttaagatttctaaaagaaaactccaggagcagatttttctgtcttaaattttatctagaaatcacatcaaaattacacagttttagaaacagaggagaaaacagttctgctcatttttttaataatttaccgtctcctgtacagtgaaatcttaaaaaggctacaaaaaagggaattacagacaaaagcccctcatgtatacagacacaaatattttaaatgaactactgtaagtcaaacccaataatatatttgaaaaatctagtgtaccttacgaccaagtaggctgtactctggaatgagaagttggattaaaatttcacaaaactaattcaatgtaattgaacatataaacagaaaaaaaggcaaaaatactaccattttaattgatgccaaaatcatatgaaaaaattacatacttattcataataaaaccctcagcaaactactaatgataggaaactttctcaagcagataaagaacatttgtgaaaaatctacaagcaacatattagtgcagttctaggcaggagacaaaatctctcatcagggaaattcagtatgaagaacgattaatttatagaagattaaacgcaaagaggggtaaagagaattaaaaaaaaaaaaaaagaatggcagacatattgacctgacattacctggaggctcaggcagagtactcaaagaagaaaaaggcaaaagaggatacttgcctggctgagattcagagctggctgaggagggaggatttagtggcccaccgggcagcaaaaatgcatgctgaggctcaacactccacacagtccagcacgagtgccagctaatgtctgtgggaccttctggcgagctacccgatggggtgacagcaaaactatggagatgattgtcactggataccctgcacaatgctgactggcacataatcagaagcagaaattagtaagaatgtctcttcctcctgctgtgtccatgcagcaccctctactgagaaagcttaacatagtggcagctggcaaacgcgacatgtgtacaaggtttggtttcggaattacaaagcagaggaaagaagagcaggtttggaaatgaagggcaatatgctaataactggtacaaaagacattgtggatgatgatgacagaattcattacatcccacctgtgcctgtgttcctcacttttaccacttccgtgcaacattgtactgaaggagctgggcatttcaatacagcacccaaaagaagaaggcacaaaagggaaagttgagctgcctctctttgcagatgacatggttgcctccataaaaatttctcatggaatctttaaaacaactactaaaattaattgaatttaggaaggtcacggaatacagattaatattttaaaaatcagttaaattcaaagttttttatatgtcacatgaaatcaggaaacacaaaagaaaaaacataaattagacttttttaagactaaaaaatgttgttaaatatataccattaaaaggataaatgttggtggaaggaattacctataatacatatttcagtcaaagaactcgaatctggaatatttagaaagctctgataactcaaagggaagacaaaagttgcagtgaagatgcgcaaaatattttaacagatacttcaccaaggaagatatctgaatgatcaataagcacataaaatactaatattattggtcatcagggaaatgcaaattcacatcaccgtaaaataacactctacactcattacaatgacgaaaactaaaaaggctgagtacactaaatatagcaaaaacatacaacaactaaaattcatccctcaggtgggaatttaaaatgggactaccagattagaaaacattttagccacttcttcaaaagtttaacataaaacatactacccacccattccactcttgaatgtttgaccacagtaattaaactattttccccacaaagacttttatgcaaataatcaaaggagctttatttctaatagctaaaaacaggggggtgaggggggaacaaatgtctattagagtgataaactaaatgtggcatagctgtatattggaattctgcttaaccataaaaaatgtaccatttttatatgaagaaatgtggatggacctcaaaatcattattctgagtgaaagaagttaggcatatacagatgtgtgtgtgtatatatatatttcatataatttggcatatataatatttcaaaaaagcaaactaattcatagtgacagaaaacagttcagtggtgtgctggcaacaaaacttagaacacaggatggatgaccggggtcacaagaaaagttttgtgggtgatagaaatattcgttagcttgatggtggtggtgttccacggttgtatataaatctcatccaatttaaaattttcaatatctgcactttattggttactaaatatacctttaaatgtgaataattgtaactaaaggactcattcatcaagctagtattcaaaatgactatctctagctcttgcgtaaagaaatctattatgtatccaaggtaaactgggctctctgtataccaaaattctaatttaggaaaccaaaatagcaggtttgcagtaaaacttggcaaatcaactactgttccaagaatgagatgacctctatttgtctaaagcccctgataacgtgcaagtacacttccggtagatcaaaccataccattgcaacacaagctatagtagggaaagggttagctagtctattgcagaagaattcttcgagctcttgtcaaatctctccattatcaaaagaaagtaaccgaaatctagaaagactcaaccagttttggggtcaacttctttggatgcctttcccaatcctctctggaattaccagcatatggcactgacaaggctgcagttgtcaatcaccttctacatcagaggttgcaagcgctgctacacaggtgcattgcctttggcctgcactggaatttaaaccggaggggatttcacatattgaagattctttgctgctgatgaacaatggaagatccacgacattggacacgcctcacatttttgcctggcaacggtgggtcggtgcccagcagcagctgctctgtttacacgggatataattctcaagctcacaagaatgtatttttctatgatctgacacctgctctgtttcgctgattcacactctctgcctgactcctgagggtattcaagtttgtgaccctagtcaagtccagaaagtgacccacacagacctcagagtccacatcacacccaccttagcctttcaaattacattcgtttccattcggggtggtgggcagagaaggcactggcattcttttttaaaattaaagtgtgctcctggtagagaacagcagttttcataacataactctttgaatggatgagtttatcatcaccttattctttattcagcgtgcttgccgcttataccatagagatcatgagaaaccgggaagaatgacagtcacattttaaaacaaagtgttccttaattggatgggtcaaactagggtgccacagatgacaagagaactatgacatgaccataccagggaaaatacgaggacgggaatctcgtacggggagatacagagacccacaggcaacctcgtctacacagcacgttctcaccttccactgtttaagcacaagtcacctgcttggaacgccagttaattttcctttactggacatagctgaaaagagtgatggaagttgaggatgtcttaaaaagtctcaatagagggtcaagtttcagtgcaaaatgtaaatgatcctttcaacttccccatgtaagaaacatgcactgcattttgaagcagtcgcctctttgagagtgccttattttaatgagtctacatttatgagcacaatcatcgtaaatactctgaatgaatccacctttgtaaagcacatatgttccacttcctccctacctgaaccatctctagtccaaagtaggacttccctgcctcccctggctctcctgtatacacgagcaaatacaaagtcacaacatatcccgtgcatttacattttagaaatatttaatctaaaaaaaaatgtgaaaacccctaaacctaagcaagcaaatataatgattatcgtatccgtaacatattcaagacaggcttggtgtatatatatatttgagaaagagtctggttctgtcgcccaggttggagtgccgtggtatgatctcagctcattccaatctctgcctcccaagttcaagctattctcatacctgagcctcccgagtagcagggactacaggtacacacccccacgcctggctaattgttgtatttttggtagagacggggtttcaccatgttggccaggctggtctcgaactcctgacctctagtgatctgcccgccttggtctcccaaagtgctgggattataggcatgagtcaccatgcttggccaaccttgatatatttttgatgggactatcacggacttgtaagaactgacattacaattggagaaaaactgccatgaaagattcatgtatagaccatgagaaacagagacactatctcctttacaaagctattttaggaagttttcagcaggccaaggttttctttagctcagttttcctcttttggctgagaggacacagcctgcatgaagcaatcccttgtgttatttctgcttcctctctgattctctcaaattgaacatacagcctgttcattgcggggggctgtgccttgaagctgggagccagccacacctttttttttaatgctactgatttctaaaggaaaaagtaacagatattggttataaagtatgtggaaggaagtagtagtccaacaatagtagtaactctgaaccttctgtttgagggtttagtgtgagatgggtgcaacatttgagcttgggaagttgtgctgaaaatcacgttgagagaaagttatctgatcttaaagcggttgtaagaaggagatcaacaagagctagactcagggcatggagccaaggaaatccagtcagggtcaggaccgcagggggcagggtgtgggagggcagggcgccagcttgattctgaggaagagctctgcagtgggcttcactccacctcttgcaaagacgtctccccatcctgacctacccttcagttcaaggatgccccaaagaaaatatatgaaggctttattcacttagatctgaaaacctgaagccctgtgcagagttctgaattctgttctagttaatactccaggttctaagacataagcaagaacgatataagcaagaagaaaatcaagtgaaatacttgccttttcgattctttattatttttagtacattcaaatataaacaaagtgcatcagatttctctgcaaagggatacgtaagtaggtgagtgtatttattgtggtaaagcaagtaattgcttcatactctaagtaatattatattccttttttaaattttgggaattaaaagtgaataactcacatattttgtatatagcattcattccctttgaacttattcagtaaacaactatacatttcaatatttcaactaatattatgcgatgaaaactcacttgtttattctgaatgtttagctactcttagaggttgaaaggataaatcagcaacagactttgctgtccagtcacttgaaatgggcaggatgggggaaagaagaaaaagtaaatcttaaacagaaaaaagtcactcagcttcaaacttgatcatccacataaagctcatttaaaatcctgaaaaatctgggaaactatttatagctctttattgcatattaatatggatggtttcccactaaactatttcaacaaactacttctgtggatttgatacctgaagaaaaaagaatagaagtaaattaacaattttactgattcttgacactttcttttctcagaaggtattaaataaaataactatttcatttccttttgaaagacaatgtaaaataattactaaagtgatttcttcatgaaatttgattatgtctactactgtggaaaactcacttccttcctgacacgatgcccaacatcacctcccattcctggtcactccagctgctccgggatgccccagcctctgctggctgcctctgccccgccaaaaaaataacagttgctcccctcagccagttccagctaacctctttaagcttcggccttgaacagaaaaataatgtaggcagacatatgaatagtataggaatagtacagacaattctagatattgctataaatcaaaggttttcacccttggcatttctgatactgtatggcagacacttctttgtcatgtgagatatcctgtccactgcaggacgatgatcagcatctctagattatacctgtcagattctaagagcaactatctccccactgtgacaattaaaaaaaaatgtctctagatactgccactgttccctgggacaaaaaaatcacccccagtggagaaaggctgatagaagcatatacatacacatatattatataccatatatatacttctgtgtgtgtgtatatatatatatatatgtacacagtatcaaatttcaactgaatgatttttaaaatttttcttgcagttctatgttaacattttcttgtagttctaaaagtgcatcttataaatgaaggaaactaattcttggtctttcatacctcttgtaaatattttaacttaatttgtcatttgccttttgagtattaagttttaggaagtccaatttttcactcatatatatatacttctatgtatgtgtgtgtgtatatatacacacatatatatacacatatatatacacatatatatacatatatatacacatatacacatatatacacatatacatatatatgtatatgtatatatacacacagtatcagtatatacacacacataaaactatacagagagagaaagagacataggataagcataaacacagatgtaattcagtgtaagaatttcaaggacagagaacacacacaggaaaaagaaaatgttaaaaaaaatgctctcctcacacatgccctgccagggacactaaaatggcctactgtttctggatgaaggcagtatttttaccttggttaaaattacactgactcatgggaagccatctaagagccctcaggtgagttagatacccttggaggagcttcccacagcctctactgaaatcactacaacctgttaaaattatatctagatcaggaatctctgagctcccaccatcatctagaaattcgttgatggtgttttattatgagtttttacacgccttttattaaaagagaataaaaccttggaagaaaatggacactctgatactgtgtttattcttaaatgaaacatatatgtgagagatcttctcagatccgcaaataaaatgtcattgtttttaatggtaatttgtattgtagagctaatataatttacttaactagtgagagttattgatagtctacatttatatacttagacatgtttgaattttcaaacattatcaaaatgaaacaaaaagcattcctttacatttattttgtcatatttgaatgcatatttgtagaatacattcttagctagaatttctgaatgaaaagtttgtactttattttgagaaaaatttcaaaatatctatacaaaaatgttgcagcaatttaatatcctaccaatagacatgaaaacatgttttcaatatcctcaaaaacgctgttactaaaatgtgaaggtatgcccattcagaatggcgagctatcatactgcattgttttaacttggttcgaatatacttactggcacaaatgtattgtatttggactccttacgtatattttacctgcttttcaattgaaggattatttaaaattttcttgtagctctagaagtgcatcttacaaattaagagaaacaattctttgtctttcatacttattagaaatattttaacttgtcgtttgccttttgaatgttaagttttaggaagtccaatttttcattcagttttatatgtgatttctaaattacgtgtcctgcctagaaagacacttagacaatatttatcatttttattttccatattaatatttacattggtgatctaacatatttattttgctacaaacagcaaagactagatttactattgtataaaacagtgtcaacattcagattttcatgaccaaatcaagaagatatctttgtctgctaataatagtgtcatgttgcaaactatgtggctgtctgcttgttcttctgttccctttgtgtaaatctgaatgcttttccttaggctttaactttctaagaggaatatcccaggaagctccttctctctagccaaccgcaatatttgaatacttttccacacacctgtatttacaaatgcctaaaatacttctctgcccatattagtatggttttgctgctttttaaaaaaagccaagatatggaagtgaaccatccgtttttagctaccgcaaaacacaccaccacagcatgaggaggtagttgtctgaattcacatgcctgtcaaaacttcctcatagtattgcaaacataattattatctctcttacatgttttcttattttatcacagaatttctaattactagtcattttatcctttttcttaacaaataagcacacagcaaatacacacacacacacacacacacacacacacacacacacactctcacagttgttgtcaactaaggctgcataataatatcacttagggaaggagagaattaggtataaccatgatgagagcccaatctcacccttgaatctctgaattaattggtcttctccttctctctagacaactgcaaatactcaaaaacaaaacaaaacaaaaacgaaaaacaaacaaaaaacaaaaacaaaaatactcaaacttaaccagtaatgattgagcttacctaggggtcactaatttaaagcatatgttgacaagagcaatttgaaagatacattgaggaaaattacattttatttcatcatcctaaaatctgtaggtagaatagtgacaaaatcacctaattatgggaacattataggtttatctgagtggaccaaacacctctgctgtccacctctggtgccctcactaaggtacaataacctgttgaaccaggtttctaagcattgatgggtttctgtgatgtgtcatctgtgctccagttaagaagtcacctctgtgtgacaagctcttccactgctacttccctggaactatccaggccctggttctgggatcctccctcaccctgtgctggtcatatttgctggtcactgtcccagtcctgactgcacggctgccccagtgccatcaataagaagtcaaaacatgtgtggtgttcatatgaggctggtgtccctataaaagctttgacagtggcttcaccctctgattatcaatcttaaccagacatcactcactagccaagctaaaaataaaatgaaggccaggtgcggtggctcacacctgtaatcccagcactttgggaggccgaggcgggtggatcacgaggtcaggagttctagaccagcctggccaatatggtgaaaccctgtctctattaaaaaatacaaaaattagccaggagtggtggcatgtgcctgtagtcccagctacttgggaggctgaggcaggagaatcgctggaacctgggaggcagaggttgcagtgagctgagatcctgccaccacgctccagcctgggagacagggcaagattcagtctcaagacaataaaataaaataaaatgataccttggtttgtttttttttttttttaatcagtccattgatctgtgaatggctcccttaggaccttgtagcaactatggagacagaaaagcagaatttaggcaatgctaggtctctagtctaatatgatcctaatgtaattgagaccctttctttagccctcatatgtctataagttctaaatatcaccagatatattttatgttaggtaggttttgtcatggtgtgtaacctaactatccacaataaaactgtttttaaaaatatttaatgcattcaaaagcattattactgtttaagaaaactggaaaacctattctattttaacaacacttattcatgattttctgattttaatggccctatcacattcacctctaacctcttcattatcagcattgcagaaaattaggggtaatcttgttaaagttagaaagaccgacgaactcgagataaatgccaaagctatttccctaggccttgtattttacaataatcatgaattaatatatcctgattttctatattgagtggtaaaatctcccttcatagattcgcctttattcactttctgactttctaaggagtttctcttagacctttgatataataattttatcacagttggaaatagatgtcaacgtcaattgtttctgatttgggacaagtaaataaaacttcaaatttagaaaacatgtaccaattatcagtcaccacatgggatggttgactcacattcatttaggagagagttacattaagtcacgttgggttccgtgcacagtggcagggatgagttgccctgaatcaggaataatgtaattcaaaattgccccacgaacacttattgacgatgtgaaagtcaacatatcttccagcactttgggaggccgaggtgggcagatcacctgaggtcaggagttctagaccagcctggccaacatggtgaaaccccgtctctactaaaaataaaaaaattagccaggtgtggtggtgcaccctgtaatcccagttactcaggaggctgagacagcagaattgcttaaaccggagaggaggagattgcagtgagccaatatagtaccattgcactccagcctgggtgacaagagcaaaactccatcatgggggtagggggagcagggaaaaactcaagacgttggtaatcacaggagaagacacattcagggcacatttcttagcctcagaggattatgttctattagacatctgaatgtacaaagatatacaagccccgagccccattgcgaggtaacttcagggcaggtgtgagttcaaaggagtacaggcttccaattgcagtaggtggccagtgttacaggagttcatgcacacaaagaaaatgtacgtgggttgttgtttggaatgcctagggaagatttcctgaaataaatataatgtgcactgcgttttgaaagacgcatactattcagaccggtagagggagaggccgggaataagaggacaacattctcttgtaaggtcaggtcaaggagtaacccacagatctgtgcaactgaacaaggatacttttcaggggacaaacgggagggactgaaggacagaatgcagtttggagtccgatcatggactttcttgaatttcagggtcatgggtactagaactgtttatgttgccggagatagaagccagggctaggacagcagcagatgtgtcagtgttcccgagaggggagcctggggcaggaaaggatcgtgcattggtctatgtgaacgctcaggacagcctgtgccaggacaggagccttcgtaggaacatttactattaggatcaaaaacaggctgtggttaatggaaaggtgtttttttatgtgttcgtttgtttctttgtttttttttgatggagtttcagtctgtcccccaggctggagtgcagtggtgcgatctcggctcactgaaagctccgcctccccagttcacaccagtctcctgcctcaccctccctagtagctgggactacaggcgcccaccaccacgcccagctaatttttttttgtatttttagtagagatggggtttcaccgtgttagccaggatggtctcgatctactgacctcgtgatccaactgcctcggcctcccaaagtgctgggattacaggtaagagccgccatgccaggcctacttcctttttcttttgttttgtttgagatgaagtctacctctgtcacccaggctggagtgcagtggcatgatctgcactcactgcaacctccatttcccaggttcaagtgattctcctgcctcagcctcccgagtagctggacttacagatgcctgccaccatgtccagctaattttttttgtacttttagtggagacggggtttcatcatattggccaaggatggtctcaaactcctgacctcaggtgatccacccgccttagcctcccaaattgctgggattacaggcatgagccaccatgcttagcccaagacatgttaaaaaataagcattttgggatttggtgactgcatggttggaccttactggagactgggaagcaagaggaaatgcagagtcaataaagttcagctgtttaaaacagcaaccacctgacaggtcattaaaaaaaaaaaaaacaatgaagagatgctttaattctaaataacacaaagatcagatttttcattttgaattttgagtccaaatttcttccctgtgcttaccaagagaggtctcatttcagctctcaatatccacatcattaaaatttagtttattgatgggtgcccaaatcatatatgtattgttggtgtgtttgtactaaagaaataatccaagatgataatataaaggatatattaattttttaactctaaatgtttttacatatgtaaataatactatatttctgactaaagttccagttacaaggtaagcatcaataattctaaagtatatattctgttttgtcagctggggattaaatctgcctcttaagtttatttcgaaaaaaaatattacagtggttatgtgaaagaaatttattgatactaaaaatgctcaagttgtttaacagaaaaactgttttggtatttcagttaatgcacattttaaacttctaaaaatagcttttgtgcaacaataaaacaacaacacaccaagacagctctaagcaataacttttgtgacatctcagttatcagcagctcctacatcaatcctcccacaaaagaatccgtcctttgaattctagagctgccttaagggttgctacttaattgcgtttgagaaataaacaactgtttcaaggcataatgggaaacgaatagcattagagtgctccctttcccgattaattagaatttgctactatttataactactttccccatcaactcatcctgaatgttgaaagagaaaacacctcctcatgtgttttccctgacaacacacccattccaatttcacatctctatttatttcaccttttgtaatagtagagacctgtaacactcagtagtcattgggcgtttttccgatttgtattacagtactctaaacggttcccaaagaaatcactctgcactcctcgaacgtctcctcaaaatggcattctacgtatgcggataggaggaagaaatataaaatggaatatcaagatgaaagcaacatcctaactctaaggacaataaacaagtagaaatatgacatatttttctctatttcaaacaaaaaattgtcggtaactgagtgattcatatgaacctaagtaggctctttcttatcaacctcccttgcttcctgtactaaacataacccagcaagtaaaagaaaaaaacattctgttgtacatacaactcacaataaagctctctgaggcacaggtatcaatttatttactgttcactcaaactccaaaatgaaatatgtttctaattgttctaacttaatatttccgctgtcgatcctgttataatattgaagatggtaagaatgttgttttatatttattaatataaaatgatcataatagtaccataagaccataagagataatacattattgaaagacatacctgtcagtcaaattaagacaggttttctatatatgaaagaactagagtaaataaaaatattgagagaaagaaaatggaaacatttttaagagagcatatttttaacaagcattttttaatggaaaggtaaagtcataattttaacgtagagtcacacacattggcatttgaataaaatggattgtctaattcttttttctgtaactctgcagtttttattaccattataatacactactataccctagtagcgttgataattgacaacaaaaaaagtaactggcttttaaagagcataaattatttaagaaagcctacatcaaattagcaagtattgtatatgtagatactttgttcaaatactaacacataagaccataaatgtaataaaaggacagaggaaagcttacctgtttcagaaaagagacggccattctactatgtatgaaaggtaaacatgctactaaaaacagataatagatattgtagatgactcagaaaaaaaactaggtgtttgaaagtgggtgaaaaaatgcaaataaaatatatttgaaaatatattaatgaatatattttatatttaacctattagttatgtagcatatattgacatattataaactagatgtacacataaaattgtgttttctgtagagatttttttctcatcccataaaataataaatgaagcatatgattcttgtgtgtattactgttggcattaacatcagtaatctatataagttaattttgttaggaaaatctgatttctttggaagggatattccttcttcctttgccaaattgaaaacaaaaagtagatacagacgtacaggtataattttttcttgttgacaattgaaaaaatataatttaaaaatgataccaggaaatgttttgctttcttcattgtaaaaactatagatcaaaagagaaaacaaattacgaatagattgtaccattattgtctaaaccacaaattctccaaagaatgcaatagccctgaatgttgttccctcacccacctcctatgttcctttcactgaatatattctctgacaacataagggttcattttgttctgattagctgaattgtactcaagaatttatctttgttctttttctctcaaactcacagttgcttaaaaacaatggtgtattataattttatttaaattaccttgacaactctgtttcacagatcttgaacaatatatctataaacaaagtcagtgataactttcaataaaaagttaaatttttaagtatagaaaaagtatgcacaatttgccacaagttgatagacttcaagttttctgtatagtaactgtatttttcttttctggtaatgaggggtgaagccagctggacttcttgcattgagtggggacttggagaacttttctgtcttacaagaggattgtaaaatgcaccaatcagcactctgtaaaacacaccaatcagcgctctgtaaaatgcaccaatcagcgctctataaaacacaccaatcagcaggatcgtaaaagtagccaatcacacggaggactgaaaaaagggcattcctataggacagaaatggaacatgggaggggacaaataagggcacaaaagcagcccaacgggttggtctcccttgctgtgctgtggaaactttattcgctcttagcaataaaccttgctaccactaactctttgtttccctgccatctttaagagctggaaaactcaccccaaaggtctgtggcttcattcttgaagtcagcgaggccacgaacccaccggaaggaaccaactccggacacaataataaaatttaaatattccaactagatttcataatctgtgtattcaaacagtgctaactgtaatataaaaagttgataccttacctcacttttaaattcccttgttgaggctgtccatcgtaaactgataaaatatcaaaatcttcttcaagagcaaaggtatggaaggacaactgtatcctattgcgctcgcccgtgatgatgatccaggtgcagttggcatagttcggatacccgtgaggaaaccctgggctctcaatagtgccattgggaccctggactaagcctccacagttctgacctggaagagaaaacacacacaaaaaagcatattattctggccatctttaatctgtgatttaaaaaatttctaaacactttagccaatttttttttttttttttttttttttttttttttttttgagacggagtctcgctctgtcgcccaggccggactgcggactgcagtggcgcgatctcagctcactgcaagctccgcttcccgggttcacgccattctcctgcctcagcctcccgagtaggtgggactacaggcgcccgccaccgcgcccggctaattttttgtatttttagtagagacggggtttcaccttgttagccaggatggtctcgatctcctgacctcatgatccacccgccccggcctcccaaagtgctgggattacaggcgtgagccaccgcgcccggcctagccaatttttacaacattttataattcttgcacaaatattgaaggataaattaagtgttctgcagtgctgaaagatagaggacaacaacaaattaaaagaaaatatgcaacattttgtaactaatattagaagtttagggaagttctttatcctgtcactttaaaatacagcctcatcaatatcaaatttcagttcatgggggaacaaatttggtgctatctacatagtatcatgcttaaaacactccaccctaaattctttgttggtggaaactaagttacagaagaataaacattataaaactatatacatacacacctagccacataactgcaatatgtggtaataagaatagttagaaaaaaacaaggtcaatacgccagtgattgatcggtgcctgtgctggcaaatgtcttactgggcagaagaataacatatgcataaaggaagcttatcaagttgaaaataaaagacataaaacaaggtaagttaaatgacgctaaaatgaaagagcagctcagcaaaacgaggactgtaacaacatcctcactattgatgtctacccgttcacacaggcaggacttaggaggtggagcagaaaggaaggtgtaccacaaaatgaggggaccaagtaaagaaaaggctcagagttccaaagagcagtaagtaagcagtaagtgaattagcttagtccctaagcaggacagcaggacatctcacgttttactcagccctcccttaagaacttccctttggcaggtggaattgggatcaccctgagggtttaggattgacatgacaatgggaaatgatgagggctgaagggcaattgagtgccacaaagccaccttgaagccactgagcagtgtctgaggaactgatttcattctgcctctgcctctgaagattttgtgttattgattctaacaaagcacttctcaggtgactcccagactgctggagtagtttgaaagaatagaacccttgagtaaattgtaggccccaggcttcctgcaagaaccaagcgctgaaagaacagctctgggagattagtaacagctgcacacctgacccacctattctatttttaccactagacaaactgaaatgcctgccttgtcagcctcaccgatgcatttcatttccgctactcctgatcttcatccacctactttgcagggtgattccctacttgcctgtttcagcccttccccttcccaagttacttcccacatacaagctctccgtgccatgctaatttggtccctgtggttgtcaattttttttttttttttttggtctgttcagttacctgtaacagtctgcctctgatggccatgcctgggccaatccaactgaagcaagaggagccaaagctgaaaacggggcagacagatcgttggaagtgtgctctcataaacacactctgctcatgtaccctgtaaatattactatcctgtaagggaataggataacccactcaaacccttccaacatttcgtttgtctgaggttagctgttaagtagctcgcaaaaactgtctatgtttcttaccttcttaatatgcccatttcccactaatgtgctttaaatgtatttaaatgttttgacactaaaaatattgagaaagttttgaagggacctgggtgtactcagattgtggcatgtagtgtaagtacttgaatacaagtattatctcagctcttattgttaaagtacaaatagaaaattattttcaactacattttatacttaaaaagtattttacaacagtagacctcagtgagctcaaatcattcacagtaatattatcaaatgcttgtgggagttggcaaaatcttaataaaaagatttaatgaaagggatttatgagtttaaaaccagagaactaataaaaagcccattttccactaaatttaagtccaataataacactgtaacaagtaaatattaaagctgtggggttttgaaaggtttttaaagaaaatagcttgtctgctttacgagtaattcttgcttaacagtaaatcaaaaaaagggaagacttgattataaattggaaaaaagaaaaatcagttcaacagaaaaacgtcaactggaaagtagttactgttatagacccatcaggttgaatcagatgaacagatatgaagatttcctcaaggaataacatttaggctgcattcagggtactaatgagtacagtgcatgttgctgaatgagtcacatttgatccattcattgacattccatagcaccggttagaaattttggcaactgctcaaaagttcttagcagaatgaatatcatcgttggctgtccagtgcaaacaaccaagaagtttttaaagtatctatgcctaagatagaatcggatgtatttggtctgcaacttaatactgcatcttattataaagccaccgtgattaaagcagtgtttgattggtgtaagcctaaatagccagtggaacagaatagaaagccataaaatccacaaagatatagaatctagatttaaagctaatatggtagtcctcttttctcttggatcttatactctaatgggcccttgcctactatagagtatgcacaaatattctatacatgttttctttgtaaacgatgtacatctaagcttaatgtaaatgatgtccttaagtacagcttcaaacaagtggattattttaattgaatattcttaatggacaacttttaaatgctgcaaacataaccatatttcaacatgttgtttaacatgaatcccttgtaagtacctttgtaatttgtatttcttcagggcaataaaataatcggtagtttctgtgataattgtaatgttttagttaaaattaagatgttattttacagggattgaaaccttaattattgctaaaaaaaaaaaaaaaaaagtctaatggtcttcttcctccataaactgacaccggaagtcaccctgaaataaaatatcaatatcaatggcaatatcaatggtaaaaaagaagtatatatatatgtatgtgtatatttttcctagtgatactgaagtttgatttcaatttcaatttcgatttcaatttcatatatatatatatgaacacactctgtgatgtgtattttggtatgcatgcaattacacatataccaaaatacacatctgtaattgcatggataccaaaatacacatcacagagaaacatacatgcaacattgtgcatacagatgtttttgctgctataattcaaacaaacttccaagagaaaacctgaacacatgccataattttaggcaactggaatctaaatcatctgttaccgaaataataatatacgaaacatctggctcctatctaaagtaatcagcagaatgttagatatagaagaatcagagagttagtttttttgcagatttctactccttagataagtccttaataccacaaccttccatacacagagttaacttcagtcatttttaaattctgtcttatactgttggactgaggttctgttttcaaactacattttcacatatactctttgttgaccgtctaagtagccacacatcatgatttttacaaggatggaagaacaagtgaaaatgaagtaagttgtccaaagtcttctgggaatgaatcaaggtcttctgacaccaaagcctagagccgtcccaccaaacccagttatatctccacgaacaaacacagcaggcaacccagtgcattacagacctcatgtatggtgatcgagtcataacatatatcacaataaataccttagatcacaaaataaaatggtgagtaaatacagacattcggaaaatctagatatgtagggactctaaattctgtcgttctttaaaactaatcaatgcccattgaaggaaaaaaaagtgaaagtattaagtagcaattggaaacataaacatcactcatagtcttattaccaaagataattattgctaacattttgctgaacacttttctaatctacagttaatgttgcaatactacctggcatgcaagatgtgaacaatttggatttggattaaatacttgccagtcctgcaggaaccagtaagaactgacctacgaagtgccttgctttggaggtgacctggtcagcctgtaggtgctactctctatcctgtgaaggtccaggtctgcaagatgggcaagtgctcggcaaggagcctataggactacttgttcggggccccggtgagccatggagttgatggttggttatacagcagtgcccctcttggaggccggaaaacacattccagtaaaggcagggctcactgtgtcctatgacaattttctactttgaaagcctgtctcagaaacacccagcttagaaaatggccctgtgccctcatcatttctgagatgaactaacccctccactctgaacacccccctacagttggttggctcctctcccgggctgttgctctgtaattcgtgctgctgtatagcagtggcacatacttttcctagaaagtagcagctgagatgattcatctgtgatccaaactgattcactgtgagcatttgaggagtgaaggtatcataaacaaacgccttcctagattctacacctggatgaaactgtgctgtttctctcagtcctgggctgggtgggcattctcagaaagtagtagaggtggacataatatttaaaaactggtgtgccaaatatgttctactacctcatttaattcgtgcacagcctttgaagtggggtgtgtagcttagcctttgctttgctagctgtgaaaataattacttgggtaatgctttatgatgagggaatggttttgctattcaaaacctctgtctgagagcaaatgtttggacatcaaagatattttgacatgtaattgggtttagggacttagaaagatgtggactatactgttctgtatgtggagacagccatgcagggaaatgatactctgtagcaaattctacaaacgaggaaacgagtcatttgagaaatgatggacaggactgcagaggaacagtctggagatgaaaagacttgggaatgtataattgtctccaactctggggcctgatatcatttgaaagcgtatatagatttgtgtgtaaatagagtccaggcagaagccatattatcatctgaacagtatgtctcattggagataaacatcaaaaacagcctttgtggtttttatcccgtttgcaaaaagcccagatcaccacactggctcctttctaaaacaacatcattggtggaaaaataaaccttacatatttattacactcaggggcagtgtcgatccttttactacatctattttgtgaaaatgacaatttatggttttcatgtctatataaattactgtgtaaacgagaacttgattactttctgacaggcagatttttgacctccaaagcatctttcatttttgacatttttgtagtcaatttctattgtatacctgttggcttttctggaacactaaacattgccttactcctactggacgtagctatcaagcaactctcaagtaaaaaacataaaataaagaaaaaataaaataatataaaataaaatggtccattgcgattttcagtgaatttttttatttaagagctaaggagtacgacagacttctaagtggctctggaatttgaaatagtgagaggcctcagatttcaatgaaggaagtggaagtttccctgatcagataagcgctgtttgaaacggtaaacaaatcaaatatgcattaaattctgcattatcttctacagtttcaggggttattccagggtctgcattatggggaaaataattaattgtggaaggaccatgatttaaagtgccgttccggggacttcgattaagggttttcagaattaaagtcttcaggcattttgcaggaacaccatgccctgtaggaggctttgaaagcctgatgattctcagatcacctggagctactgacatcagccactctggctcagcgccctagggtacttggttgggttttactcccaaacacttatgggagattactcactacatgagcaaagaagaaaagtaaaaatgccagaggcagcctgcctgaaagagagccaaggaatcgatttctcactgtggagtctttgcccatgagcaaggccttgaagggagctcttacactcaaaatgaaccaggagtacccggtttgtatcactccaaaaggaaaagggaggttttcactggtcagtgtcacttctttcccttccttgaacacaccacgcttgttcccaccccaggccctttgaacatgtgggtccagctacccgaaatgagctttgcccagattttttcattgaggcctcatgcaggtctcactcaatgcagtatactctttccagacactcatatctcaatcagcaacattcttccaacattacatgctaccctttgccctatttttttttgagacagagtctctctctgtcaccaggctagagtgcagcggcgctatcttagctcactgcagcctccacctcccaggttcaagtgatcctcccgcctcaacctccagagtagctgggattacaggcacgcgccaccacacctgactaatatttctatttttagtagagacagggttgttcaccgtgttgcccaggctgggcaggaacctctgacctcaggtgatggcctcgcctcagcctcccaaagtactggaattacaggtgtgagccaccatgcctggcgcctacactattgtattcccttatagcatttataactttgtgaaatatcctatttacttgcttacgcattgatgatctctttctacactaaaatgtaaaccttccaagagtgaagataatgattggcttgtttatatgcccatttctagaatagtgcctgctagttgacattcaattgttgaagcctgtgggtgagtttgagtgcatgtgtgggaggtagaggtggtcggacaaattaaatctctgtgcacactcatagggaagcagggaaagcagtggtacttgaaagaactataaatctatattctggttagtgattacttaaaacattaggatgcaggtgatattttaattccaaaagcagagttgctattctctcaaccctgttcagcagcctgattgtcgaaagctccttaaatactccctgctttatgggaagctaatttttctcctacatgctgttcctatggacgttggcatctctgctttttccttctagacaggggtcatcattccgggcaagacaaggctgccatgagtcagaactggaacctcacggatatgatgtcaatgttgttccctctgctgttgcccccaggggaggcagctttagttaactccagcaatgtaatgttttcacctactgagaaattgttgcattaatggtaataaagtcattcagtgtgtacccactctgaaaagacaaattgccaagacagcaggtgtagtgcaggggcaaaaaaaaaaaaaaaaaaaaaaaggcaagcaaagcactgggcttcggatcaaacaaatctaaaatatgattaatttgctgcatggagcattaagccttgaacatattgcctcatggatatgagccccagtttccacaggtgcgggatgacgaggctgcccattttgcaaagtaattgtagactggcaaaaagagatgtcgaaggtaggaagcaggggtagacacagaaaagaaaaaagatgattattgtcatttttacaaaggaatatttagctagagggcctcctaattgcaagagaattttacgtgaaagatgatgagtgggatttgccctgtgcctgcctttaccctgttgtcctttagattccgggacacatcattcttcacagggaggcttcatggcaccccacgcctgcatgtgctcctccgctcactgtacttaaacattgtacttaaaatatgaggatttcaaggccatgtaacacgactttagagattctgagtgataaagtcggttatattcctcagccaatcaaatcaaaaacaacaagcactgttttattcacgattcccagatctcacatcgatgttttggaaataaacgatttttttgcctgaaacaggtgacaatctaaacctgagtcttcgcttcagagacttcgagcttatatttcaataatgcaagttattctgaagtcaatgctacttttcttatagaaacatagcacccattgccagtggagagaattctcttcctctatgcatggtagaactaatctttttattatatttattttttcttagaactaataattagttgtatgtcaggtatttatttatctcttaatgaaattcccagtgatgacacttcatcttgggtcagtaggattgagttgttccctacatttgaaatcatgctatgtattactcttgctttaatacgggtgaagccagaagctccagtgtctcaaggttgtggcagtgaatgaatgtagtaaaatgtttccctaagtagtgcatttaaactctgagatgtaaattgatgtagtttaattgggatactataggatggattcagcattactcactaaaaaaggtgtaaaactaccagttgcctgattcctgggtgttcgcatatacaaattctttctgtgtagatatatgagtgccatagttgtctttcctcaacaatgaagaaagatttctgcgtcaacaaggcatattttaaaattgtaataccatgctctattttaatgcttagtagagttcacctccaaagagaaattgaaatgttaaaaagtcatactaaaacccctagatctatgattatacctgaaggttgaagctaatacaagctctctaagaggacagacagtaaagaagaatataatgagggttttttgttatgaaaattatacagatatggagacctgaatcatgacaaattatgagcagatttttttaacctcatcaaaattagtacacacatttttaaaaagagatataaatgtccaacacattttctctctcccgggatgtggacctagtcatagactaacagccaaggtgctgacacggccctcctctaggccatccaaagtgaggccaagatggcagcaaagtcagttcttaaggggtgttttataagtttaatatgaagaaattgatctccaacaagtcaaatttaaatgtataaaaatcacaaatgggttcatatccatctctttggacaaataggccactgggccatacgtaacttcagagtgtttcgggcgccagtttgctgtttctatttttttttttttttaatttcttctaaaaaaaaaaatccgggatacatgtgcacaaactgcaggtttgttacataggtatacatgtgccacggcggcctgctacgtaggtacgcgtgtgccacggcggcctgctacgtaggtacgcgtgtgccacggaggtctgttaggtaggtacgcgtgtgccacggcggcctgctacgtaggtatgcgtgtgccacggcggcctgctacgtaggtacgcgtgtgccatggtggtttgttacgtaggtacgcgtgtgccatggttgtttgctgcacctattgacccctcctctaagttccctcccctcatcccccaccccccaatatgtcctggtgtgtgttgttcccctctctgtatctatgtgttctcattgttcagctcccacttgtgagttagaatatgtggtgtttggttttctgttcttgtgttggtttgctgaggatgaagcttccagcttcatccatgtccctgcaaaggacatgatctcattcctttcttatggctgcatagtattccatggtgtgtatgtactggattttcttttttccagtctatcactgatgggcgtttgggttggttccaagtctttgctattgtaaatagtactgcagtagacatacatgtgcatgtgtctttatagtagaacgatttatattcctttgggtatatacccagtaatgggattgctggtcaaatggtatttctggttctagatccttgaggaactgccacactgtcttcctcagttgttgaactaatttccattcccaccaacagtggaaaagtgtttctatttctccacagtctcacaagcatctgttgtttccttactttttaataattgccattctgactggcatgagatggcatctcactgtggttttgatttgcgtttctctgattatcagtgatgttgagctttctttcttatgtttgttggacacataaatgtcttcttttgagaagtgtctgttcatatcctttgcccactttttgatggggttgttttttcttgctaatttcttgtagttttttgtttatcttgttcctgcttccccacctgtgagtcacttaggatataatgacatgatccacattctctgtgatctacgggattgtctgtcaccaagtggcccctaatggtgcctcagccatgagtcttggggctcagtccacaccacaagggcatgaaatagatcttcctcacacacacaccatgcatgcatgcacacaaacacacacacacatgcctgctttctccctctcttagggaaatagtgctataacttatatttgggtttagtgtctatctgcacaaaaaatgtgatttttttttgcacagtggctgcatggataaaatcatgatgcatatcaccatttacgttgctcatttcacagacaaccatgtttcaccttttactggatttttaacatttacagttgtgcttttcctcagtgtctttgtgaatttaggaagagaatttgtggggatgagggctactccattatgttggagttgagacatcagatgccggctgatgccaccccaccacttgtctggtaaaatgtgtgtttatagttggtcgggaagtatgcacacccaccacagtaacaacgtcacaaaggataagagtgtgcttccgcatatacgtaaatcaatttcagtctgcaatgaagccagcacttccttagtactgacacctagtatcctagggccctggagtagtgccttcaataaacatatctatactgcggttatatattctctttggccgagaaactcttcttgtaggcttcagttggtatatttgccaaggtgctcaaaataagtgagtcatcattgatacacctgtcattatatgatctaaccttctcaagaagatagtaatgctctagactggcagccatgaaggcagatacctttattataatctactgactgctatattccaagtgccaagcacagtgcccagtgcacagtaaacatttggtctatggaagcaagggagctggagtgactattgtatctgataaaagatattattactacctacagtaatgattgtgaacattgacagagtacctattataaggtaaatagtttccatattttaatcatcacaaatgatcttgaaagacaggcattatcattcctattttactgatgagaaaaactaaagagcttgagtgattttttccaaagccacatatacaaagcaaagaaatgaggggtataaacccacgtgagtaggacttctacccctgtgctcatcctatcctgacacaatttagaaatgatatagtattttttctgtcattttctgaaaagaatgtgtctacaaattccactacaaaagcaaaggccaattttttaattttaagaactcttctactcctctttataagaagccatgaaactacattaattggaaaaaaaattaaacgtttttgtgtatctgagccgaaggctaaattctgtttctttgtctctatttgtgtaggcatttcagaaactaataatgatgtttatctttagttttatttcataagtaactattctgacctgatactacaatatgagttatgcctttaacaaataaaagaggtttggaatttcaataatatttgcaggtgtatgactgggggcaccatgtgttgatgcacaggttgtgcactgcacaactccacagagtgtcgttcacacagatgacacagctgccttgaacataagactgtcgagaacttgattgatattagaatttatcatgtctgggatgagacagctttacgtgtgaatatgtagaagacaccaaatagtcataaaaatatcaatgaccagcactttgggaggccgaggcgggcggatcacgaggtcaggagatcgagaccatcctggctaacacggtgaaaccccgtctctaataaaaatccaaaaaattagccgggtgtggtggcgggcgcctgtagtcccagctactcgggaggctgaggcaggagaatggcgtgaacccgggaggcggagcttgcagtgagcctagatggtgccactgcactccagcctgggcagcagtacgagactccgtctcaagaaaaaaaaaaaaaaaaaaaaaaaaaatcaatgaaaacaatagctcccttaacggatttgccactgtaattgatcttcagctaaatttctacatccatttgtatggcctttcaacttttaacttgctcctaagctgtgggcaagaaatcaaagccctggcttctgcctcttattttagcttggttttgcgacgtgatgcttctgcagaaacaacgcatgacattgaaactccacggagaattcggatttgctatacaaagtattttggcaaaaaggaagtgacagcctttcgagtctgtggccttgagttaaaaaaaaaaaagatacagcttgtagttgattctgtgtgtgattttattttactgatttctaattagagatttgagagcagaaaatatgtattttgcctatttaagcatggttattcagtttcatctagattctattcttctttattttacccaagttttgcttccaaggttgtagagtagaaagcagaaaaatagctagttgcctagataaagtatgtgaacagaagtgttgatctatttagcaggataatactattcttatttgccttgctttaaccattacaaatgaaccagaaacttgtactcataagttaaatattgataacaagaagaaatatggacttagagacaagggaccatttgcaatattcactgatcaaagcagtacaaaggatcaaaacttttagatctagtgcagatgtctcaggaaatataacatgatgccaagcgaatggcagcaaaaagctgaggctaaaatgagtactatagtttcaactgagaaaaaaaatcaaattattgtaccaaattccctaatatcagatgtgtataaacttaagaatattaaatacctggcaaacagcaagaggacagttttataaatcataaaaagcatttgtttaatgatcaaatgttaaagatttggtatttccagaaaaaaaagtgttgacaaaatcaacctttaatagcgttgaatattcaagcagatcagctcaagcagtgcattcctccactgctgtgctgtttctcgggtcttcagctggcatcatttctaattttttgcactgtagcttgattatagtcatatactggtggggggaggaattgaacaaacacaagcggatcacagaagaaaaaataaagtttactggtttctctaatcagagtcataatttactattttacttaagaacaaaactattccttaatatccagctgtaaaatgaggcccacatggttaatattctcataagatccttacacatcttctgggataattctctttcaatttctgccaggtatatgatgatattctgtcattattatttcaacatgacactctaattcacacgtctttagatttaaacacacatacctactccccatctgtatttaatgggcaagctgtgtgattattaggggtgacctaatttgatttactgaaccaaacagagagctcattggaattaaaggactcctgtcttataaagaaccctggcctgcaagttagggagagacattagattatctttcatgtgctagtatgatttagagacctgatagggagaactttaactcaatcctctgggtctagctccctaagtataatgaaaggagactcaattagaaaaatgtctaagtctcagctttcctctaagatacctatgagccatgattgagtcaggaagaacttgaattgtcaaatctttaacacaatttttttccaattaaattaataataaaggagattaggagaggcagaggaagcagcaataaattctattcccaattataaagcattgagggattgcattaaataggagtcttcaaaagaaccataaaaatcaaaggatgggattggggaaaatgatgtcagaatagaaatccagtctcatttatacttcgagaccaggaataactgtgaagagacatttgacatttctcattagtctaatgtattagcatcagtgaaggtcttttgaaacaaacatatgagacttccattctgtttttttgtctgtttcattctgctttgggaggaagtgggaatttccatttaaagagacaagcggggtcagtgcatgcagcctaccagaaagaaccactgtgccgagcctgccgagacagattcgccccatgtggtggctgcacctgtgatcccagctactcagcaggttgaggcaggagaatcgcttgaacccgggaggcagaggttgcagtgggccgagatcaagccattgcaccacagcctggagacagagagagactctgtctcaaaatttaaaaaaaaagacagattcgccacagcttcagccatcagggcaatcccaagcgcagtgacaagctctagagcagcagtctccaggctttttggcaccagggcggttttgtggaagacaatttttctgtgaagggtgtggggatggttttggggcattagattctcataaagactgcacaaactagatcccttgcgtgcaccgttcacaatagggttcatgctcctgtaagaatctaacgccgctgctgatgtggtggggtggagttcaggtggtaatgtgagtgatagggagtggctggaaatacaagcaaagcttcccttgctcacccactgctcatcccctactgtgtggtccggttcctaacaggccacagataggtacctgtcctcagtccagggcttggggaccccgctctagaggatgtgtttatgagagacagagctccttgtctctttcccagccacagattcagcccatttagtagaaatttccaaagtagactcttaggtgttgagtgatctgactggtcacagcaggaggcaattttagagataaagcaaatgacttttcatctatacaaatcgggctcctataaaggagtgattggatccacagactcccaagtaactgaattaaggtgacgatcactaggcgcaaccacattagaagtttaagtagactcaagtaggtcatggctatctttccgtgctgcagtagaaacatttttttgttattactaaaaattctggtaattgtttaattcacaagagtaccttgtctgtcatgttattttcctttccaggctaaaatttgcatttcaaataaaggaaagacttacagacaccagactttctaaaatagattttagcaacccatgctcaatatcatttctacttgtttcaaaatggaaagttttgtgatttatgacatgcattaaaatagtcccagataaccaccagtgacagagagtcaactgcagcgggttcctgatctcattgtgatccccaggagttaagttgccccaggctgaaaataagcataacacaaatggcagaaaaggaaatgttggaggaaaattgtattcaaacacatttggttgaaactccaaagtgtagtagatattattttgaatttgaagggaggcatttgcaaataactaatctttatcaagtgccatgcttttaggattctgaagaagacatgcatttttcataacgttattcatgcaaaatatctcagtagtctcagtagtcatttttttttaaccaaagtataatatcacagaggatattttaggattggattggtttcatttactcatgattaggttccattcaaatataaaggttggttgtaaacctgaattgacttcagatgtccaagttaaataataacttctcaaagccccataatgcctcagcaacttttttctttcccggtgcaaaccagggccgatgttacactccatgtatttgctgcaatttctatttctcaattgccttttctgttgtttcatctttgacctactcttctggagtagtctggatctagtaatctcaatatgtctaaaatatgtctcaggaattcaatttgaacaacagttcaggcaaatctcaaatgaatatagacttatatggaaaggatataaatggttcagggatgtattgctttctatgcagacgtaacaactccagcagtataattcccctgctgggtctccacccctctgatgctctctattctggggaagtagagcaaattctttgcttggtgagtttggaaaaggaaagtaggaacttggagcatgaagcctttctctctccaccctggaaacgaagtaccaggcaatgcatatacttcttacgtttgctgagaggcacagtggagtttagagggggaggaatggagggatgttggtctaatccagagttttatattaggaagttcatatggctatagatatcaactaaaatggttgaagtcagcttagattgtaataagttttggatttgttgggtgctttccagtggtctcacacctgtggaagaggtgtcttatttctcaatgcattcataattcagacagagaagaaaactttattttttgggtcccttctgtgtacacaggcagacaactttggaaagtcatctttcactggtgaaaatggaactctattttaaagacaacaaataatgatttatttggaaaggggcaaagggttgaaaaactacctattatacattatacaatatacccatgtaacaaacctgcacaggtatcccccaaatctaaaacaaaagttagtattttttaaaagacaacaaataactaaccattgtttgaaaatgaggccaagcatttgatacagatgtacctccaaaaaaaaaaaaagcttaaatctttgtaaatcatttgtccatcaaaggagacctattaatttacctatattactaatttcaagggttttgtcttactaagacagttttgattcttttgactttaccaaaatgttattccttaaatacagataattacctttttcatgaacttcgtttccttctacctgcaaatcttaccttggttgctaaaattgaatagaaccctccccctggggtcactgccatgctgctatcctggctgcctggctgatcctagttcctcaatggccactggttgcaatcgacctgctgaaggtttgaaagtggcttccaggagaccaaacaaaactaagtgataggaagtaaatgttaaacaaaaacaattttaggtataaaatggaaatgtgaagttacagacatggattctggcttattttttggaaataaagtaaaatctatgatgatcagaatttaagaggatctcaaattgtaatatttacttccactgacattttaagaggaaataaacagttgaattacttatttttcaaaaaacttctgtgtaagtaactttatggtacttgctatagaagaacatagcatgtaatcaccttaatcatttagatgaaaagtcaatataatggaaaaggtaactaggacacgaagaggtgttaaccagaaaaatgatgttcataagaaatgcccaacagctactcacactaatagtataatttacgttgatataatatcaaatcaattactcaaagacctccaacaacaaaatgtggattagaattcagctaattcacttactgagaaagaaaagaaaagcatgtttcattattcatcaaatattgattgactgtcaactgtgtggacactgtgttaggctcagagaagacacagatctgtgctccctggagttccatgttagtgcagagggttggacaataaaaaataaacctactcaatacataaactgcatgctctgttgggagatgagtagtgttatggaagagaagaaaatgtagggcacagtaatgggaaagacaatgctagtcttatgggggcaaagtgtatcgtgtgtgtcaatgagaggtgatgtgaagcaaggattaaagggaatgagggaaaaccccataagaacactgaggaaggactattccaggaagggaatatggctgtggaaaagccttaggttaggagccagactttcagggggcagtagaagaagccagtgagcctagtgaagaaaagcaggaggaaaagacatctgagaggcaaccttcagggtagagaaggtcagaccaggcatggttgtgcaaagttgccatgatattcagattttaatctcagtaaagtggggacactttgaaggactaatgtatcattatattatccacgtaaagcttaaagcacttaacctttgctgataagaacatttacggaccatttcataaaaaaatccatcttgcagggattctgacaactttgggtttgttcaaatctgatgccatattcaacttgcaaatacgattgttgtgaatagaaaattagttgaatttactatggttcaaaccaacaaaggtggtgactaattttagtttcaaagttctctgagatagtctatcatcaccgaatacaactgcccagttacctgccagagcaacaatgggacactcactccagaacagtgtttggggacactaaatgccgcaggaggcagtggcagacgtgatcctagaaaggaccgtcctgcggggattctcggtgtaaaggagaacccttccccagagaaaccacatttactaatgtgcagagaccaccaaatcagcaggggcccccaacatcttatctgtcctaatccatctgggggcggcctgaaacactgacaaaaggtgtttgtctttgcatcacccgattcagaactcacatgaggcacaagagatggacgatcctcaaaaaccaccgtagggcacgcaaagccaccaggacacgcaaaagatcacaatggaggcaaataacacagtgcccaaagctgcacagaaaagctaggcacagattttctctgggatataaaagcatccaaaacatccctgcatagtgggaaactcagaaactcacacatatgcccagggcagaatacactctcagaaaagacctcacaattttcccaaactttcacacctggttgagcagtagtttcagtgcaaacaagaaggaaaaactaaggcagagttgtaaaaagcctggcgaagtgttgaaggagggcccagcacacaaagggtcaactggcagactgagagaggattttcatttttgttttgtatttcctttctgcctctcttttcctttctttcttattcatgtccattcccttccctctctgtctctctttctcactcacgcactcttggcattcatggaaatctctgtcaaaacgctgtttaaacattagttaaagggacaaaggcttcaaagaacaaacatagaaaagaatataaaccttataaaaattgtttttaaaagtatttaattcaataactacagcaataaaacaattcccaagaagaataaataaaattaatttgcacagttaccaatgtataatagtaaacatggccagttctcaaaaaatcataaaacattaacaaaaagaaaatatgacccactcacaaaagaaatgaaaaaaaaaaaaactctccctgaaaaagcacggacatttgaattagtagaaaaagacttaaacctactgtttaaaatacacccaaatagctaaaggaaaccatagacaaaaaggtctaggaaaccaggagaatggcatctgaacaagcagaaaatgtcactacagatatagaagttataaaaaaatacaaatactgaagataaaaagtacaataactgatgctataaactcatgagaaggtttcaaaagttggttaaagcaggtagaagaaagaatcaacaaacctaaaattaagaaagttgaaaatatccagtatgaagaaaaatattcagtatgaagggaaaaagaagggaaaaaaataaacagagcttaagaaacacatggggcaccatgaaacataacaatatatgcataataaaaaatccaaaagggaaggagaaagagaaagcagcagaaataatgtttgaataaatgactgcaaatttccaaaatttactaatcaaaataaatcaacacattcgagaaactcagatacgtgtaggaaggataaactcaaagagatccatactgggacatattttaataaaattttgaaagacaaaaacaaagattgaattttaaagatggcaagacagaagtaacttattatacacaacagatccttagaaagagcacctgcaaatttctcattaaaaattcctggaggccagaagcaagtggcagtatatttttaaagcagtgacgcaaaaaagcaaaaacaaaaacaaaaactctatcaaactcactattctacattcagcaaactatgcttcagaaatcagacattgataaactagaaataaatatattcacaaatttttaaaagcaaaatgctacaatgaatgccagtgcggagtatccacaatgaaataaaaagacttcggaaagtaaagcaatgccgttagaaaaattaaaaactacaatcaaagtcattatactggtaaatataaaagtcactattcttatactttcggtttctaactcatttttcttctatatgatttaaaagacaaatacataaaacaatcaccacacatctgggttaatggtaacacaatttatgaggatataatatgttcctatgtgaacatggtctggggttgggagtctagagctatataggagcacaacttttctatgttattgaaaatacgttgatattaatagaactagattgttatgattttaggatgtgaattgtaatgtctgtggtaaccacgaaggcaataactgaaaacaatacataaagggaaatgagagggaagtcaaaatggtacactacaaaaatacataaacaagaaaaccagagaacttcacaaatacatacaaataaaataaccgattaaaaatgtaagtacaaaaatgggtcaaagaagaaattccatgagaaaataaaaagtttcctggagacaaatgaaaacgaggacacacaaaaatatatatggaatcagaaaaacagtgctcagaggaaatgcatagctgcaaataccaacattaaaaaagaagaaaagatcaattaacaccctaactatacaactgaaggaattagagaaaggagatacaaataaactccaagctggcaggtaaaatgaaatattaaaaagattagagcagatatatttaaaaatgcagaacagcaaaacaatagaatctacaaacataatgtgacatagacttgcagtggaataccactcagtcacaaatgaaggaagtactgacacaggctgcaccatggatgaaccttgaaaacatgctaagtggaagaagccaggcacaaaatgtcacagacagtacaatttcacacatatcagatacccagaagagttatatccatagacacagaaaacagattggtgattgccagagtctaggccatttccaaggcgacaggggagtgactgtttaatgagtatggggtttcctttttggatgataaactgtttctcatacagatggaggtggtagttatacaacattgtgaatgtactgacgcctcggatttgttcctgagaatgcttaatttatattaagtaaatttcattttaataatttttaaattaatctatgtaaccatccatattaacatgctaaacaataaaaatcaaataaatcataaaaatcatgtccatcagggaaaaaatgcatgtgacataattcaacacccactcaggatcaaaacactctgaaaactaggaatgaagaagaatttcctcaaattggtaaggagtatatactcaacttgtaactataattatacttaatagtgaaaggctccatgattttctcctaagattggataaaagaaaggatgtccactcttattcaatatataattgggagttctcaaccagtgcaaaaaaaaaaaaaaaggaacgaaataaaatttatatacatctgaaagggagaaataaaactgtccatatttaaagatgacataatgttctttgtagaaaaccccaaggaatctaccaagaaattcccataaccagtaagtgattttattaagtctgtaacatggacagaagagttaaaaacgcaacacaatttaaagccattcaaaaatacttaggtgtaaatctagcaaaacacatacaggatgtgtttgctgaaaaccagaaaacacgaaagtaatgattaagcaagataccatgtcagaaaagtaaacataggaaagatatcaatgatcccaaaattgacacacaggtttattgcaattccattacaaatcctaacccaacttttgcagatatagagaagattattctaaaatgtatagggcaagacaaaggaactggaatacctaaaataattttaaaataatagacaccaaaatcacaatctataaaataaaaaatattataaattatagttcagcaaaattaaaaacatttcctctttgaaaaatcctgtaaagggaatgaaaagacaagctacagaccgcagaaagtatttgaaaatcacatatttgacaaaggactaacatctctaatctataaagaactctcaaaactcagccataaagccaacaatccaattagaaaatgggcaaaattatgaagacatttcactgaagataggcagatggcaaataccatgttaaaaggtactcaacaacattagctattagggaaatgcaaattacaactacaatgagatatcacttcacacttacaataatggctaagcttaaaagaaaaatgataaaatcaaaatctggttagcataagaagaaaatggatcatacatacattgctggttggaatgcaaaatggcacagccaccccgggaaacagttggcagtttctttataaaacacaacctgcaactatcatacaacctaccaattgtactactaggcatttatcctagaaatgtgacaacattcacacaaaaacctgcacatgaaattttatagcagcgttatctggaataagcaaaaactgaaacagcccagatgtcctttaatgagtgaatggctaaataaattgtgttacatccataacatctaataccactcagcaataaaacaacgacaataacaacaaataaaaacagactgctgactgatacatgccatatactggatacatctttagagaactaggctgagtatacaaagccaatcctcaaacgttgtatgctataggattcgatttttataacatttttgaagtgacaaaaatatagaaatggagaacagattattcattgctatgggttaggcggtggggtcaggaggaacgtgaatgtgactctacatgagaataggatctttgtagtgatataaatattctgtatctccaatgtgttcatctcaataccttagctgtgatgttgtactatttcctggctttgcaagatgttaccgtaaggggaaactgagcaatagatacaagatatctctccgtattattgtttacaacttcatgggaatgtaaaaaagtcccaaaataaaaagtttaatttcaaaacaaaatatagactaagatcaatgtttttataagaccattaaatcgtaataatcctatatccaaaaaacggttagcatgaagaatatgttagtcctaggtaacagaagttgtagaatgttaatgttatcatggagatgaaggacggtagcatgctgagacaagaatatacgtaaatcacaatcagtatcttttaataggattatattgacagtttctacatagttacagagttattacaacatattcaatataattttgctctattagcaatgtttgatgaacaattatatcatggacatacacaggtcaatgatgtaactgtgttgagacattatattaagataaaaatttgggactagagaaacaccacaattacactttttcttttctaatagattgcagtacaatatataaatttcaaaggaaatgaaaaccccctattaaatccttaaacagggtctaataacctgacatgtttgcaaagttatgctataatgattttttataattaataccaaatttaataaacatttttattttgtagacaaataagaggtttctaaaagtaactgagtaatgaattactcagaggaaatgagggaaagcagagggggcgatttataggaacatgcattgttcctgaaattgctgaggaaaaggcattagattctacaaaaagaccacattgacacgcttttcttttaataacactaatttctttttattttctccagtgaagcactttgtttctgcagactggtgctttctggtggtgaaaagtccatctgtgtttttcaggcactttcgctcgtctccctggagaatgctaatgtaaagatgtcattcatgtgcccaacaatgccagtcttgacggctacgatttctcacatcatgttcttcagaaatataaaacccctttcagccgccacttcgttttgtggtctactttcaggagcatttgtacactgcactttcagatgttacgcaattattcgtcacatacacctcctgctccaccgttcctatggatgatgctcacattccttttccaccagggattcaagctcaggtgacaaacgagtgcccacatcatcaaaacattgtggcaggacacttgtcatggtgtggaaacgcgggtgacagtgtttattccaaaatgagttagccaaaagacaaaaagagagaaagaaaaaggaaagaaaggctaaagaggttactcttaaggaatgttcttcaacatgatttcctttttcatgtggagaaggcttttgttttgttttgatttccctgaaaaatctctgttccagcccagagctgactaacatgactggagagagtcaagtaagccaacccctgaggacaggagggccagatcacgtgggcttaggacgccacggagaagggatctgtgtcatttcctctggaaacccactggatcagctgggaagtgctggttctcttggcaagacaagcctgagacacattatcccagcccgatttttactgctgacttttcattacctgtatatacacgataacacaaagttagggaccagagcaaacattggacaaagcccatctttttaaaggggaaagagcagagcaaaactacgtagaatctacaggtatttctttcctctaagggactctttggaagatgctaagtgattggtttgggtcaatgtccctgccgaaatctcatgtccagtagtaaccctgaatattggaggaggggcctggtgggaggtgattgaatcatgggcacagatattccccttgctgttgtcctgatagtgcatgctagtgagttctcacaagacctggctgttgaaaagtgcatgacaactctcccttcactctcttcctcttgctccagccaaggaagacatgcctactttcccttccactatgattgttttaagttccctgagacctccccagccatgcttccggtccagcctacagaaccgcaggtcaactaaatccctcttttaaataaattgcccagtcacaggtagttctttaaagtaacgtgagaatggactaatgcactaagtgctgtagcagagcgcctctggttccaggcagaacaaatccaggatcgtcagacacttcagattctcacaaatacctgggctggatcaggaaaagcatcctggggttcttctcaaaatccagtgtcatctgacgatggctccactgggatggaaattggaaagctaatccagataagactgaggaagtggctcctgttgtttctggttcgggcaagagatccacaacacaatgctgttctgatgaagctacctcatgaaatcgcctctgtgaactgtgtgggttctgtgtgtgcgtcatcgtacagcctcatcagagtctgttaaaatttctcacacctggacaggtacaccagctggtaaagagagagatactctccctgcgcatctcaaagtagcccagggagtagttttcatctttgcattatcttggggacatttaagaaacactaaaatattatttctgtgtgactagtaagaagagattttcaatgctgggcacggtggctcacgcctataatctcagcactgtggaaggctgaggcgggcggatcacttgagctcaggagttctagaccagcctgggcaacatggtgaaaccccatgtctacagtagaaacgaaaattgaatgttcctggtagttcccgcctgtggtctcagctactccagaggctaaggtgggaggactgctttaccctggggagttcaaggctgcagtgagccgtgatcataccactgcattccaccctcggcaatacagcaagagcgtgtcttgaaaataaagaaataaataaataacaaaaataaatacatttttaaaggaaaagaaaatgttttcaagagttctcagattgtcacgtcaaattcacatgtgcttattattataacaggttgggagccatacacagcaaaaataaaagcaaaattttattttatataaaagtgtagatgctaatcttatagagacaatcaaattattcacatagtttggaactatggaaattatggcatctttatggtgagggaaaatcttctttgtatgcatttcaaatggattacatccatccaaactttataaaacacaatgtatatatattacttctttacagtttctatttacataaaaaacttgcattaggaatgtgtttgggaattttagatatattgaaaaattgtagcatctgaaaaaggaaaataatatctcatcgtgttcttcattttattattaccaaatattttaattttcaaactgtttaattattaatttgcagaaaaggtattagtttccctttactctccttccaccttgccacccagccctgccctctgtatttctggcaatctagattaaacctcctgcattttttgctttcttaggtcttttctgtttgtccatttgccaaaccctggcggcttctttcagagctctgttctcccacgaccttcctctccttcactttctctgaaacttcaaagtttggctggttctcttttctctcagattggccttcctctccctttgctgactttgaaatttgtaaggtaaattaactgaagactaatttccaaaaagtaaaccacccgttttaggtgaacgggtccatgagtcgtgaaagttatgtcacacataaccatgagtaacccataaccatgagagattcaaactccacagctaacacacaagcattcccagcacactgataagatcctcttgctcctctgtggtcagccctctcccccagagggtggcagctggttatcagtgatatgatttccatctctgtagctttgcctttcccaggtcatattaatagaatcatacagtgtgcatgcagccttttgcaatggcttattccacgttagcataacgcattcaaggtccacccacgctgttgcatggatccataatctattcctctttgttctgagtagtgctctatggtatgaatattaaacaatgtggttaccatttgcatattaatatttgtgtttgttttccatttattagcaaatataaagttgctgtaaatatttatgtaaaagtcttcctgtagacatgttttcatttatcttgagtaattacctaggaagaccttgcaggattgtatagtaggtatatattttactttacaagaatgacccaaatgtttgccaacatgaccgtgccactctgcgttcctattaggaatatgtaatattgcatgaactctgcatcggcagcagcacttgttgttgtcattttttttgtttttgctttaagccatagtaactggcacataggacaatctcattttgcttctaggtaacgtttctgtggtgactggggggcgctgagcatcttctgatgtgcctgtcatacagcacatcctgggatgcagaataatgacctcccaaggatgtctaagtcctacttcctggaaactgtgaatatattatttaatgtggtggaggggaatcaaggtaacagatggaatcacggttgctaataagctaaccttagaatagaaagatgattttggaatagccagatgggcccaatataatcagagagggcttttaacatggaagagggaggcagagtcagtgtgaaagtgagtcaacatgataaggactcaatcagcaactactggtttgaagaggaaacagcacaggagacaagcaatgtgggcagcctctagaagctgtgagaggcaaaaaggtgaatttttactaagaccctccagaacggaacagaatcctgataatactttgatttttgaccaattttggacttctgacttctaaaactgtaaaataacaaatttatgctgtttcaaaccaataatattgtggtaacttattatataagcaacaggaaaatagtaaataatccataactgtaattaaacaaagtgtccaaatattttttattttaaaatgtgctgttttcttactgagatttgagagttcttcatacagtcaagtccttcatcagatatgtattttgcaaaaacgttctcacattctgtagtctatcttttcattttcttaacggtgtgttttgaagagcagaactttataattttgatgaagtctgatttatcaaactcctattttagtgctcctgctttttgtgtgttacctaattaaaaaaaaagttctttgcctcaatttgtgaagcatttataaaatttttatgtaatttttattcctttagtttatatatgtaagaatatcaatcattttgagttaacttttgtgtataatgtgagatataagtaaattttttaaacttctacatgtacaggtccagttattacagaatcctttggtgaaaagactattttttctccattgtgttaccttgtcccctttctcaaatattgttcggccacatatatgtaggcctatttgtggactctattttgttccatagattatatctatctatctatcatgttttccaataccacagtcttgattactgtagcatgaaaagaaatcttgaaatcagagtgtgttagtgatccaatttagtgcttctttcttaaaattgtcttggccattctagattctctgcttttctgcaaacattcgagagtgaatttgtccttttcttcaaaatgcctgctgatattttgatttggattgcattgaatccagagaacaatttagaaaaaaaaaaagaaactgatgtcttaataatatgaagtactccaattcatgaacatgatataccctccttttatgtaggtctttttaaaattttcctatattagtgtattgtagttcaaaattcagatttttatatattttcttggattgtccctgagtactttatgtattggaacgctattgcatatgggattaaaaaaatacaaattctaattttcttcagtgattgttggttaaagaaattcaatggatttttaaaatattgaccttaaatcacatggcattattaaactcttttggtttcagtaacattcttgtatattgcttagaatttttctacatagactacgtcctttgtgaataaagataatcttattttatccttccaatttgtaaaccttttatagctttttctagccttaatgcacggctaaaactgctaatggaattgaatagcagtggttagagtggccatctttgcctggttcacacatacgtctttgaaacaattcttttacctgccattgcatttgttaaaaatctacaatattttcgactccattttttaagctatagcgattctacatgaaatacctcatctcttattttgtaacattaacacgtattaatttgacctaatcttattctaccttgcacgtgtagcttttagcagatattgcctcgtatcaaactcaatgagttttctgaagtttaatcaactgcactgccatggatttgagtataataacttctgttatggcttctgatccttccaactttgataatggggcattccgttgaaaagcccaaaccacaaacccaaatctcatccacgtttgtaggcttttccattttgtaacttagctttcttggatgatcacagcactgtcattggtaggggttcttgggctgccttgaaccctcgtctctagccactgccacacacagcactctaacttgcttttgatgttttccattattattattattattattattattattattattattattattattatttgagatggagtctcgctctgtcacccaggctggagtgcagtggcacgatctcagctcactgcaagctccgcctccctggttcacgccattctcctgcctcagcctccagagaagctgggaatacaggcgtccgccaccacgcctggctaatttttttgcatttttagtagagatggggtttcatcgtgttagccaggatgttctcgatttcctgacctagtgatctccccgcgtcagcctcccaaaaataaaacattaccagtttgcctacaacctctctctagatagttttccatttccagtgttctcttccttaatccctcaatgaagtgctcaacattctccatgatttcttctctatatctgttatcctctctctaccatgtttatctctgtattttctattaaattcaggttgaatctgtttcctcagatctctgaagctttattttattctctttttctaattcatctattatttctgaactagtgttagctttatttctaatttggtttcttaggtgtctaatcttccttttaatctcactcatttcctttgaaatattactttcatcttatatttcacagaatttacacagctcttaatttttacagacttataaagctttacttcagctttaaaaaatctgcatttggcatgtgttttctccctatttccttcttcgcttcctttagggctgggatgtgaatactttgccttctcttgctgtctctcttgcttttagttcccttaatgggacagagatgggggctagacatatttactactgatttttacctctgttatcgtttatatttattcactaaaaatccttacaagaagttagctctacccagaaggtacactccaattggtaattcctccaatccgtatttctcgatgagatttttggtaatcatacaaatgatttctcctcatttgagaaaatagttgtagttttgtttttctagttcctgaggaacaactacttggaactcaggatgtggacaaccgtatctagtcatctttcctttctgcctacccacttcttccaaattgacacatatcaatgagaattttcagagatttttttacccatctccagagaagcactctggaagcattagggtagctactaagtatttctgtttagaaactttttttaaccttccaacaaagttcttaacattttatagtatgaagctgttggttttttgctaacttgaacatttctgctgtttcttttcttaaaccctctttacatagttttattcaccttcttagggtcagaggtagggggtactgcaaatatttttctagaaggagaatgatttaagtagcaatatttggaaagacatccaagaagaatggtttcttagccaaatcacagaactcctcaggtttctgggcttctagaactgctgaaaggtgcagagccccagtgtgctatactcctttatttttgaaagtcatgagtttcatgttttatgaggattggagctgctgagctgaagatctattaacactagtgaagtgttgctccagaacaaatgaactcaaccatctgaaccctgctaggagaaactctgtagaaagggaagctggtttggtgcccccacgtccacaagtgtaagatagggcaaactttctgattagggtagggttagaaatatagtttttcatctcctacactcacattaatttttgcaaactaaagtccctccatgtatatttctgctatgccttctctcatgttctttgtgtggataatgtagaagaggcatggcctttagtctcctggaagctctcatttgcctcttttgatggtttttgtggccttggccctagggaatagctgactttgtcttatttatgaccgtgtcaagattgtggctaataatgaaatacatgttctcctaataagtgaagtcatgggaaagaaaatgtgtgttttggatagtcaaggagcaaacatgtgtgtcctgtgagctagatacgtggtggtcttttaactactcccacttgaattcattattataattaaaagtgctaactgcaagggatactgtgtcttatattctgatcgttacccttaatataaaaataaagcacatctttgctataggcagttctgtatgacatgcattttgataatatcactatgcaaatgttacctgctataatataaaatgttcatccaaatattactatgataggtttgataggattcacgtctcttaaggcagaccagaaaaaaatagttggctctaagtggttgagaaatacaagtacacaaaaatttataatataaagaaaaaaataatttgtttcatgtgctcagatgaaagtcatactcttttcttagaagagcaaaagaacgtgtttgtgtttggtggtggcatgttttgatgggggtactttaacaaggaaattttagtgacaaggatagctttattaattgagcagtcatataacaaacagtcatatgacatccatgctatctcctgactacagctttatcaagaagctccttaagcttgcctacattggctgctgttttatccactaataattctcaacacagtcattgcaaatattacaaagcagaaccctgctggtttgaatctgtggcttgaaaaactagctgcatttgcactcagtattctctcttcaaatcctgcggcatgatttatgtacctatgatgcttagtattccattcctcttagtagtttcctttcaagatgaagtattcaatccttttaccattgaagtcattagataatttcttggtgactattagggcaggttactgaatgggccctagggaaacgctaacatggcaattctttattcttgttttttaaacctaattgatgctgtttatctacttaaaaaaaattacagacccaagtctgtttgtgtaatcaactagaaactcttcatgaggagaaaaattaacatttggcagacaagtttattgtgataattctggaagcacgacagaaaagccactgttctggaataatagcagtgatgtcggcaaagtgtgactggccagcttccaaataagcatcactttttcctctccacgtgaattcaccagacactttgaatagtctcaaacaacgttatcttcaacagttcctctctcagcacagagagcttcaactaaaacgttttaaaatggaactgttttcatgattcagtttatagatttattttttcttacctcaaaatatgggtcagaaagtattgcttgtgtgtgtgtgtgtgcttgtgtgtgtgtgcttgcacgctcacaagcatgcctgctttcctccaggaggctctcagcctgaaggagccagcgaaaaacttacgtttgaggagtttcatttatgcttcatctttttaaattatcttaaaaacgagaagatagaaaccctccactaagttgccaagcatgccagtggagtgggtcagctttctcagtagggagcagcacctcgccgaggtaggcagtgttttgctttctcagaacatccagcatggtttgggtggcttactgagagcatgacagtgatgacaccaaggcagtcctgtaccttttgttgaaagatagagtttcctttaagaattcggctttctacagtgacaggacctggtcactgatcttcccattgcatgaggctctcacacagtgaaatacctgctggcttccatttgccaagtgtcctggaacctcaggaagagaggacaatggcagctgcagagaaggttatatgtgcacaggtcacaggacacatatcaggaagcttttgatctcttgtgctctcccaaatgaaaacttctctagaacttcatttctcaacctagggtaaaaggtgagatgggttggatgctgacttgaagtaactgtaaagagacttagagcctgttcacattctcacactttgaagtatgggcagaaaatatttgtagtgtatgtaaaataacccattttctcaatgagaaaagagggagaataattccttttatattactgatgaaaaaaagctttaataaggatctttggtgaaatatgcacctataatgtaaacaaccaatcacagaaagtgtaagactattgctgattccctactgtaaataaaatgtgctacgtatgcagaaaaattaaaaagaataaaataacaaataatgccaggtgcttgaaaaagttttgggagaaaggggagaaaggaagtaagactgcgcacacacatgcacacatggtgacacaacacacgcactctcatacagtgacatacccagtcacatgcatacatggtgacatgacacacatacttacactcacatgcatggtaacaaaacacacacacacactcccgtatgtagtgacgtacacatatgcatgcatacatggtaacatggagcacaccgaaacatgagacaacaaacacattcacaaacatggcgacatacacatgcatacatggtgacacggcacacatacataacacacacgtttccatagtggcatacacatatgcatgcatacatggtgacatggcacacacgcacacggtgacacaacacacacacaaacatgctgacatggcacacacacacaaggtgaaacaacacacaagcatggtgacatggcacacacacatctgtagcaaactgaggacattgaggggaaaaagggattctatggaaggaaaaagaaagaaagaaaagacatttatcaggtacaatgttaaaatttatgccaaatgtttatttaaaaaaactttttgtaagagtcccttatgaattctcatgaaaaagtcacaaaaactattaaaacgcataaaatgcaagacccaaagactccagggcaaagttagttttacagatcatcctttgaaagggtttagcatgctgtctataggtgacctgctgccatctgtaaggattatcctcctttccaacctagggcccagaggtgttgaggcacacttgatatcattggccacattatctaaaacctcaggaaatgattgctatgtgttttgttggaagagtttcctacaaaacagctctcagttagttcccctttaatatctagcacctactttctaccttgtgcttgggggaaactctgggggcaattcacagactacctctattctaggaatcatgctttgtggttctagtcctcatttacatcaactctgctaatgcttcctcaacattttcccccaagaaaacccacagctggtcaattaaatcttgacgacataatgctaagtgtaagaagccagtcacaaaaggtcacacattgtatgattaagtttgtatgaagtgttcagaatacatatatccacagagactaaaagcaattgagtgcttgccagggactgcccgtgatggaagtgaggggctggggaatggtaatgattgctgaaagatacagggtttgggaggatagataaaaagccctaaaattaataaaggaggtgattgcacacctctgtgaatatattaaaaaccatcgaattgtgcactatacagaggcaaatcttacggtatgagaagtatatctcaataaagctattattaaaattctaaatggagactttctcacttatatgcattattctctttatataaaccagattcaaacattggccatctcacagcagatgtccactggaaccatagatgaggtgggaaaatcgatctaatggtcagacctcaaaattttggccatacaattatttgttcactggaggggttggacctagtggtcctgagttgaaaaaagcgggaggttatgttgagtctggcatgtgcagggcacagggatggacctggattgaggctgaaaaaaatgctaaggaaggtaaacgcaagtggaaatagataggttgatgccaggataggttgaaaaaaagttctgaagaaggtaaaggcaagtggaaacaggtagggtgatgccaggatgggaaggtctcaaacacctggcagaggaggctgtgtgtataaatgctcaaagggaatgagggaacagtacgtactcagtaaaatcagcaggagaggagcaacttgaccataatagtattgaacaaagatgtaccactaaccgttctggtacttgaagctttggtgcaaatcaggaacaccaaggagacaaataatagtgtttggtaaaacaaacaaaacagaacaacaataacaacaacaaaaacaaaccctaatatatggaatgtagaagagagtagtgcaaatacatatagaagaaaatgcaaggtttcctggcctagagtatcagcatgctatagattgaatcgtgtccccctccaaaattcatgtgttaaagtgctaagcccccaatgtgatatctggaggtggggcatttaggaggtgattagctttacatgacgttagaaggtggagactctcatgatggcattagtccctttataagaagagatgctagagaggctgcttcctcattctcctccatgagaggacacggtgaggaggcagctgtctccaaaccaagaagagagccttccccagggaactaaactggctgcaccttagtgttggacgcacagggctccagaactgcgaggaataaattcttgttgtttaagccacccaatccatggtattttgttatggcagcctgagctgactaacacataacatttatatagtttcagttttttctttagttttaaaccttagaacctaacctgttctagtgaacaattctttttccaatacttatacaccatgcagtatttaaaacacttaaaactttcacttcttatctctgaaggggcattgttggagcctaaagagagttatcaacatcaaaagttatttgtaaaataaatgagtgtagagaaatgtttgacatttgaaaaatacagggcaaaaccttaagtttatcatttctgagctggctgactgtttttgtcatatttaactttgctgagcctcaggattgtaagaacattaaataaagaacaatacacggataacaagtcataaatcaaaccagaatcaagactgtaatggagggacaagttctgagaatggtttgatatttcaatgtagagacaataaaggcctaagttgaggtggtagtagcagcagtgattacaatgaggacagaataaacataaaaaaagtaagcaggatatctttctggcaatctcaaaattgagctgtttaagtaaaaatccaagagttatatttggtattttttttgcatattttccctattcatctgtactcccttacattgcattctacttgtcaacagtaagcctgtgtttacattcaggtactctgttttctttgaacgaaagccaaaggtactctaatcatcacatttatgcagtgtagtaaggtgcctaattgtttcctaaacaaaaagtatctaaactatcatactagtagaaaaagagaaaaataaacgttaagcctggattgaatgatttgttttatggatgtgtctgccttttatagataatagcaattcttcacatttgctttacatttggccttgcagtttttgaagcaaattattcacttttatcctttcaacagtcctagaaagtagaaagagaagcgatgatcccccatattgctgagtggtaattacacaattctgctatgcataagatgttttgtcatataaacagacatgttttctatattatcaaggtcatagaccctgacctaggcattgaatagttttgtggtacttgggattgaagattctttagagttgctcttctcctttgcttatgacaccctccctctatatattaagataaattagccatgtttctcattccctgccaaacactgaaacagaagctcctgtatccatctgccctgaactgcaccactgccctaatattagctatgtccttgactttgacttccccatccacccctcaaccacttctgggagcctctgcagctgctggagtatgtcttcattcctatcttcaactctccttcaacttatcacaggtcctgctaattttgccttccgaatatatctcataatttcctgttggtctacatcatcactagcaccagtttagcacaagctaccagctaccacggcaccctttaacggacttcttatctccattctcctttcgcacctgcagcaatctgttttccaagttacaaaggaaaaaagaacaattttattatagcctatgtagcgtatcaatgtcacgtcatagtttgtgtttctagatctctcccccagccctcctgcccttagtttgttcttagcccaccaaagcttttctttgttctcttcagcgagttgctcattttataaaatggctttgaatgttttgttcttctgtcctggaattttatatattgagagagagatatacatattttatatatagagagagattttagatatacaggaattttatatacatagagagagatgatatatatagagaaattatatatatctatcatatataatatatattatatattttatatatatataaaattttatatagaattttacatagaattttatatagagagaattatatatatagaattatatatagagatatgatatatatagggatatatattataatatctatcatatatacatatataatatatatgatacataaaataatatatacattatatctctatcggattttatcatttatatggtcaggtaactatacataatagttcttaagttactgtagaaataatgctcagggaattttagaaataattctactttgttgaaggaatccaacaatgtagttagaaattaaagtgaagaaagaaattacaatatacaattagtttatcattataaacatgtgctacctatttatttatcttggataatgggacagagtttcaacataaggcatttgaattagagacagattctctctctctctctcgttctctctccaaccttgtttcaacacactacaatttatatagttattctctaatcatttttatatgttcaagccagaagaaattttccagtgaaggatttccttataatctgcactacatcaagaatactcactttgatgctttcatagtgcctaagtaatttttctttatagcatttatcactgctgcatttttatatttctttatgtaatcattaattaatctctctgactaattgtgaatttcatgagttctactttgactcaccgttagatgcagaaaacccattagagttcttggcaggcaacagatgctcatcaaatacttgtgagcaaaaaggagaatggaaaacagaaggtaatgtaaaaatgacaaaagaagaacaaaaaggaggcaaggatggaggagaaacgaagctgaagaatgtctttaaaatgaagtattaacacatctgaatgctgtaaagtgtgacatttaatgaactatatattgattccgtaggtataaaacactagaaaaaaaatgaaatagacataaagcctgccttccatggtttgatgtcagagacagtgataaacaaacaaatataaaaccaaatgggaactattttagtaacagcacacatggacacacacccacatatgaattaaaggaactctcttatcaagctggaaggagcaaaacagtctaaaaagaatttttcttttttttttggccacttctgtaatcccagtgctttaggaggctgaggcgtgtagatcacatgaggccgggagttcgaggtcagcctggccaacctggtgaaaccctgtctctaatgaaaatacaaaaattagccaggtgtggtggcacgcacctgtagtcccaactacttgggagggtgaggcatgagaataacctgaacccaagaggtggaggttgcagtgagccaagatcatgtgactgcattccagcctgggcaacagagcaagactctgtctcaacaacaaaaaaaaagaatttgttaacaaaactaaaaactatcacatttttattatcatttatatggccaggtaactacacatgatagttcttgagttactgtagaattaatgttcagtgaatttcagcaataattctgctttttgatggaatctaacattatattcagaaattaagtgaagaaataaattacaatatgcatttacattactactaaaaacatgtgctacctatttatttatcagggaaatggatacctttcaacagaaggcatccaaataagataaaaatgtcttcaaggaccctgttgttaaacacatgtgctaatttcaaaataaatatctacaggaaagttgtctctcgtcttacctttgagcaagttacctttaacctgtatgtagcaagggtgtggtttttgctatcaatgtttcctcagtcactgcccagtaactgaaattctgtcattgtaaaaagtttacaaacagtaatatttgacaaacaaatagattgtacttaactacataaaccaaaccagccaaccttaccagctatgctaagagttgtgtgctgccgactctcaacctcacccacagaacaacagggacctgcccaagatggttcattgtttgcccagatcacagtgaggttcgtgactctattcctccctcaggtagcctcacatctggtcatctgcgcaagtttctttttctgtcaatgtactttcccttcttgatatggccaagatcaaccacaacgcaagttctattgaatctggctctgggagctgtctttgcagggctttccctggacacatggcactgttgctttcctgagtccagctgctgacgtgaacacccgagaaggtagcttgaccttactctgcagatgcatgaagggcgaagttgacaccttctgcccatttttgataaacaatgaaatattaaacattttttaactttgttgaaatttaaaatggatgtgcctaacaacgaattaaaataataattaaagtagtaattccgccctgtttatttttagactagtcatcctcactccctctatatacctatcactattctagaatttcatgagtctagacttcgcttctggcattggccccaaaatgccaaatttgaggagcacagataatttttttcacactatgaaaactgcaataagttctcttaatcatcgtccttctttaatgataatgtatctacaaaagataatatcttactaggaagttaggaggatcaaacaacataactatctacaagaacccagacactcagtggatttttgctggatttgaaatttattagtttctgtaactacttatttctttaaatgaagctttatgctaagtaatatgtgtataaatattataaaatgcataattattttaaatgtttatttaaatatgtaatagattaaatatgtaaaatatatacaatgcataataaatgcaatagaaatgctcatttaattttaaaaatagattgctgtttcccaaattaattgcaagtttttattaacagggcagatttagaaccatatttctagaatattagcgataacagcttgtaatttgttttagtactcttcaagtactttaatcttagcaatgtatgcaaatgatgtgaataaaacaatatgacattaacatgatttaaatatatttcacaaatcatagataccttgcacagtatttggtaaaaggacaactatgaatatacacagcagtgtatgtagaatcagacctgttcttaggaatttcttcagatctaattgtgttctgcaaaaatgcatgctgtgcttctggacattccgctgattttcaaaaatacatgttatgttatcactaatattttacaaggaaaattcgaccgaaaaagtaatatgaatcaaaaatctgaaagcaccgggtcacttaattcaacctcgtatctttccctactaatgttactgttcaatacaagtgcactttctggtgaatttccttcaccctttgaaactacattgagtgacgtaccatgttctcatcatcgtaccttcacacttgatgacactgggcagatgcattaaattatagagagggaggaaggagaaatggaaattggaactgctgatggtgagccagcttgatagggggccaccacattctaagatagtttttgtgtttgtttttgtgacagagtcttcctctgttgccaggctggagtgcagtggcatgatcttggctcactgcaacctctgcctcccaggttcaagtgactctcccgcctcagcctcccgagtagctgggattacaggtgaggcccaccacacccagctattttttgtatttttagtagagacgaggtttcaccatgttggccaggatggtcttgatctcttgacttcaggtgatccacccgccttggcctcccaaagtgttgggattataagtgtgagccactgtacccaaccctaagatagttttcaatgtgatatgataagcacacacacacacacacaaacccctaatctatctatattgatgtgtgtgtgtgtgtgtgtgtgtgtgagagagagagagagagagagagagagaatgagaaagtcatgcaacctctggaaacctccttgttttttaaattcagaaaaattaacttgcattatggctacgtaatgaaaaataattaatgtctctcctgattaacgaagatgaaagcaaacaatttttgacataggcatgaatggccaacaatacttcttgagaaggtaatctatttttggcaattgcattttctgtaggaaatgagagaggtcatttgaaaataagaccctagatatcgatatgaataaatccagtctgcttggcttttaacttctactttgtatcgttacatttgaaaagaggtagtacaatatctgatataagtggtgttgaaaccaccaatatggtttgctaatttcagtgggcattcttgctgtctcttcagtatctatttccctctttccatcatctttacaaaaccccagcttttccagtcactggactttggtgaaatgaaaccacaaatggtgagcacaaatgatgtctcaatacgttgttaggtaagccaagatctttcctttgttgtttacgccaatgttagttgtgctttctggtgcttgctattgaaaatacgacgagtggaactcgagcctggtaaatattactctgtggcttcactatgtgcttggttgctggcacgtcaatcctgctctcatacatccccccttttcctcatacaaaataacccgactttaaggcagaattaacaaaaaagaagcctagacctattgtgaaaaattagcatcctctgaaaagataaagaggtatttaccccatgttatctaaataattttaagaaagtcataaaacctctgataacctccattttctcctccgtaaggtgaggaaggtaactctgcagaaaaaaatgctcagaacaaatgttcagagtaagccctacctcgtgcttggtcactaggaagtgttgatttattttctttgctttcttgtgtttctgtggaaagcgttattaatacgcttgaaaggtttatgtcattttattggataaatttgttgttgttattttgagacagggtctcactctgtcacccaggctgaagtgctgtggggtgatctcagctcactgcaacctccgcctcctgggctcaagcaattctcatgcctcagcctcccaagtatctggataactgggactacaggcacacaccaccatgcctggctaaatttttgaattgtttttgtagagatgggatttcactatgttgcccaggctggtctcaaactcctggggctaaagcaatccacctgccttagcctcccaaagttctaggaatacaagcacaagccactgtgcttagactgaaaaatgctttttttgattagtcagaatgctgtatttaaattacttgttgtgtatctgtgtcctcaggtatgcatttagtaattttcaaatttcgatgatttgctatgaattttttttcataggaataatatttctatatgaaaaatagaataatatgaaagatacaggaaaaagaatgtttttcattagcatcagaaaaaaatccaattagaacagttgttttaaaaacagataagataatacataaatgtatgatgcagtctgaacactctaaggacataggcttcttaaaggtatttatttgtaattttggattttaggatattacagatcacaatagtgtacagcttcttaccttggaaaaatgatactctaattctatattatttgtccaatattacgttgctgtcttagcttgaaaaaatagtttaaatccttcagtaagtatatacgaagcaacattatatataagaatatgatttcacattaaactaaatacactgaaatgtttttatccaaagactactaaatagtgactacatattttcttaatattttaataactttggaacatttttagagaaatgtttctctcatttctttaggagcaataagtatcttcatatatatatatatatatatatatatatatatatatatagtcacacataaacacatccaaattatctcacttcttgtgaaatataagtattagaatagtccaatgtcattgtggcatagaatttagaaattaagagaagtttcaatttgtactattatttacatgtaacttatgaattagtatggtcagttctgatctgttaatgtttttacaaattttacttattctaagggtaatatgttcatgaaacaacttagtattaccatgaagagtctaatgatctcaatttccttttcagaaagatatgttaaaagtaattaagataaaaagaaaagcaaaatccaaagtacatttaatagtaaatgcatttccaactaggtacacaggcccatttggagtggttctccaagccgaaaccctcttgctctccttttctgagacctgtccttacatttacacactcattatatcctgaaggacacacttgattaagggaagtctatcagactccactcctgcacaagtagagtggacaacaggggaggctatcccatctctgtaagggattgtgccaggacagtaaattagcacctagaggcacgttctattgtgaatcactgttggtagtggagccagaaaacctttcatcagacagttgaggaaatgacgaggaacctcgcagagaaggcggccctggagtgtggggactcccagccagtccagtggctctgtttccttggggtcccaccaggggtcctgatttactggtagtaaatttcccatttttgcacaattagctcagacatacatctatgaaacttttctaggcactaaggctacaagaaaaaatggcagtaaaaataagaacaagtagacaattactccttggaatatgaatctgttcatttggatcactaattgtcaagaactttataggaaaggactaattagatatgtgagcagcatgtcatatacaagaagagtttttaatcaaaagatatttatcacagtgaaatctgagaaaatattcagtatcactgactgagtattgctcaagtgaatggttgtacatcagtatgatggcattttacaatttttgtaagtttagaagaacatttaaaaatccagggaattttgtacaagtgaaaaagcatattacataaaatgataatgatttcatatacacacgtcaatagacaaggaatgcaaaaaccttaaataccataaggttatttatgaataaggacacgagaagttcagtggattttcttctttatacttcggacaactttctacaataagtgtgcattgatttttaatcgtgcaaaaaataggagcgcagacttggtaaaaatcggttttctgtttgtccaacaacatataacctaccttcttgattctcaaaatgaactctatgaagaaacttactcatcaaatttcaatactttccaaaccttaaagctcgcatcttgctttttgaaatggataattttttggtttgttttgagacggggtcttgctggatcaccccggctggagagagatttactttcaaataaatctctgttttcaaaaaaacatagagattttcaaatctaggctttgccactttcatactgggtgctttggccctgttagcctgtctgaaccctcttttgaaaattaggaatgatattaattgaatgtaaggattataaggcaattaagtgaaataatacatgtgaaacatcatacatacgctttccctgtctcagggaatgaaggatagctgtaaaaatattttgaactataaataattaatcataaatttcaactgatttgattttgcaattttaattattgagaacagtaagtaaaaaagagatagcttattcatgttaaagaatataatagacaaacctgtgctactctttcttcttctactaatcaatcacttactcaacaaaactgtaaaattcactaataatcttgccttttacatttgctcccaattgctgaaatggaagcctattttaatgatagtaagaaaaaaagtgacactaacatagaacaacgggactcagaaatcaaatatagcagcttccaacatgattcttctgacccttacccagttatcgagcaactccaacatatttactgccttctattattatgaagattcaactcataaaggcaatggaaataatcattgtatgttgtaaacaaacataatggacaagaaagggcacaaggaatctcaaatgagaataatggccgtaaacaaagtgctgcatgggagaaaataaacacaagtacaggtctacttaccacatgcatcatatcaaaaacttaatcatggccaggcgtgttggctcatgcctgtaatcccagcactttgggaggctgaggcaggcagatcaccttaggtcaggagttcgagaccagcctggccaacatggcaaaaccccatctctactaaaaatacaaaatactagctgagtgtggtggcacgtgcctgtaatcccagctacccgggaggctgaggcaggagaatcgcttagaactcaggaggcggaggttgcagtgagtcgagatcacaccactgcactgcagcctgggtgacagaatgagactccttctttaaaagaaaaaaagaaagaaagaaagaaagaaagaaaaacgtaagcacaccatcacaccatgtacttcacagagaaacttcacaggaaacaaaatcaattaaatttgaaaattgagtacaaggaagtgaaacggtaaaataaattctgaacattctttttaagaaattacgtttcaaatctgttggtgagaaaaaaatatttattaggtcggtgcaaaagtaattggagtttttgccattactttcaatttgccatgactcatatttataggtttgctaaaagagaggttgatttccctttgggccatggccaccttgattctcaaaatgaactctatgaagaaacttactggatcatctttaaaagcactgacgttgttataaacacaaataaaaacggcaaagactgctgattttaaaaccttattttctcaatttaattccacagttgttttatgaagggaggtaattggcagttttatcttgtcttggatgactctggttgtgtcattcactttttcgttacagaagctgtgtcagaaaatttgagatgccaaattatgtgctattccctacactcaagaagagaagcagtgcaaggaacgtacccttctttcacctttggagttagtaaggcttttctttcggagctgtcttggattttcctcttgccaagcacgagagtgaaggaatgctttcttttcaacggcccattaaaacgaacatatatgcaatcatgccattcctgattgattggattcaggacaccctaaccctaaatatggcactctgacatttgagaaaactgcagaggcaggaaggccactgtcacctgcccttgctcttctcccccgatgtaggccataagtaggccttgtgcgagagggggcctccccatacctagagaaaagaaataacctgtctctgaaaacacgggagcacagcgaagaacctgagcaaacagcccctgctacatccctgctgatttataagcattagatcacaagtccttcgtccagtctcacgtcccgacgtctggctacctcttcatcaaagccataagtgaaatatacaagttgacctgttgctctgggttttcatttccttacgaaggctcatattacataaatttgtaggcttttaactattttgtcatgggggcctcagccatgaacctaagatcagaagaaaagatccttctccttcgcttcagagacccatttgaaaggttagaaccatgaaagcctcaagatgcaatgagctgcagggagagaaggaaggaggcaaaccctgagcaggcgatggcccaagaccagacagaggtggatttcctggtgctggaagaatggagacgcacttggaagtggaggagacacgtctccagtcctgaacggcacacagggaggtggcaagaccactcatgatgctggcacatggcaccagccagcgaactccatgcacccatggcagatgtcttctgaggctgagcttcaggcgagccggcccctgtgcaggctaactctgtggtcgataaaagctgccatagcacacagaccatgggccagggaagagcaccgctgccagccagagaggcaggggtcttagtgtgagcatcagagccaaggaagaggctttctgatgactgcatctccaggcccctggtagccacaggatgctggcactatcagatgaaggaggacaaggagccttactgaggacagaggatgatgtgtgaagacagatgcatagatggagaagagccagatcgaacaggactaaagtacattaagtaacgtgatatagcttacaaatgtcataaaaatacgtactagagtggaaagaaaatgaaaaactttcaatgttgataatttagtcaacactaagtccacctgatcaatttagaagcaaattgtagaagagatgccagaagacacgatctctgggaaggtttcttggtttatttgggaaataagaaattgcagaaattttataggagcatcacaagaatttaacaagaaaggtagttactctgtattttcccggtgaattatgaagtgttactcacagctaaatccgtgaaggcttaaaatgagctgccgctgtttttgatctttcaagatagctaaacagaaagagtcacctcccctttccacactaggttcttcttctatttctggttccctccttttgtcaccctccttcactaatgatttcagggaatgcatgcacagacagatacacacaaacacacatacatacatacacacacacacacacacacacacactcatctcctgcatgcctgtgtcaggagccaatctggataacgacatgtcatatgtgaattgtgatggttgatctttcacatcctagacatttaactctatctgtagcatctttcactgcttcttgattctatctggtgtgtatttcaagtacctacactgttccatttttagatgatatctaattgattgccctatggctcagttcactctcttacccagttttaaagctttctacattcatgtagaaattggaggattgtatgaggtatttgattctaaggttctaaggtatttgattctaggagttttttgtgagtgtacgagagtcaagattctttgggttttaaatatcaatccttatatcttacgtcttagcttcagatacaaatttcaatatgtatattgatctaacataatgaatctatgtcaaaaaactgaaaaagcatgggcttgggatgcaggtcaagtcaccagaactaaaaagctgtaagtgcccaaaataatggactatcaggttgagcgtggcctaattaatgctctgacacctgctataccaaaccaagaagggtgagccatctccccgggtccctgctgccagcaggcgtaagcacttgtatggtgataataagcaaaatgcattgaacttcattagaataccaaggaaaattctccaaaatggctcttaattaaatggtctcccactaagcagcagtcagagagtgaacactccctatattttattcaactgaatgtcatgttgacttcagagccatttgggggggtctttacctaagaacaatgcttcctatttacatagttattttcatatgagattcgtgtagcactccacaaatgtcatctcattacctcatgcagtgagtcaattacagcactgcggagataacccaagactcaaaactccccgtgctttgtgagaacagctctgtaaacatcgcaagtggtctgatgtgatgcctgttgtagacaggggaaatgaagattgacataaattctataactcacgtcagtgtgctaacagcacaagaatgtgattgtccattaaagcattcactttcttatttttcaagaaatggccattttccaattctggtatcaattacccagaggaagttatagaactaaattgtctgttcatatgaatacaatcttctgctgtccacataataacttgctttattcaagagtgaatacatttgcacctgtattgataaatttgttctcaacccaacaggtaacttagtgatcatataatgcctgaattcagcaaaggtaacaggccccaaatctggaaatttcaataggtttattcttttgtgttcagatcctactgtgaggtgattttgcatgtattaaaccaagcgtaacagtatggaaacaaagttcaccagctccctaattttggatatgtaggaaggtatatttgggttttgctagtcaaatacttgatcttcataatgctcatttccagaatgattttttccacattgtagagtcatatttgtcatctaaaattgtctatatgtttcataagaaataagaaaacatgatttaatgggtatgcatttatattagaaggatttgtggggaaaaaagggttttctttatgacgtatttcttggataacttctcagagaagttttaaagtatcataaggattattaagaatattcaagttacaatacatttttgaaaagctgaataacacagttcagtaagatcttttctagttcagaggacagaaaaggtgtaagacaaagactgtatctgaggcacccaagtaatcttttttttgcgaaatgcctttgctttggttcctggccaaatgaactgcagatcgtctttggctgcagttatttctgtacctgatgacctcttctattaaaatgatggtggtttaggctaactccatatggaatttatctatggggtcacaaaagtccctttctggtgcctttaatactagactcattgtatgtttatatgaatgattaaaactactatggaggtaagaaggaaagcctgttttaatacacagctacaaatgttatcactttctcccctgcaggaagtgggctgtattactgccgtaagcgtagtgctaaagaatcgtaatttaaaaataaataaataaagcaatgggtttagagaagagaatgggtttgaagcattggtaacattatacggagaagagttacaaagccttctataatttgtttttctatttcaacaaattcatgatattgtgaaagacttattacaatgctcataatttaagattaccctcacagtgttatttacatgtcagtgcagttttttctctttgcatgattttaggctgtgaaaatttctagaccaacaagtcttaatgaaatttcccttgctttcaatcctgaagaggacgacctaacagtttagtgactaatttaagtaaaaagcagtggaaaaaattaaaacagctacttcccttcacctatagttttgaatgagtaaatgggggaatgttgctaacacattcaaaatttcagaatattcaacagccaaaaaagaagaaagttgcagaatttaaggaaatatcaaaatttgtattttaaaagttttactgggtaatataaattatgatatttgagtggtatttcctggaaaatctatctgtcatgacacatcgcacttcagaaaaaggatgaattctaaaatattatattttagcaaaaagcatgcttgttcctcagtcatgtgaatacagttattcacacaatccttttgtgaaataatctcagcatttcagcaggattttatgaattgaatcattatactgcagttgtttcacagggatctgaaatcttgatattattattttatttttgagacagaatctcactctgtcaccaggctggagttcactggtgcgatctcggctcactgcaacctcttcctgccgggttcaagcaattctgctgcctcagcctcctgagcagctgggactataggtgcatgtcaccatgcccggctaatttttctatttttagtagaggtggggtttcaccatgttggccaggctggtcttgctctcttgagctcatgatctgcctgccgtggcctcccaaagtgctgggattacaggcatgagccaccgtgactggccaaaattatttttacgccgtgctttgaaacatgcacctttaaaatggtacctgggtatttttaaatggattttccccatctttatgacagaatgaaatagcagaggacattttaactgcaagggaaggaagtgaaggaatcaaagaatgttacccaaagaaactgcaaatcagcagcaaactcctagggatgggctggtgagcagaaattaaatgggaaagccaacctgtcagcagaatgaataggtggagagtgtgaatttcagctgtaagccttagtttaattttctttcctgataacctctaccacaggctgttatttcaaagtcactgggcccactcacctagatagacacctattactaaagcaaccaccttcttgcaacatattgagtaattatattcatcttgataacatccttcttgacaattttatcattgatggaactctccgcctgtgaaggttatttgtatttttccccgcttctgaccttatgtcccatgaaaagggttctatagagcaaataccatttgttatgttatcttgggaaatggccacacttctccttccaggaactgtggcaaaaattattttctgcactccatctatgcctgtcatgtctgccttgatggagtgaaaggaacatctacctgcctgccttaactacgcttattttcaacccaatttcctgaaggtccaggtacactacattgggaatctgtagctatctagcccagcagtggaatgctaaattttaacctttaaatcattgttcaaatctaaccacagcagataaagtcgaagaggttttaatgggccagtgttttcacacttctcaaacacactcctgtgatttggcaggtgccatgaactcagtttggggacattttctcctcactccctataactagtttatggcaaataaactgcagctctcgttttatgagctctcctctgtctcaatccatcttcagtgccctcttgtacagcagagctcagtcctactatcctgaattatgataatgcggggcacacaacctaccctacaaatgggacttgctgtatgctgaatacccctggcaccctggtactcagcccaggggctccacctgctgaaaacctgccccctgtcccttctggaaaccagcagcccctggcctgacctcacagggaaatcatggctacttaccgacctcactcaagtcctctgcaagccactcccaacagtcaagtcttaagatgtacgttttcttagttatgagaaagggagaaactcattaaaggaaatttaaaaacaaaaaaagaatgtattaaaaacaaagtaaaacaacaaaacgaaacaaaaaactgaggttctgcttcccaaacacatatcccggttgcttttcgtggccaggatttttaaagagtagaccgtccttgaagctcctggctatggtcgaccacatgggagttgaaggggttgataaaaagaaaatatctaagacataatgtctgagttaaggaacaaggagcagccacatgaagagggccgggaagactgtgagccatgggtgagagcgtttccaaggattctgcaggcaaagccatgtggggtccgtgaggctgcagcagacaaggactgaccaactgtcctggtttgccgatggtcaccattttataactgaaaagtcctgcagcctgcaaaccccccgataacgtgcaaatcaggatgatctcacatcatgcctaattctagttcctattgtttcttatacgggccctccctggaattctcaaatttttaaatttctaccatagcagtcatgaactactttctcatcatactgtgaggtgctagacaagactctatggtattcttctgacttaattgcttaaacactgaccagattcccagttttgcctcattgacagtgggccaatccccaagaggtcacctgccttatttctgccatggttcctggaacaaagctcatcatgggaaaacgtcaactcctgtccagaggccaatcttctctgggtgctgtgatactgactacactacacagctttcttctccacatcctctcggaagttcccagggcccactggaatcttctgagtgtcagggttgctctcccttcaagctcctcttaattccttaatttggccagtgtttcagtaatgaaatgtgagacaccatgctcaccccttgggtgacggccatgagcaagaaatgttctctgccaataacaagttcaaggttcatggagaggtagatagggaagaaggaatagcaaaaacatcataactttgtataatgtgatacagggatgcatggtgcatcttatgtgagtagagtggagaaaacagctggatggtaggaggacttcctggaggtgtgttctggctgtgtcagcctcaatattccaaacttgtttagctcttgaatctcattcttctctaactatgtggggacattagtcctatactgttcctcttttttcacttgagtctgcttctttaattttacatttttttattttaaatatgcatcaatcaaaacagcccattaggcagagtggtattgaggtaaaacaacgggatttttctccttccattttttcaaatgggtgatctttcattttagtattcattttctcaaaacttattctttcagagatgaggtctccctacgcttcccaggctggagtacactgactattcatagatgtgatcatagctcactacagccccaaattcctaggctcaagccattctcctgcctcagcctcctgagtagctgggaccacaggtgtgcacctccatgcctggccaggtcctattctttttaactcttctattttctaggttttcttttaacactaatatcacagtttgcagttattttcaaaggtcacaaatggtttctttattgtccatgtcatcacatacttcaaattcagggagactctgtgaaggaaagtcaatctcgggacccccaaatcactaagccaaagggaaaagtcaagctgggaactgcttagggcaaacctgcctcccatcctattccaaaaaaagacagcttctaagataaaaattgctacgtacctccctcacgatttgtccacgggaatttccttgtggacaaaagacagagctcaaagccttccttctgctctctgaaataaatgcgtatctgattgcttcctttgaaaagactaatcagaaactcaaaagaatgtaacagcttgtctcctatctacctatgacatggaagccccctccctgcttgaagttgtcctgcctttctggaccaaaccaaaaaccaaagtacttcttttttttattttttttatttttttgagacggagtctcgctctgtcgcccaggctagagtgcagtcgtgtgatcttgggtcactgcaacccctgcctcccggattcaagcgattctcctgcctcagccttccaagtagctggggctatctatatgcatgtgtcaccatgccaggctaattttttttgggggggtatttttagtagagacggggtttcaccatattagccaggatcgtcttgatctcctgacctcatgacctgcccacctcagccttccaaagtactaggattacagccgtgagtcaccgcgcccagcccaatgtacttcctagatacattgattgatgtctcatgtttccctacaatgtgtaacgtcaagctgtgcccaaccaccttgggcacatgtcatcaggacttcctgaggctgtgtcacgggactgcgcgtccttaaccttggcaaaataaactttctaaattgaccgagacctgtctcagatattctcgtttcatagctctcagccaaattttcatctttcagacattttactccaaaatccaatctatagccaaggaaacttctctaaagcactatgaacatacaggttctaggttcttgtacctttcacagcttacattaaaatacgaaggtattaaaataccacgtgattaagctccctttacttatctgtcatcttcccccttcccccttatgggaatgttcttaactaaccaagctggccaactcatcatcacttaagcctggggtctgaacttcgaccaccgtgacttatcaaatactcatttttgtacatggaatacacatactctttatttctcgaagttatttttgtcatttcccttcctatggaaagcttgcctgtcttctgaaggtttccctgagcactgcagttctaccaaaacctctctctctgaccctgtacagcctttatagtctgcactcctggcattgaaataacttcattcagcctacatccatgcttgagagtgaggactggcccctgttcacatgtgttatttacacgcatattactgaatttgaaaattgtaattagtcgcggatgaccagtgacatttgttaagatgttatgtggactcagttgttgcctctcctttatgatttatctcgataccctaaaataagttaaacgatttcattttttacagcagttttaagttcacagaaaaatgaagaggaagatacagaggtttctcatctgtcccctatcccccccaccacacagccttccccattctcaacatacgccaccaaagagagaggtgcatttgttagaacctatagacctaggttgatacatcattatcactcaaaggtcagtttacttcaggatttaccgttggtattttatgttctatgggtttagacaaatttattgtgatatgtatccccgatatagtatcatacagcctctagaatatttttacctgggcaatttaattttaaaataataaacagaggatcatctagactggtggcccaccactcttttgaacatgagaaaccctatgtatttgccaaatttaataacatttaaaattaccataggatctacatgaaagccggctgtggttagagacttgggttccggagggagaatgcctgtgtttaatcctggcttactgcacattagtcaggagactttgaggaacttacagaatctctatcttataaacatggattttaacggtatctggttcatgatcaatcaacagccttcaacaaggataatgccttgaagaattcagagaacagtttttgttacatgaaaatcattcaataaatgttttaaagccagtgcacatgtatgcatataggatatgttattttcagtctatggacatgacagatatgatagatacacataagaattcaatagttgcagaaaatcaaaagtactctgtgtccatttattgggatatttggtagcaataactttcaaagactcttagattattgtttagttcatctactataaactaaggcctacctctatagtatgaagaattttaactctttatcactgaaacatcctgcttctcctatttctctaaatcagagtcaattacatttgtttattaaagggaacagagggacgggaacttcagagatctgtagaggaaaacaggtcttaaacattatcctaccctggaagcccctaatatttggggaggctacagaatgatataggaataacagttaatttcccccgtattacccagatttattatccaaacaacgtatttcatacttttttcatttatctggtttctcttttattgttgtctttatccacagagaaggtatgacccatgaaggcaaggactttatctatttcactagtacccagaataatgcccagcacccaacatgggtgtccaatgactgaaggactgcatcagtgaatgtatgtttacacaaatttattaaatttcattccacaaaaatcacaaaatgtaagtagtgacagagctgtaaagctcttgaaactatgaattcaaaaaatcagggccaggttcagtggctcattcctgtaatcccagcactttaggaggccgagctgggtagatcatgaggtcagcagttcaagaccagcctgacgaacatggtgaaaccctgtctctactaaaaatacaaaaattatctgggcgtggtggtgcgtgcctgtaatcccagctactcaggaggctgacgcaggagaattgcttgaacccaggagggggaggttgcagtgagccgagatcgcgccactgcactacagcctgggcaacagaatgagactcagtctcaaaaaaataataataaaaataaaaaaatcagaaaaaatcattctacttatttttgattctagaacagaaccttgctgtaaaggcccttagaacatatagcaagacaagatgaaaacaagaggaccacctggacttagttatcattgcccttctcaccaaaagttgcattctgagaaatatttatgatgctttcatttctgcttgattttaagtggctactttacatgctagcaaattagtgtatttgggcatgctcatatttgcttacagaggcaagttcaatacgtaaaaaatttggcagctattaggtataacatattcctttggctttaggtggaattctatgtcctgtattgtttactcaattggggaatgtcgacgatagcaaaacaattgtagtattcaagtgactattgactagagttcagtcaataagttcaacattataaggccaaaggcaattaagcagggactgatattagttgctggttacacgatttccctggacagttttaattactggacatgagagttctgaaatatgtggattagttaataactcaaagtaaaaaaaggaaagcattactcatttggcattacaaactgtgataaaatacacacacattctcattctgtaagccataaacactaagccataatttcaaaattagtaaactgcttgatatttgtaatatcttacataatatgtaaaggaccatttttagtttaagaataacacagactgccaaccacgtttaaaacattggtcctgtcaagacaaatagtgatgcttaaatgtaagtattcattaccatctagatcttacatcgaacacttaatatgtccatagagaaataagattatataattggaagggttcatcaaaatattaagtgaagttcccaaacatgtcaaatataaatgaattcccaaatctgtgaacacttttgctttgaatactgggttttttttttttttttggaattgaacataatattatatgccacaactttctgcaccttcatctgtattaatgtaattaagtaagccctggttcttcatcagtattaaacattttagtcaacatgaagagctgtgtcgaatgctgtataaaggctcgtttcaaatgagtttttgatgaacaacggctcatggaacttaaagatgatgtcccaaaacagataaactggtgaatgcatcagagaaagaaggcaaaggtttctgaggacctccaaagctctgttctgcataaaacaggcttggtgtgattcgcaaactttcatgcttatgttctcataaggcagttgggatagaaaaccagctcaggtgtgtgttaggcctaaagaagtccacctacagggaagtttatttttgagacagggacagatttaaagataactgtttttatacaatggaaatgatagaaatttttttttttttggttctaaggagcaggaagtttaataggcaagaaggaagggagaagacaggaagacagaaggaagaagccctcctccctctgtacgggggagcattttccttccaccttctcccttccttcttacctactaaactctctgccccttaaaaaaaaaaattccaccatataaaaacaattcttgcttcttataacctgagactgatttagctttcaaccaggaaaatcctaaccaatagggttacttcaatacattttggcaatccaactcttaaacatgtgcataccctcccaacacacacacacacacacacacacacacacacacacaccaatttcaccgtcgaacgaacacgtcaggattatcactgccttgccatggtcatgctttgtgtctccactatctatgcctttcattaacttaaagcttgtccacagttttgggaaaaaatgtgctttgacgtagatgtcctgctagagtttgaggtcttcgctttctcattactcaatcatttacttggatgatgccagatttggaacaattaattccgtgtttcactctggacctctcaaagcctgctaagtatgtaaagttaatactcaaatgttttcctttgcttaaaggataactttcaaagagtttattcgcaattacactcctccttctataccaacagtacctctctgtttctagcagagtgctttacttctcttaatactgcataagaaaattgtttccaaaccttactcatctgagagtacccacaactcacaccttgtactgatcactctatcatcttttaatgcctgttctattgtcaagacccaggttcaatgtcatattctataaagttttccccaaatccatctgtgctaatgagaaagtcaaagctgtacatcgaacactcagcttatgttcttttctgtcttattaactcttctgtgtggatcctttctttctaatttaaccaataagaatataaacatcagagctcttggcatttatttgttgagatatgaaaccacaagccagataaaaatttagaacattttaaacaatgtcatcatccgtacatatgatttttaaaaatctcccagacaatttatgaggtgttaatttctactgtgattcatggaaagcagtgtttcatggttagtttgtcaggaaaggatatggtgcttgaactcacctaaagaatgaacaggtcttgccgatgcagagagtacaagtgagattgacaatactgcgagcaagaacaagagacaaagtttttcagatataatggaatcctttggaagattaaaatccctatctggatacacaagctaggattagaataagacaggcttggattctgtaattctctctcattataatacatggcttcaatttcttcatctcgctaatcttagaaagcttcacaaagagccatgaaggagaaaccactgagtccttttcctaatgagatgaaggagctcaccacagagtcatttttctaataagtggtgaactttttgtttaatttttatttttaactgacctttcaagacctattcagttcatgtttatgaaacaaaatcttgaaatcttagaaaaataataaaaccaagcaaaggaatcaaagaaagaacctcttgttttctagcaggaaaggtgaaactcaaattttgtgagtattataaaccaacgtgaatgttttaaaggattattttatcattaatctattatttataatacatattataaaaatattatttgttatcaacctgatcatttgctatactttgcttttacaagttttatacttataaacaggtaggtttactttgtgacacctcattgcttggaaacaacctgcatattctttaaatttaaaactataaaactatgcatgttacaatgaaaaggtgtctaatagagagacaagatatttcaaaggatgaaaaacttaagtgtgatttgcttaaggtctcaattagtgaaataattgggtatcattaacagaaacaactgactcaatctatcacaaaaaatgaaagtaactggacacataaagagaatatactatattctacctgtatatgatattcagaaactcacaaaattatatccataaagtcagcacattttattatatgcaacttacgctgcaataaaaatggttaacaaataaagggaaaggatatttctgtagaacggattagagcatgaaaaaaaggtaacagcaagaataggaagaaaggatgaagaacaatagacctacagtgctcctgttacatggagaacaaaaccagaagatttcagaggagcagagaacactgtggaaggtatcaagtaaccttcggtctcctgcatgtacatacttctaataataagtgagtttaggagctggggtttatcggtgaacgggaggcaaactagtgaacaaagtatgagtacataaaacatctgatagatgagttttattgaaattaagggtagagttaggatgaaaggtgaatgttgcaactccttcaaaaattcgttttttacacaaagctgtgggctcccccacagctaggggagagtccgtccgctgtgtgcccctagttcccgactgttctttgctcagagctctctcatcacttctcaggtctgcttccacctggcaaataccaatgataagtcaacttcgaaggctgcttttgagccatccttcctttgatgctttttttttttttaactctgcttaagaacttactactcctttgtttatcttgccaggcacctaacagagcacccaggatgcgttcccttactttgtcctgtgcctgaaccacagctggagagtctgatggggaggggccatgcacagtactcctcctccccgaccccagcacagaacacccaggccgcctcccagagggactgggaagcatcaatggtgggcatgggagggagcaatacagtactgattctcatttgagaatagctgttgatcacaagactctcaggttctgttccacagctgttgacagtatacaggagtttgaagtatgctaggtccacacatctcctctgtcaaacctttctccttaaaaaaaaaagtagagtggtgacaaatcataacattcctctttttctaaacacttttaagtgttactttcttcaaacaagttttagaaaaccttgggtggaagatttaatgaagatgcataatctcatatttactctggatgaagaatcccatgcaactccattaagaatcaacagatgcatcaatgatagactggataaagaacatgtggcacacgtacactgtggaatactatgcagccataaaaaggaatgagatcatgtcctttgcaggggcatggatggagctggaagccattatcctcagcaaactaactcaggaacagaaaaccaaacaccgcatcttctcacttataagtgggagctgaacaatgagaacacatggacacaggaaagggaacaacacatactggagcctgtcagggatgaggtgggcgaaggtagagcactaggaaaaatagctaatgaatgctgggcttaatacctaggtgatgggttgacaggtgcagcaaaccactatggtacatgtttacctttggaacaaacctgtgcatgtacccaataacttaaaataaaaataaaaataaaaaatcaacaggttgccttgcttctgagacctgcatggccatgggcctctgactggattaggaatctttgctaaactgaccctcctgctctccgaagtagcaattccaagaattgacttttgaacaacagttttgaaaacaaccttgagtaagatgacatcttgaagttcactctggaacattctaaatagtccccttcagtcaaaatgttgctgctgtttttaataacagggaaaataaaaatatttaccagcttaaaaaataaaaagacattcatgaattataaatcatctgaaaggttccgtaggagaacacactgccctttacaaaatgaacctcattaccagtccagaacacactgagaatcacaaataaacgtttccaagaaacatttttaataaccactaatacaaccgtatttctattgctaagtacaaaaattctaccgtgtagagtttcttgtctattctgtggaaggaaagaaagagcatccttttgcgggaaaatgttaggtagcaaaataaataataatagcgggattcatcatatcttctctttgtcttagttctttaatggataacattattaaagaaaattatttaaaagtctctaaaaagttaattatgaattttcatcatagactgtagacttctaaaatgacaaaattacccttagggtctcaaaatatacttttaaaagtaggtactctcaaaaaagaatgattatttaaaatgctgaaaagaatctggcgatatttttatttataatgttcacagtttagggttaagcaaattattttataccatacataatttgcatttgagtaatgtggcatattatataatatttaattagatgcaatatctggcagaaaaaagtatggatctccatttaaggagattcaaattttctttacaaaattcagtggatgatgctatagctcatacagtgtaaaccaacggttctcaaccatggcaatgatggtggaagtgtgtggaaaaattagtagggagtgtagataatcagaatcttctcagaaagtttttcaaatatacgtcgctccacggacctttctgcaaagatctccctttctctactgacagaagaaatagcgatggactcaacatcatttctgtcacctgtaatttcgtacttagaacatgcatgaatagcctatcttgcaatcaccaatgtatggataatttgtaattatttaaaacatgtatacttcatgaaagttataaaattgatacagtttttatcaattttgcaaggaattagatatacagtataattatgaaaagtaatgaaaacactttggtgttaaggaaatatttcaatttttcccaaactggggatttctaaatatttcaagaaaagtaatctagaagacaaatagtagttgacttagcattgcctgcgaccttgaattaaaagattttctttaaaaaaaatcttaaagtgattttactaaaatccagagtacagatacagaaaagcattgggatacgaagagacccgatcatcaagctcaacagtccccagcatttttggcaccagggaccagttctctggcagacaatttttccatggacagcagggttgggggacggttttgggatgaaactgttccacctcagatcatcaggcattagattctcacaagtagcacacaacctagatccctcacacatgcagttcacagtaggtttcatgctatgagaatctaatgccgatgccgatgtgagacgaggcggatctcaggcagtaatgctggttccctggctgctcacctccagctacgcagactggttcctaacaggccaacgtctgatacaggccttcatccaaggcaggtggggacccgtgatctagctaaatactcaagccccagtctctattaacacgtaagtcaaatttaatacgctggtagcaccttacattgtcatttaagtcatttgcatttgtaatccctgtgctatccccaagtatacttggaaaacagagacttttacttattttatattttattcagcattgagtgtcttactgtactcacaaatcagttgtctgggacttgattacagtacttattgcaatcagtaagaatctcagttgtttatttacttatctattgtttatgtggtgtctggcagagactaggatttcaataaatatttgcttgactgaaattcaatttcagaaatttgaatttttgtagtactattttctcccttcctaatctgatgtttcagtgccattatacagaaattgactgcttttgattacagaacattttcaaccaaacataaccacatcgatcaactctgtattttctaattctgtacatttcttcttttaaccattcttaccttctactggtcatttaaagaaaaccaatttttccaaaagtattttgtttgtttgcttgtgtgcttgcttaatggaatgcctgtcctttcaaatgttctggatatgtgtgagttgtcgaggcaggagaaagggagtggcagttgtcctaaccagcctgagtgagcttggaagtgcttcctactgcatctctatgctgatggggcaaaacaccctagagaaggctccaaaaaccctatggtaaagaaaactgcttaattttgttttaataaagtcttagtaaactccatgggtagtatggtttggctctgtgtccaaatctaacttccaattgtaatccctacacgtgttgaggaagcgtcctgtaattttggatcatggtagttatttttcccatgctgttctcatgctagtgggtgagttctcatcagatatgatggttttataagtgtttgacagttcctccttcaccctctgtctctcctgccaccttgtgaagaaggttcctccttccccttcaccataattgtaagtttcctgaggccttcccacccatgaagaactgtgagtcaattagacctccttcttttaaaaatttcccagtctctggtattttttttatagcagtgtgaaaattgagtaatacaatgggtattaaaaataacacatagttctatgttctagagactccattctaagaacatactttctggaaaccatgatgtaagacaacccagcgtctatcaagaacatgcatagtcatccaaagacacaaaaccctaatccccagtcgcctgtcattcaaaagtgtgctcacatagtcttcctgctgtgtacaattgcaattatcctctccaagaaaaggaaacgcgcacagcctttatctctttacccctagattctactacggcatatttcttttttgactgaaaggcaggagtacttattgaacagatatttttgactcatcttatattctgatactgcggcatgaacgaagctcttctttccggcccttgtatctcgtgtcatatgaatatcactcttttctgagtgtctctttaacgtctgaaaccatttggacattacaaatataatctaactaatattttaaaatatgactgaataattgataacattctatcttacagagtgtctagttctgggagaaagattattctatgagccagctgcatctgagtgtcctgggggcactttaaaatatacagattctttcatttgactattggaaaaatagtttaactaggtctattgttggtgctgcttatttgataaagaaatctcttcaacaaacctctggataaatgcttaggatgacctttatgaactgtaatttttttcaatattttaaaaataaacagtaatgtatttaaaatatgtaattttttatatatacacaatacatgatacataaaattttaacatataatatataaaaactatatattttcatgtcctatatattacatattttatattaaaattttatgtatttatatactgtacatatatattttttcaatatattttttccaaaatatttctaatatctggcaattgctaattgtttgaaagtcccacaacatatctgacctaaaatttctcttttaattccctgtccattaccttacatgtaccccatgaaataagaaataaataaaatacttttccacataacccttcaaattattatactccatactgaattagactacgttatctgcagacaaaaagtgtataatgaaattgctatagcataacagatgatatgaccaatgagctcagtaattcacaaatgtctctataatacaaaaggggaaagtaaatatagcattaaatacttttattcacaaatcaacatatttcataaacaaatatatttaactcggcatcatttaagtcaacttatgccatgtttaaattagttcaactatttaggaagtgtctagttagtataaacagtattttaggagtgaagaaataaagataaacaatttctagtcatcaatgtggctgaagttaataatggcatgaaagtccaaaaaacaaaagacagagatgtggccggggaggcagagggtcagagagaagggctctcactcagaggcaacagaagacgcatttgagaaagacagtgcttgacttgtgtcagataaacacagttgacccgattgagagaatgggggaaacttcttacaagtagcaagggcagttcagtgaaatgagaaaggcaaggcgaaaagcttctgattcatgaaactatgagtaatttgctcatctgaagcttggcagaggttggggttagagtgacagggacaaagtcatgaaggacctttctcttgaagtttggacaatgtcattgacagatctaacttaaggacttaaggtgatcagatctgagattaggaaagatcaccctggcagctgtgtggaaaatgaagcagatactaaatacagccagaaagctgttacagtgatctgggtgaaaataataaaataataacttcctcttattgaatagttattgcactctagacactgttgttaaaggctttctatacattatctcattttcattcttacaacggtcctaggaggtaaggaatattaggtctttaaacatgaggaaattgaagcttggagaagttaaattaatttcttcaagatcacaaaggagagctgggacattattcaaagaaaatctagatttccaaaagcatgtttttaatcgtgctgggaaacaaagacaagatgatcacatagtgcaggaatgctgatggtggaaggtcagattaacagaaacgcctgaatttttagaggatttaggaagggaaatcagcgtaggagtccgtgaacagttaaatggagaggccgcttgtagaacagatgctaactaaattcccaggtttttactgcaaacgagcaacaagagaggggaaagagccagccatgatggctcactcctgtaatcccagcactttgggaggccgaggcgggcggatcacctgaggtcaggagttccagaccagcctgcccaacatggtcaaaccccatctctactaaaaatacaaaaattagccgggcgtcgtggcaggcgcctgtaatcccagctactcgggaggctgaagcagaagaatcgcttgaactcgggagggagaggttgcagtgaaccaagatcgcaccattgcactccagcctggggacaagagcaagactttgtttcaaaaaaaaaaaaaaaaaaaaaaaaaaaaaaaaaaaaaaaaaaagaggggaaagaagtttccgtgtgattattgtttttaagacacatctcactctgtcacccaggctagtgcagtgacatgaacatagctcactgcagcctcaaactccttggctcaagtgatcctactacctcagcctctgcagtagctgggagaacaggcatctgccaatacactggctaattttttgtatttttttttatttttttgtagagatggagttttgctatgtcgaccaggctggtctgaatctccacaaacaatccacctacctgggccttctaaagtgctgagattacaggcatgagccactgcatctggccttcagtgtgactcttgattcccttcagaatataaatcattgtcatttacatagacatgcattttctctctccctaggtggaatgtaagctccgtgaacatttagacaacatctgtcttgttcattattctgttcagtgcctaaaactgaatatgtatctggtaaaaagtaaaactgctaatagtttcactaaagaaacaaatataggaacaatgaaaaagtaatggttaccatcctgataagtcacaataactcaatctgtagtaattctcttaaaaatgaaggtaaattaaaggaaggtgattgccaggtaatattgtatctttgagtcacttaaactaggtagccaatcagaaagagttcattgaatggttaaatttctagtgttttctgtcatcattatagacaccatcctaaccagattcatttttttttttaagagaaagatttcccaactgtggcggtggaattgtgaccccctaaagattcatatataaagtcctaacccccagcatgggactatatttggagagaagattttgtaatagatgtttaaattaaaatgaggtcattagggtggtccctaatccgacatgactggtgttgttataagaaagggaaattagaattcaaaacacacagagagtgacaatgtgagcaaatacaggaaggtggtcattcacaagccaaagaaagaggcctcagaaaagagcaatcctgctgatacctcgatcttgggcttccaacctcctgaaccttgacaaaataaatgtctattgctgaagcttcccagtctatggtactttgttatgggagccctagcaaagtaatatgcttcccaatatggtagactgggttggaaaaaatgtcttactctaatcacatggaaattctgaacgaaatatagcaatatggtgtttgatgcatagctcagctcacaatcgagagagaggaattcctcgatggtagaaggaaccaggctactcttgtagactggtgtggggagtagagttaaaaatgactccttggctaactgcaggtagaaggaggtgctgaactatggaggttgatacctgaggcctctgtgttggattgggggagtttaggctgtatgtcccattgtgtgcagcaatttggagccaagggacgaacataaagactctttttacttggggctgccctggcctcaacacaggaaatagagggactctgtccataggacgtaaggaacagggggagcctcatgtgccaccttcctcaggctgagggtacaaagagggcagagacctcgaggctggagcctctgtcgttgctcaccgtggatgggaaattcaatttgcagaagctgtccaaaggcaagaaacaaatataaaactggccaggagcccaagactactgggggtcttcagcaaagatgaatgtttaacctactctgaaggttttccacagcctggggcacctgtgggaagcatagcaggaaggctgggtgcaggtgagctccatcagtgcgtccctatggctcccagggagaagtcacaggggaaagaggcaggagaggaaaagagcacagtgtccagtcgtcccgcagagtaaaatacacatgaaatcaacggaaaagtctcaatgaacgtttaaagtaaacacatctgaaatggcccaaggattgaaaaactagaaaccataagaaaaaacagggtcttggaagaaaatatcaggtcgatttagaaattttgataaaaactgggtaattaaataaaaatatcacttgatagttcaaataggccactaagctgacttgataactagtgatttggaaaatctggggcaagaacacaaaatatcgcccaaggaaaagcaagttctgataaccttcgcctggaggttattctaaggggggattaattcctgtctgcatgctttcctctgcccagtaccaacacaagataaaatatatatacgtatcttcagtgtgctcttattcaaggtactatgaaatacatatatttatacacattttatatacatttgcatgttaaatatataatgtatatgtgtatacatttaaacgcatataaacatattctaaagtacattaatacttcaattatatatttaaataaacatatgaagtaaataaaaatatattattaaatatataaatttataaatatatttaatacaatataaactttatatattgatatataatggaatattatatatatatatatatgtatctctgtctctctcaaattacattgagtaagtgtgccaggagaagatggtgggggtggttatttaaaaagaaaaatggcttctgggtgcggtggctcacgcttgtgatcccagcactttgggagactcagatgggtggatcacaagctcaggagatggagaccaccctggctaacaaggtgaaaccccgtctctactaaaaatacaaaaaattagcccagcatggggccacatgcctgtaatcccagctacttgggagtctgaggcaggtaaaatgcttgaacccgggaggtggaggatgacatgagccaagatcgcaccactgcgctctagcctgggagacagagtaagactctgtctcaaaaataataataataataaataaaaataaaagaacaatgagaaaaaagacttacataactagaaaatggcctgagtccaaacataaaaggaccatgccctatcctgagacaaatgatggtgctcttggatgtgtacttgagtgacatgtgaggtgacggacagatgtgcccaggccttttctagttagcaactaaagaaaataaaattaggcaaaatcatgacatgatatttcagaaaacagtcttatgtaaatagcaaattattataagagaagtttggtaaaatggatgaaattctcaacaattttctcacaaaaaaaaaaaaccatgatccttttattactcatacttggaaaggcaaatttgaagtaaaaaatgttaatcatgctatgaaatgaggtggtgagaatcatcacacttataaaagagcacttgtttaggtcattttctatttatccaataaactgaagggcaaattaaacctttgttttgactatttattgatagccaaagtttccaggaaattaatgttaaattgcatagttttcgtaccagtgattctcagaagacaaattgtttagtaatagctgcattttcaaacaaaggtgtgaaagtaccttttatttttgtaaagcaaaatttattttcagagaaagtatttttgggacatctgtcctgaaaaaaaaagtgctatggaaggttttcaacaaaggacagagaaatttgaaaaaaaaatatattggtactaaattagaaatatagtctgtaagagaattatttttgcagtcggaaaagccaggaatacttctttactgtaggtaaatttaaaaaaaaaatccattaaagtctttgagtctaaaaacaatttcaatataattccagaatttccttcagtttggtgtgtttatgtagtttttgtttgcttttgttttttgtttttaattttcctcacaggagccttaaaaaaggtcccgaaccaagtagttttcttctatcataataatgatctttgttaataagatggtgatgatggcacaaataataccagctggattaagtgcctactacaggaaagggactgagctggctggctactgtgcacatctcatttgcggtacagttttaaactcaagtcagtgatttgaaatatgtggcttcctaagagtctacagagaaaatctagaagagattttctcaggagaaatcccataaaatgcatgttcactgccatgaagaagaaattaggcaatgcccctggaagtcaatcaatgggactgaccgtggttgaagctggatggcatagaccagtgaacctcttctatttcatttcttcaggctcaaatgtctgcgaatccattagctcttgacctctactcatgatcctcagtgcaaatagcatcattcaaaattggctgaggatacatgtaggtgagagtacacttcagtgtgggagatgtaatttaatgatggtcacttccaaccacgcatttccagaacggaaaaccctttgatttgtacatggcacacacagaactgtctaataatctgtaggtcaaaaataaaaccagaaggatgcaggactacctactcttactctgaacccttctcacaattttttttcccatgtcaaagcagaaatggctaattgcttgcaggaaaatttcccttattttccttatccctttatcagagcaaagatagtaagtgaaatagaagagaacagaaagaaggggctttagaatactgaagatatttaagatctaggatttgtttatttttgatgagatttgcagcatctttttcctctaattgggcaactagtaaacatttcacaaatagataataatagtgacggtgtgtttttttctctctctcttttttcacttgtgatattaaaggtgttttgtttcctccttctttcttttgggaccactgcctgttggtttcgtgctgaggcacatacatgactgtactatctaaagtttctatttcagagaggtctaatctggatatattttagtagacatccatgccgatggatggaagaagacaattttcaaaaagggtgcttgattgacatacaagtctcgcaattagaaaaaggaaaattttctataaaggcaaatccacgggaattactggcagtaatattaatgatattaggctgcctgactacaaggtgtgatcttagggatactgggaaaggtcttctgccagaatcggtccccgctgcacctcaaatccccaccattaaagtcattcatttgagttaagaaaattgccactaggacctctattaaaatgcaaatgtgttccccgggtggggaaacacattaaatcattatcaaccattaacactttagaccaaattagtttcagatttattagccaattactcaagtacagaaggaatgcggagcaggagagtgtagtttaagttggtttttggaaacctgggatgcttaaagacccatccggtggtgtggtgtcttgccatagcttttatctttttattagtcagctttgtgtttttgttttgttttgttttgttttgttttgttttgttttgtttttgagacagactctccctctcttgcccaggctggagtgcagtggcgcgataccggctcactgccatctccgcctcccgggttccagtgattttcctgcctcagcctcccgggtagctgggactacaggcggctgccaccacgcctagttaattttttatttttagtagagacggggtttcaccatatgataatgcataaagttctcacataacaatataaaaaagtggaacgtctcttaacaaaacagaggtcaggacccagagctccagctgctcgccactgcctcacggcctcctccccaaaccccaaacctggcccctgaggcaactccacggacaggtaagttctgagaagcttgggctggagatcattctaggagggtgtcattctaatctgcatgctttcttctgtccttttaattttcctatcttttgaagatgggcagaagccaaaagtggaggtggagataaaatttgggcttgtggggaggccgaggagggtggatcacttgaggtcaggagttcaaaaccagcctggccaacatggtaaaaccccgtctccactaaaactacaaaaattagccaagcatggtggcaggtgcctgtaatcccagctactcgggagactgaggcaggaggatcacctgaacccgggagacagaggttgcagtgagccaagatcatgccattgcactccagtctgggtgacagaacgcgactctgtctcaaaaagaaaaaaaaaagaataccttgtgttctgcacaccaacaccaagctccacgtccaccgtgttgacgcctcctctgtcattccgccacctccctgagagtcagcagaaatatactcatcctaaacaaacagatgccatcttttttctctttaagaaaaagaaatctagacctttctcacacttgcaaagtttggggtcagggggtcaagaatttaaattaatatgtgtaagaaattaaaaaatgtgcatcaactgaaagacaaaaataaaatctccccaaaaaggaaatggaaattctaagtcaaaatacataagcgctttcatatgcttcatcttacttaacttttcagaaatactttaataattttgcccaattgaacataacagatagagaaggcccaaagagaagtcggaactttcccaagttcatagggttattgaataacacagctgagattcaaattcacaccactcatccaaaaacacaggccctttccccagaaagacatacttgtctttaatttcatttaaaagaagctaggcagttcaaatttactcgagaatacaaatttccacttgtagaaattatgccacttaaattttgctgaaataatagaggaaaaataatgttaggaaaaatttgggattaaaatagactcaacattataaacagtaacattagatttttcttttgctccaaattcttaaaaccgaagaaaaaaatctgtatacctttagaataattgtataatttgactatgatccatagcagactttttggaaggtgtctagagaattctgctgctgtttttgtaaaattagactgtatttccctttatgctcacagatggcaataatttcatatcattttaacatttcaagcatttttttatgttattcagggtctgttatttaagtccagataattatccaaaaacactccagtcctctcatcacttatagttcagatccaaaaactagtaagattaacgtaactataaactaactatgctttagttattctattatttcgcagaaaaagaaaacgaagaaatatgaagaatgtctgagtgtttttatgaatttgaattcataacctaacctgtgtttggctctgacaaaattattaagggttacttaaagctaatttgacatgatttctgtttggtttacacaaagtaattcagaaatttacaaagcaatgcttcatcaaagagcaatattaaaattgaatataatataaacatgtaaaacagatacctttattcatctctgttttctatttacccattcccttgacaatctcatatggtttcacagcttaaataccacatataaattgataatcctcaaatctgtatctccagatcagacttccccttttaattgcacgtatatatatccaacggtccaccctgaacttctctgcggatgcctcactgacatccaaaatttaacgtgaacaaaaatgatctcctgatttttcccttcaaaatcatttctcttccagattcatcttaattttggcaactgttcccttctaggcgttcaactcaaacaccaaggtatcaccctcagcccctctctttctctcacacatatccaacttgtcagcaaattctgttatctcccccttcaaaacgagcccgtcctcctatctctagcactacccctctggaccaaaccaaagtggactttgcttggattacgggaattgcctcctaaagggtccttggctctgtcctggttcctctagagtctattcttcacataatagctaaaattgtcttgtaaatcgtcttcgttaaatgtgtatcaggtcctgtgatgactgcttaaatcttaccagtggtccaaagagcacaggggccagggcagattccaaagccaaccaatagtaagggagctgacagagaagctgctgttagagctgggttgggggcagggactcttagtcgggagactcacagagctgtgagatgacctgcctggtgagccaggctgacttcacacttcagcgaggaatccccctgagcaggcgccacccaatggggactgctcatctagagaacagaaggctgtctgccaagaatccttacacttcaagacaatgccagctcttcatccatctccctcaacacccagaaagggcacaaagaaggtcatgtggctgaggaaatgtcttcttcaagagaaaacaggcatgacatcaagtgactgatcactgaatttggaaggccaacacaaggatgggactttttcataaatgtatacaagggacatcaagattaatatctgaaaaacagaatttttcagttattaatagaaggtttttaaagtattcataatacttcaacatccattatctatgtttacacttacctacttttaattgacagataaattttaggcacagatgttaaaggaatttactatattcttatagaaatgagtagcagaatatggattaacacaggtctcccgaattcctggcctattcagcatttaagaaaagtatttaaattctaaatatatctgataattagaggactattcaagatgattttaattttgtagtcttgtgagaattaactaaaaactgaggtctaaataaacaagtgtggcaggaaagaaatcagtgtctcgcctttttccttgccattttcaaacatctcttagcaactaatgaatttgaaacaaccaaattttgtgtgtatatagattgaaattaattctctagaagattaagcaaaaaaatcatatctagactttaacaatgagatccaataggttaaaaaatgaaacttagtataattccatttcaacaaaatccaagtctcctggtatagaagcctgggttgatgaggacacattttctcctctttattcctgaatatcacaaagaaaaataggaaaaataagtcctaccttcttccctctctgccccgagaaaaactatttttttctaatcatgagaaaataatcattaggaaaaaaaactagggtatacagtgagatatttgggagtcaggagaaaaatttgatgaggagtaacagtattaacaggttccaaatacataacatagctaccttggtaatggcaggatgaaaatagggcctcaaagaagcatctctgaccctgcccttctctctctctctctccatatatatatatatatacacacacacacgtatatatacacacacatatatacacacatatatatacacacacacatatacatacatatatacatatatacacacacactatatatatacacatacactatatatatacacacactatatatatatatatacacacacacccctttctatatatgtatctacctatgacaagattcagttacaaacctatcaatctgtctgtctgtctacctatctatctatctatccatccatccatccatccatacatccatccatccatccacaagcagtaggaactatatatatttctacaacggggaaagcactggtgtgagtgggaaggaatttacagaactgtgattccgaagaggctgggtaaccaagagaatcacatacagtggagccatgtttgcaggaagcaatcagtctctgtcagaaactgtcagattgtcaataaaagcatacaaaggtagactatctgaccctttcagatcttaccgccaccccaggaatctcttcacattaagtccaagaatatttaatagctttttattaaattatctaaaaataaataggatgactaaagtattgatacagaagaagtataaaacagtggcaaacaatagtaaagtttataaaatctatcaaacttattttattttattatttgttttgagactgggtcttgctctgtaccccaggctggagggcagtggcacaatcacagctccctgcagcctctacctccctggatcaggagatcctcccacttcctcaaagtacctggtatgacaggcacatgccaccatgcccagcatatattttacattatttttgtacagacagggtctacctatgtagcccaggctggtctcaaactcctgggcttaagtgattctcctgtctcagcctcccaaaatgttgggattacaggtgtgagccaccatgctaaaccatacaaatctatcaaaattttaaaaaacatatataacgatttcttatattaacaatcaattatcactattggtaaaattcacctaaatatacataaattggagtcaacttaacatgataaaacacatctagttcaccactaaaaccaggctgattcttaagcaggaatgaaatcttagaaacatcactcctgaagacaggaactagaaaagaataactaatattcccgctgtcaattaatattttacattaagtactagctaagggaatttgaaaaaagaaagaaaaaatttataaaacatgaaaaggaggagataaacatatagtacgattgaattttgatattattttaaactggaaaaccaaataaaatcaatttttaaaaaatctattttaaactaagaaagaattcaataggtgacaggaagtaaattatcataaaagactagtttttctattaaaaaacaaccaattttataaaagaaaatactctttttaaagcaatagaaacttaaaatataaggaaattaacatgaaatattcaagaccaaatttttaaagatataatactccctaaaaagtaccaaaatgtaaatgaatgaaaatacgtatctttgaactctatgacattgtattaaaaaatgagaatgttcattatacactgacaggaaaaatgagaacgttcattatatattgatatgaaaaactttgaagatatgtaggtatgagaaaaaaggaaaacaactgaagtttatattatgttttcactggtgaagaaaaaaaagagagagagctagaattttgttttaatgtggttggtttctgcacaaagaagctctgaatgatgaacaagaaactaaagacaatgatggcctggagaaaggcaggtgaaaaaaagactacacagctagagaaagtgcaggggtgggggagactagatggcacacattgtcatgttttagattttgcattttgtgcaagttatcttcaggactaaattaacaaagtagataaataaatgaagcctaataagaaataagggttttctaatctatttccttctctctcacgtgccaatgcgcttgagcctgctcattctctttctctccctcccttcctgccctataattctctgttgcattaaaagcatcattataagtctcaggcatttgctgcttcctttcttccagaaatggactctcattttcttcaagcgcattgtaagtaatttagtccccacccccacctacaaaaaaaaaatcttcacaacaaacttatttttaagaattattgcatcctttctaagatagcatagaactttgggatggtaaggtcaataaaaacttgaatccttttcctattttgttcaaaagctaaatttccatttatttgtacttccagatgaaagtaatttgatttatgtatttcagtaaaagctacccagttttaaattacctaaagaattcctaatatgcacttacgattttcaaagtacaaattattatttccctttgagagcttgaactattgctgccttttactttcataaataaaattttatctcattaaagtagtataaaatatgggaaaggactccctatgcagggctcacatatctatattcgacctcactttttattgattttaacagttgttgatagctaatgtcacctcactttaaattttttgtctacattttacctacaaaataatcagtcattctcaccaagtttaagtgcttacttacagatcattaaatattttaaagaaattattcctgtggtgaggctttttctaaatgaaatattttttatgtaaaataccacctcttaatctgtggtttggagtttttgtatttttgcttcacaaagctagacgtatacatacatataacatatatatatatatatttatatttcatatacttttgttccttgatgtttcttagtaataatatataaagggaatgtatcatttttggaaaagttggaaaaatttttccaaatatcacagaaagcaatgtgaaattccttcttctcaaaatctattgcaccagaataacatggtaccatgtattatctcaaggaaaatatgacaaactatattaaatgcaaaactatcagctactacttctcatttgaataattttttttgttttttgagatggagtcttgctctgtcactcatgctggagtgcagaggcatgatctcggcgcactataacctctgcctcctgggttcaagcaagtctcctgcctcagccccctgaatagctgagattaaaggcacatgccaccatgccaggctaatttctgtatttaaatagagacagggtttcaccatgttggccaggctgctctcctctcgaattcctaaactcgattgatccacctgccttggcttcccaaagagctgggattacaggtgtgagccaccacgactggctaaataattttcttatttggaatatttataaagtttctgaaaaatcatcttggtccatactttgtgacttagaattccatctaaagatcaacaacggccataaggaacacagaaggaaagtctagaagccaagggaaaaccaagatcctagtgccgtctctggtacaaacatacctggtgaccttgatcaaacatcttaactttcgtgaatctacaattcaccagctcttaagcttgccctgcctacttcaccggaagacaatttttatttgaatggaatttaaataaacagttaattattgtgtttatagcattattcataaaaccactctaataataaacctctcaagagtaacatgagggttaaggaggaagtatgaaaaaggctttggaaacttacaaatgcaactcggcaataaagttcttccagcaaaagactaatcaaattaaactattgcgatccatatactttgtccctatccatgtaatttactgaaacataggaattgtgttttcctcatccatatttcctcatgcctagtatcatgtttaacatatagaaagaagaaataaatacatgtgattttgtagttggtgggtttgatgagtagaacaatctctttttattctactgcctagtgatagacaagtataaactaagaatcatcaaatataaaaaagaatgaatctgactactacaaatcagattctgaacaatttgaaatacaaactattctggaagatgctcaacatcacttatcaccagggatatacaaatcaaaactatgaaatattacctcacatctgttagtatggctattatcaaaacaatgaaagataaatgttgacaaagatgtaaagaaatgaactgctgtgcactgtttgtgtgaatatagattggtatagccaataatggaagagtatggaggttcctcaaaaaattaaacatagaaatatcatataacccagcaatccccctgttgtatctaaaaccaaaggaaatgaaaccagcacctcatagaaatagctgcactcccatgttcactgaggtatcattcacaatagccaaggtatgtaaagaacctaggcatccaccaatgcatgagtggaacatgattcagctttacaaaaggagatactgtcatttgtgaaaacatggatgaaactgaagggcattatgtcaagagaaataaaccaaacacgaaagaaaaactagaatttatttcatatctataatcttacaaaaacggaatacaaagaaacaggagaagaacgatggttattggagtgggctggcatcgaatgaggagatgtcagtccaaagtatgaagttgaacttatgtaggatgaataagtcaagaaatctaatatatagcatgaaaactataggtaatagtgttatgttgtatactggaaatttactaagagagaagatgtaagatttttacacacacacacatgctgactatgggaggtgattaaatatattaaatatattgctttgcttgagtacacttatttgactatgcatatcaagctatcatattatattccttaaatacagactgcaagaaagagaaaaaaattgttttggtgaagaaaatatatttaatatccatgcagattttaattttatcaaaggcaaacttaactaaatatggctacttctcccaatgctgtgtatctcttgaccgagtgaaaagtgatgccttctaagtgaagtgaaaatgcattttgtactgcagtctgaagtcactatatcctgcttccattaggacttgggaggattgctgattcttcaggagtatgctctgaatggggtagaactttccaaatgcatcagatagttaggaatgtctgtgttccttcttggaggagccctgaactacagggtgcataagtccacaggcaatgtaatagtctcagcatctcattactatcctcagcggaaaaaaaaagtttctaatttttctaatttgaatatgatgtcagctgatttttacggaaagaaaaatttggtagtcgtcaggaaaattacagtcacttgaactcaactacttgaatatttcaggaatacttgttttcttctacctcttaacaaagtcataaatactactggaatgacactgctttagatatctcaacaaaaaaagatttctcctctgtgaaatacaaagatcttactgctattttctatatccagctgatcttttcagatctaagctcggtggggtttcagcttagagtgctaaggtatcatttttctttacttgtggcattacaagagtctcactgagacactgctatgtaatatcttggcaaaacagtattgatctcctttcaaaagtgaatagaggtcagctttctgtctggatacttatatatctgacttgtacacctaacaccattaaaatctatttgagtgcattagtggaaatggattctattatatggtctcatggggaacccgccaggaagtcatagagtataacgtagacggctccttttaaagacatttcaggcaattttcttgccatcccttcacttcattcccactggctaactgggaatcatccaattactacaatagccaggattgatacccgggagttagaagaaaactctttcaaggaccgaggttcgctcaactcatgaaaaacatgttgccatttctgaaaacaaaaagagggtttaatactttggagtacataataatgtgaaatatacctgatacttatgattcaagtcactaaagtgtgttacctgacaacacgtccattttgtatcttgtaggatctgtgtatacctgtgcataataggaagaaatttattttgctgaaagtaaataccaaatattgtaaattgtatgaaaagaggacatttaaaaagcaaataataattagcagtttgtttagctaatgaccttacatatgtatctttctcagtttttaccacatttttgttgaatttctgatgaaaatgtccaggtatacataaataataatgaaaggaattttcatatgtgctgtaagaatctaaaatgtaaatgcaatatgctttcgaatgtaaaaaaaaaaaaacaaaaaaaaaacaaaacaaaacagtgcctgaatcatggaggaccttgtaaggtgttcccattgccttcccaaaactaactgtcatagggaatgagatttgtcctgcatatacagatctcttcaaaacatactttgagtaacttgcctagataagtgcatccaatctcgggcagaaagaacgtgaaaacaatttttaaaaatatgatgctctgtcatgaccattaaatatcaatcactgaatgattcttctagtactgaaaatagtttaaacaatctatatgcacttaagtgagccattgcaatttgtcattttcctgtaagacaactagacctcctcttgcaaacaaaataaaacatggatgttccagaatgcttttcatgagttttatgataataattatagtctcaaaacaaaatattaaccttgcagttttaagaacagtattatcaggctggctaatgaatactgatatataagctatgtcaaattgtgtgtaaacatagggttatctatatcactactgattatatgaagagctaataatgcccattaaaatataataagattttctagttttcttataacccatgtggcataccataaagtaaaatcagacttaaatatacaaataacagattcaaatataatatttacattacttataagtagctgggagttcatctttataagtactaatatagtagctctttatatatatatgtgtgtgtgtgtgtgtgtgtgtgtgtgtgtgtgtgtgtgtgtttatactcccagtgaaattctgttgaagaagaattgacataatatattatgtgatattatttggaaaaaataaatgtaagtttcacacagacattgaataaacttgctttgtattttaaattattgaacaccattctaaaagatgtatcttggtaagattaatcaacgattagctcttgaagcatttatcacgttttttaaaagttaagatatacagcatagccttgtagtatgaatcaagttgatatattcaagttgaatatagcctgtatgtttaaatttgaaatctgacggaagtatacttcactattaaaacctcaactataatatgaatgaaacaaatcatacaggtttttttcttttaagaaggttgttacagttgtataaatgattcgagtttaaaacataagcccataacattttggttgagggaaaagtcgtgaaagaacacgttttaaatatttatacttttgctattttaaacataaaaggggaaatgtgtgacttttgccatttgcgatccgaacttttcaaattaaatgtatcctgaaaggtatatatgttttacacattataaaagtgtaccttttataaagaatacattaaaaacaataaaagtcagagaataaagatgaaaaggttaaatttaagtcttattgcaagctgtttagtatcacgagcaaagtatcgaacttcattggtacatgaatgaccaagatctgattacttttcttcaacaccatttttcctaattagcattatcagcatccagttctagaaagtcctagcaaaattaattacataatagtaatgttgttttgcttgtgaaagcgcaataatataaacaaagtagattatttatggttgttgttctccatttctattattttcttaatttgatagctcagaaaatacatagttacgtgagctccacaagggcatatcgcacagagatttccattttgcgaactccattccaggatatttctagttttgagacctacgtgtatttcagaagcaacatggggcgcgtctcaaatgtccactttttaaagaagcctcttgaaaccacagctcatcctttcagaatctgcattctcagacaaattccagccttgcttttggcatcttgaagaaaatccccatttatctcagataacagagaaacaatttgctgtgcttatttagtagctggtaccttgagttacacaggatttgcgctgcgtttgagcctagctgctcggttggaactgagtgtaatgttcacgacgtggctaaaggagttttgagacctaccctccgacatcttgtagaccctggttgtgggactgggttcacattccagggggggttactttgacactctccagtagatacacggcattcgtcaagaagttattaggatttacagtggaattttggtatcacgaactagttgtaagaattttctcataatggatttttctggtcacggtgtgagttcacatcgtggacagttcaagccactgacaaatgatccgtgatacacagaacgcacatataacacacggggaggacaagacgtcatctgggcgagccatttgcatccagatgaatacaaaacctacagttggttgtattacacttggaagttttcagctgtggcttcatcacccatattagggtcagaaaaactcttgtgtgtttctacagccttgccccgcttctttgatcctttgtagtaatggcgactaagtgggtagcgggttctttaaaaaaaaaaaaagctttttgtattcctgaaagatagttattatcaccaaaagctttctcttctaatgactaaaaatagagcactctaccctttagtgtagttcacagaatttgtttttaatactccagctctttgtgctccttaagtctgcttcacttttttttacttcgtttttcaaataagacctcaatggacagggctttaatgagaatacaagcagtgctaaccagagggacaggaccacttccctgtctgacaggtgagacgtctagggcctcccatcagcttctgcaaaagatagaaaccctgaatcattatttcaaggtacttcatcatcctccctcctctgttgctctgctgctgtcctatttcatcagttctaattttattcattctccttctggaactttcacttcagcatgggctgggttatgactgcatgtcctttcctatgttctggcttgtattaaaaattgcaataacacaacaattgacttgaagatataattgacctgaagatgcaaatgacctgaaaagctgaaatagtattgagtttcaaaaacattattagaaatatgaagagctgaaaaaatagctttttatgaatttcttctggggattgtacatatgtacttaaaaaaaatacatggatgagatgattaggatggaaaatgagacccctatatgtcatactggaataccagcagaaaggtcatccaactgttttctaaatggagaaactgagattgatgtcagggctttctaccggctgagtagggtgaggaagctgaggcccttctgcagctgaatgtaacttctgcggggacacttcgctctcaatccaccgtaggccagtagctctccattctctctgagaaaggactgatcaatgatgaagagtccactcagcagggcacccaagcatttctgttttcacattaaaccagttaatgtctaccggtgaagtctgtaacaataattaagtaatttaattaagtgtttgagaaacccatgaacaaagaccatgaaataaaatgttcacaaaaacactaatgctctccattgaaagctttggaaaactccataagtgcactacccataagtcagtccctggaattatgcgtaagatagttctaaaagactggggaaaacaataaagagagagaatgatttggcactttcaaaaagcaagtgaaataatgccttctgggtgtgttttgcaaagaaaaatggtgcagaactccactatgcagatttattttcttacctaacgtcttctagctgttaatgacttccaagtttatatttccgtgatctggttcccacttgaaatccacggggaccagctctactagtcacctggaaataacttgcaaaggcaaattcctgtgttctgccagtaatcttcctctttcctctttttcttctctgaatctcagttaagggctgctctctgcttccaggtgctaaatttggaatatatatgtttggtacatgtatatgtttgggatatatatatctattatatatacatattggatatatatttagcttatatcaccaatatgtacccacctataccacatatatatatataccaaatacatctaatatatatatatacaaaatatatatatgtatatatatacaaaatatatatgtatatatatacaaaatatatatttatatacaaaatatatatatattttttctatttttttggtttattgttatatatagagagatgtagaatgtatatgtttgtaggtaaatatgtacatttggtatatttggtgtatatatttagacataagatcatacctatatatcaaatatatatattttatatatatatttatttggcatttatatattcgtatatttatatatatatttggtatatataagtgtgatcctacacctaatgatatgaagtaaaatgcatgtatatgatttgggttgaaataaaattttaatattaggtgtttatatattttagtggttctctttttaaaaatgctcatttgcttaagtaatttggtcctcattacatgatataagggacgtatttaggggagtttagtttggagactataaattcctgagggtaagaagcatttcagtcttgttaccaattgaacgtatattgcacagcagagtgctgccatgtagcaggttctcagcgactatttactaggtgaaataaataatctcccaatctttagcttatttggagctcttcatgtctttattcagctctgttactgataccatttaacacatgtccttcctattccaaataaaattcaaagacccatgtatgttagagaatcttaactagttaatattgcttaagtggataatgcttccacattgttttacatatttctatttgtgatcgtatttcagtagatgctcaattaatatttctaaatgtctgctgaaaaaaaaaataaccagatgtctgctgccacctaaaaaactcaaactcctttagttcaaaacacctcgaaacaaaaagctggcatctactgagattaataaaagaggggaaggggagaattattggagggagaaagaaggaatttgtctttgagcattacaacgttaaggtaacctgccagacgtccatgtggagatagagatggacagctgcattttagaggagggagactgtggtgatataaatctagaaggcgttagtatacagacggaaagagataaattcactgatgacctgaatatagacaggaaacacttggatgttcagccctaaattatttccatatctgaaaccaggacaaggaggaagactaaacaaagaacacaaggacaggctaatgagacgggagaaaaatcagaggtctcaggaaacaaataaaaatgctgtttaaataaagagggcattatcacagaaaattatgctgacgaggaaagaaaataagaataaaaacccgatcattatattcggaaatgcagtcatcgatgatccacacaaaggtgttttgttggtgtggaaattctgaagacagtaactgattgcagtaggttcaagagagaattggaagaaatgaaaaaaggggaaaaataaagtatccacaacttcttcaaagagatttgcggcagaggggagcagagaaatgatcaatagctgaaaggaaaagtgagtcacacaaaagttttctttaaggtgaatgaaatacacataatgcatttttatgctgttgagaatgatgcattaggcaaatttcgatattgctagagaaacatataaaaaaacaaaagacgttaatctgtgagcaggtgagaaaggggggaatgcaaactttgcatgagtatctatttggcaacagaagactagctgttgtttgaaagttccagtggcttttcaaagctgtgcttacaactcaaagttcctataaaactgtagggaaggatctcataaacaacttaacacatggatctatgtataatcaataatgaaataaaagttttccattgcaatcacagtaaaagcaaagatactcctaagtcctaatctttcttttgaattcctaaggtgataggaacctcatctgaaacttcagcgggagttttgattttcatcctttccatggaatgacttgtgcgcacacactgcagcctaaacacgggacaaatcacttctcctctcccgattctgaaactcgtgattcagagcacacctgctcccatgttaatgttttaactcctctcagaatggccagagaacaaaataaattgtatgacatctttattaccccttttcgtctccgcacttagaagcattgagaagtacttggagagattcccagaatgcaaagcatggtctcagtgtggaaaaagaaagggatggaaaagagggagacagaagaaaacaaaacaaaacaaaacaaaacaaaacatatatatatatacttttttatgttcagggaactcagaacaactgtgaagacagttcattaatcaaagacaaattcagttcaaagaaatgttgcaggctatatagaaagcccttgaaagatgaaaacatattcaaactaaatttgtaaatatgggaataaaaagtagttgagttaggtggggtcattcaaagaataatcagatttaagaataaagaaaatggccaggagcagtggctcacacctgtaatcccagcactttgggaggctgaggcaggcggatcacgaggtcaggagatggagaccatcctggctaacacggtgaaactccgtctctactaaaaatacaaaaaaattagccgggcgtggtggcgggcgcctgtagtcccagctactcgggaggctgagacaggagaatggtgtgaacccgggaagcggagcttgcagtgaggagagatcgtgccactgcactccagcctgggcgacagagcgagactccatttcaaaaaaacaaataaaaaaaaaaagaataaaggaaatgaataaatgaatagagacggagaagttgctgattttcttggtttttgtgcataatgctttatctaaagaaataagagccgtaacgagaaatgtctcccttgagaaaggctttcctgtgactaaaccgtgctttgtttccagtcattcctgaggcaaccagggccagtgttcctgcctattggggtgattttactcatttaggaaggcttgggagttctatgtcatggttttaaagttctaggcccaagacgctaacgaatgaagagtatggagggtctgtgggtcttgactcctgctgagagagaccattaccagctgtaacctgcttttgatttgcccatatgagaaaccatgagatggcttcgagtagcatttaactttccgagctgtaactgaaagttaaagagaaattccactactgtttggaagcgagaatcagtcctttcccactcagcctccacacaagatgcccacctcaacctgcttttgtcttggttagaggccaccttcctcatgggatccgtctttggaatcagcagtttttgctcccacctcataagcttaccggccattcagggactggagcaagctgcatgtgacacattcccccacctgtgcaagtacttttcatatttttccgtattggagtatcttggtcatttataatttatgatttcaacttgaaacaacttgccttggaaaggagcaaatattcattcagatatatgatgtcataactttccatttatctatttgttcttttgttcattaattattaaatacatgtttattgaatattttgaggagtgtgaggaataaaactgaataaaaatcaacccatccctgcactccaggagaaaggtgggaatgcacactttgcatgagtatcatttggaaactgaagactagcactgtttcaaagctccaatgggttcacgaggacccaggaacagcagccacagcagttactctagtagtttgggaagtgatgctggcttctaccacctactctatttatttagggttgggcgaacaactcacagtgtttttcttattgtgtatattgtcttctcacatgggctttagtactgtatttttattctaactgtctcttctaatattacattcttatagggccaaagataaaaataataatagtgagaacgatcacaacagcagcagtattaacaagaatgccagcgttatgagaaggaggagagaaaaaacgagaagactgaggagccagtgttgactgcatgcctcccccatgcccgtagctttacatctctcttgctaatctttccaacagtcccgcatccttatcttcatttcacagatggcaagtctgagattcagaggcttctaataatgttcccaggacccagtgtgcaaaagcgttcggtagcagaccgcagacaagaactcagatgtatcagaccccatgggtagaactctttctactctaacaaactgcatatggtgtaattgaaagacactctgctagattctagaaaccttaatgttaaattaagacacctgaagagttaatagatttaaatttcttctgcgtgtgtgtgtgtgtgtgtgtgtgtgtgtgtgtgtgtgtagtgtttttcccctgagattctcactctggacatgcagaatccaagcatttattctcactcacaagtgcttaagaacaagaattacttacaagggcttcattttcaccatcgattacttttcgagtaactttgccaaattccagtcttgcaatgcaattgaattttatttgtactaatggaaagcaacctgtcagagaagcactgctttcatgaccaccccagacagcagaagacactaaatcaaggcccctgggaatcgtgagctcatctgggcagccacacatctgccccagctgtatccttgctctgactaagcagacttcccttgtagtttacatcgtttttaacccttggcttgataaagactaagcaggcattttatagctctaattgtgcccaaatcctccaggatttagtaactccaggcagtaaatgagcttggaacttctttgcaggctagttgacatccacactcattcatttagcaagcatttatatgggccctaaaacatgtccagcctgctgggatggcagaggagatcgggaggcagcaagggcggagaaggagggaacaggtgcatttgtacctcagcacaaatctctagggctacgctcctctttcatttgcacggtttctttggaaaaaaaaaaatccccaaatgaaaaataactagaaaaaagaccgaggttggtatttaaaatgctgatattaaagcaaattagaatagaaggcaaccattcattccttcatttccttcattcatttattcagtcaatgtctaccaagtactgaaaaaagcgaaaccatgttgaacattacattccaaaacagactaattcaaaaagttcatttcctgaaccctagtatttgagaaacatcaacaatatgcagaaggaaaaataaatgactaaaaatgttgccctcaaagcaagcacaaattagccatgccaatgaccctaactctaacaagagccttttaccctagcaggttatagtgactcatgcccagaataaccatatcttggaaagaaggaaacagacatagagggaaggtaggtgtcggagaaggagctaatgtctactaaaatctattacaggactgccagttttacacataatcctctcaatggtgcaacaaggaagatagatagtgcattgcccatttaaactgacaaagctatgtggtgtaagacgttaaataacttacatgtttcaacaaaggcctggaaagcatttttatccaatagtctacactgcatttttaacacatctgaacaggtattttgttcactgactacctatttttcctttctcctatctatgacttaacaaagaagtatgtaggaacccatgaaagtaaaactggtaaacaaagaaacaaacttaacaacaacgacaaaatccttcatgactactactaaattatggaaaactgccttattttattatcactgaccattacaagaagtcaatttatttctatttctgaaattgacctgggtagctttttgaattctggaaaaaaacagacaaggatagcatttatggtaattagcaagaggctgtatgaagttagaattatgcccctatgcatgtgaagtgaagattctcttatcaaagaaagaagtccttcttacaaaaatattttgaagaatatcttaacatatttggagaaactgaggtgacaagttattttttattgcattgataaacatcaaaagagtttatttttatcaaaattttcatttacatttacaagctctattgaaatataatagagcttgtactgggacatttaaatatgtttacctggaaaattcccctgcatggtataaggatgtgttttgattttctagctttcaagaaatctattaaatccttttaaaaaatgtgatatattgagcagtactaaaaaagcaaattattgtttatggatgtgaatttcacagtatagcttattatatagttatttagagcttcctctgagtgttctatgcatgtttgtgcaatttttcttttgtttagtgagtccctgaaaaaaaaaggtgaaaagttgaataggaattctgtgactaataacttttcttgtgtggccagaagctctaagatttttttatttctacaaaataataactgttgaagatttagaaacgtatttggtagcgaagtataagtaaatgctgggtattaaattatatgctgtttaacaaaatacaactatactgtataacattatatttttaggtactggaaatactttttttattttaacaatgattcttagctcttacccatttgacatgagtgggccgttcaagcaaaagatacatctattgttttcataggcaaataaattattggctacttctttgaagatgttctgctcatgccatctttactctcatttttaagacctctcaaggacctgggtattttcagtcttggctctgtggactgaactctccttggtgaagattccatgtgtgtttaccccagccagcagcaggctggccacagtatttccttctcctaggaggtctggctttagcaaactactcgttatggcctgggattctgggaaagtttccatatggatgttataagatgttgctgagaagtgctcgggttgtttgaaatcacatcaaaattgatggagaacaagtcagttcagtagaagcaaattgctgctcgttaaaatttgggaaagtttccgcagggaagagcaaaaggtattttggagctggtattcaggatctttttatacatatgaggtaatgctccctcaccaatgaggaatgcccccttctctttcagaacctttattgctaataccaaatgcgagaggatacttgagtcatctcagcactgaaaaagcctaaggtcttctcatttagatttcactagctttttaaaccacatctccaatgccagctaccaagttaccaagccaggatctaaacctggattttctgttgccaagcccattgtctttctctcatcaatttatctgccccaaataaccttcttttttcagtaagggagaggattattacgtagatctgcaagtgttgtaggacgacagatttcctttcaaacattgaactttatgcaacattttaatgcaacttacattaaaggtcagaataattcacctttttaaggtctcttccctagaagcccacatacagctaagaaaagaagtgaaagacaattactaaatataatactactagcaatgatgatgagaagactaatagaagctagcacgcactgatgtcttccatgtgccagacacttatttgaacacttgacatcttcttgcttttatctccctaatatctccctaataagagaaaaggactgttagtcttcctagttgtcagccgaggatttgaattttagaggaatttttccaaggctgcctagatcttcaatggtggttctggaatctgaactgaggcctttctgattccagggtccaagatttacatacaacacgctactgctttactagagatttactgatgagcaggtaataagtagccaccggttgcaacataaaaatgttatcctatttaacactttcctgaactgagttcatagcttgattttcttacatttttatggagctgctggagacactcaggctattatggacatttgtattgccctgtgttagccttcatgaatatgcctgattttcattggaaagctttgtttctcacgagctgtgaggtgtttcttctactggattaactcattctgtcaccctaatgctttcaaatattaacttcttctctatgtttaattatctgtgcaggacagggaaaaatgctgtaaaaaatttaaaaagagacgtaaaagttctcacactttttattttcttcaggtcactgcacactctgttgtgtatccaggaaaatttaggtagttgattattcttggagatattcagataataaggagatcacaatggttggaggtgccaagaagattccaggagagagagagagagcaatgatttagaaattggtgaatgaatttgcatgaacagagagaagcagcaggcccctcaggtgggcaaatacaagaaaaactaaagaagtcagaactcagatactcaagcatacactgcggccatgacagcatgacagctgcgggaaaaccccagggaaggtgaacactcaatctaggaaaatgggtttgcacatattgtactggagctaaaaggcagggaaaggcagtgacacctaattatcaaaaggaatgatttttatgcataacttttgagaagataaatcgcaggaaaaagaataatttaagaaaaaaagttactgggagaaaatggtatactgcaaactttggaagcaggtttcatgtttgtgtccccactctaacacttttgtataaacaagtgccttcacttccccactgtgctgtctgatttgtggggtaagaaaatagctcctacctaatgcagagctggtatgtaagcgttcagtaaatgttatcagctgtcatcatcatcctctttgtaataattcctggggctcagtcacagcaaaccattccattatttattctctcatggctgcttctttatagcttgatttttgcatttaacattctatcataaagacatatgcacatgtaagtttattgcagcatgattcacaaaagaaaagacatgtaatcaacctacatgcccatcaatgatagactgaataaagaaaatgtggtacatccataccatggaatattatgcagccacaaaaaaagaatgagatcatgtcctctgcagggacatggatggaactggaggccattatctttagcaaactaacacgggaacagaaaaccaaatagtgcacgttctcacttataagtgggagctaactgataagaacacatggagacatggggaggaacaacacaccctgggatctttcaaagggtggagggttggaggagagagagagtcagaaaaaaaaaataactaatgggtactaggtttaatatctgggtgatgagataatctgtaccacaaattgccataacaaaaatttacctgtttaacaaacctgcacctgtacccctgaagttaaaataacaattaaaaaaaaacataaaacatcattaccagacacatgattgatgatttcccttatagacacggaagttattgccagcaaagactcaccttcttcatctctatctttatactagcactatattttacacattttttaccaaatggttgagataaaagaaaaagagacaggttggatgaatgcaaggaataaatcatttaattcggctgctgaagtacctaagcaataggtaatggcttaaatcaatgcaaaggcaatagaaaggccagagaagacatagaaacaaatagttctttggacaatggtagcatctaaagtaatgggcagcatatggtaggaaagggaggaggagtcaaatattgcaacccacaacaacaaagttaatcccagataataaggaaattgatagcaaaatttgtttgaaggaaaggcgagaaagtaaattatgaaatgttaattttcaggtaacagcctgccattgaagcaaagtaatgatagcatatcctttctccacatgtaacttggagaatgagagagaataagaaaagtggtaatagtaaaaacaaagataagattacatgccaacaccaggtgaatgggacaacagtaaagacacacacagttttctgtgcaaggtctcaaacagaattaaacagaatatcaggttagtttatttggtttgatagactttcaaatagtccgtttttattaaaaaagaatgtccctacagtcaaatatttatccatctgtattagttcattttcacgctgctataaacaactgcttgagaatgggttatttacagaggaaacatcttaattgactaacatttcagcatgggcgaagaggcctcagaaaactttcaatcgtagcaaaagggcagcaaacatgtttttcaaatggtggcagaaggagaagggctgagcgaagggggaaaagccccttataaaaccatcagatctcatgagaacaaacttgctatcaggagaacaggatggggaaaatcacctccatgattcaatgacatccacctggccactcccataacaggggaactacaattctagataagacttgaatggggacacaaagcctaactatatcaccatctagcatctgtattttaaatataattacattttccaacagcatcgtttctgtcattttttgacaaagtaaaaaaaatcagtatattatataaattttcattgatatattaattaaatttgctgtatcataatgattaatggtatgcatttctgaatacaggattaagcttgatacaataaacaaataagatggatgcccctgtctgagttcaactacagatggagaatagaaaaaatacacaggttgcttatttaggaactacatatagtcatctattatacttaaaattctgtgtgtttgtgtgtgtgtgtgtgtgtatgtgttagaaggcaatgtccaaaattttgaagggcttgaataatataccttctcttgggaaaataatcttaagtcttccatgctaaaacaagttaaaagttaaaggaatgtagtgtgagtaactgatatattctttttaaacacacacatgtgcacacacacatacatgtgaacatacacacgtgcacacacacatacatgtgaacatacacacacgcatacacacactttacttcctaatagctcattttagatcccgtgtatttgttcaataattctatctattaaagcaatcctatgttgttgagcctgccaagttcagctctgtaaatatagcaatgcagcaatttcacttggaactcctacagattaacagagcatagccatagttgacagaactagatattttatggaggaattttaccttactgtaaacttcacaaatgttcagctcagtcatattccctatttagtggccttatatctgatacctcccaactctctacaatataaagagaaaaggtcatgtgaatattatctaattgaatttgttgtaatgatagatgaagtaacaaaacttttctgtgctgtgactcaatgataataacttaaagaaaatcataataagctccagaagatcttttgactctaaatgagaacaggtctcctttgggtccgagaaacccacatgctcagtggttatcatggcattaacacaggaagccacaggcggacagtccacactttgtgtctatcactttttgtctagcattttgtgtctagcactttactaggagctcgtggtggtactttgctccctatcccttcccacaaagattctccagtccctctctttggagtcctttttcttacctgctgcaacagcctcctttgtgatctttccatgtctggcccccatccaccgttcctactcttcccagagggatctttctaaaactcagcattgacagccgtttctccaccctcccttcttcagttgctctctgcagcaacttaagctccatagtctgagctagggaaatagctgactggccagccgcctgcccaggcatcttcctttcccaccctgagcttcagcatcctggcagaggaatgccacagctctgggaatgatctctgagaactccaagcagaatctgatggctctctgtctctactgccattttatctgtatctccatcataattccctccctgcagggatgactgtgcaatgagagcctgagcaccctgagacgaacacattatcttattgttttcaccccaggaacaagtggaatcttagaatctctatgtgcaatttctgacataataatattagtaatagtctgtatttttgaaggtctttattatagggtcttacattttactaatgttgtgatatagctaacagaaaaagccatttaaatccaaggatttattgtagaaatacagtattagaatgaggaaatagcagcctctatttttttcttgcttactctgtttctgcaacactgaatgcaatcctagggtagagacaggctgggatgtgtttagaggaaagtgcaatggtaaatgacagaaattttctttctgtcttcaaatatggataagactcatgtgaaaaaggtattttaaatcattttttattatggtctcagatagcgtaacaagcaccaattgatgaaatgttgtggaagacacatctacgaggagtatgtgcagctctctggcttttcactaagaggatgagaatctactcaaggagggtgaggttgaagtgagccatctctgcactctagcatgggcaatagagcaagatcctgtctcaaaataaatgttctacctcttctcttaggtatattttcaaagcacaggtataggatatcctactgaagtttcaggatgaatcttaaagaacacgaactttaacgaacttcttccctgagacatcatgctccttttttccacaacagctaactttcctgactttaaagtttcaaaacaaaaaacacttattaacatatattaaaaacataattatttcttataataaaaattaacaggaagacacataaaaaataatttactagaaccgaaagtcctagtaattgctttaatcaattttcttcttaatccttatgctttaaggaatgaaaatattaaattggctcacaagatccatcctagtatctcctcttttccagagcaaatgtgtacacccttctttttcaagcacactagacacttatgtaagtgtcagaggcatttcaacagaagaccctagtgccacacgtgcagttcacttaacttttactaattaggcttaaagaagagcatctttgtgaaaatttattatatcacaatgaagatccttactgcattttaaaaacagggaatttttctctcagaccatactatgtctacattattctaattcagcatattgaaaggacactattattcttgccacaagattaaatactaaatgaccaggaaataactgtttttatttttaaatgttgaaatatgtaatatttatgtctttcataaacatacacaaatattatagtagaatccgtaagcatgatcaaaacaaaaataattgcatgttttgaataataagaagaatgaactggaggttttagatcttaacatgtgtctcgaggcttggacaacaggacctttgaggaacagtaggatgacaagaacacacacgagtttacttaggaatttaagatccgttcagtaaatcacatcttttccattgtcttcactactccaggttcccacatccctgacatagtagcttgttagaagtggagagtctcaggccccaacccagacctgcaggatgcaaatctgcttctaaacagtgccctggtgattcatgtacactttaaggagtttgggtgttatccttgtttttgagacaggatctcactctgtcacccaggctggagtacagtagcatgatcacagctcactgcagcttcgacttcctgggctcaaggaatcttcccatcttagcctccagagaagctgggactataggtccgcacgcaccaccacacccacttttttttttttttttttttttttttttttttttttttttttttttttgagacggagtctctctctgtcgcccaggctggagtgcagtggcgcaatctcggctcactgcaagctccgcttcccgggttcacgccattctcctgcctcagcctcccgagtagctgggactacaggcgcccgccaccacgcccggctaattttttgtatttttagtagagacggggtttcaccttgttagccaggatggtctcgatctcctgacctcatgatccacccgcctcggcctcccaaagtgctgagattataggcatgagccactgcacctgaccaaggctgaattttgagaagcacatctctaagccaccgactgtatcatgagaaatttaagactgctgttttaaaaataaatgtcctactctggtcatttttcttatgactaagattagaggtatttggtgtttacttttagtcattcacatacacgcacacatacatatacacacatgtacatagaaaatattttataaatatattatttaaattaaaaatctgagcatgtaagagaaatgtttttttatttagccattattatttgtaagttgaattccttttattaatactgcttctattatgcttggaatccaaaagcaggtagtgttaacatggagcatttttcagtgttgacaatcaggttggttttattaaagatgcaaatgtgaaaatggcaagtggcagaaagaaaaacaaatgtatggtctattaaatgccatgtcagaaatgctaaaagcccaattatataaatcgcagaaaatttttctgtagagcatttttatatatcaaattgcagttacaattctaacttaatggtctgtttataagagacatgtctatcagaacggttaaaaaaaatctgaaaataaattgtaaaaatgtataaatgataccaaaagtgcattatctacaactaaaggagaaacatggtcaactgtcaaccacatgcttcactgtgtttggagaattacagctattttctaagtgtttttgtttgtattttattacattaattattacattaaaattggctctgctaagagtcagtatataatctgaaaataaatataccaagaaaaataaccaaacttttaacagaggagatcacattcttttagacataatctatttcaagaaaaatagccaaacttttgatagaggaggtcacattattttagacataatctattttaaaatgtgtgaaaaatttgatgaaggaccaaattctaaacaagaaatatcctcaggtcagtatatttccattacaattctgaacactaaatggacaaaaaccaaacagcccaacaaaaaacgttcacaggatggaaattatcatcatgaaacacagggagtggtatcttcaaagcaaaaaatgaacgtgtgtcaagaatgagcagagtagagcgcttctcacgggccggtcagaaacaccggagcgtcaagtaccatgaacctcctgctttgagttcatgatgttctttccaagccagagtcaaccgtcattaaccacagagagtggctatcctgattattgggtcattccctggatagtcaaacgctattcaaattttacaagttgcttttccaatttacaccttaatcatttgtgagtttagttaatttgagtcaaagctttcttctgctctaaccacttctggatgtataaaggagattttctctgaactataaattttaggtacagaccttgaagttttgcctattacacttgagaggccttcgataccctcaggtgctatgaaaacctctttatcgcaaaagcaagcttcttgcggtccacttttctctgtccgttcccactcaagttctagttgctccctatatccagccaagccgattaaagctagaagtttataaaccacagcactttctctcttcccagagtgattccatgagatgacggactctaaaacaaacgtgtgttaaagtcacgctctagagcctgcatccacgccaggctggcacacgcagccccgtttttcttatgcggctttgatgatgattcaattaaggcaggtatgagcaggagctaatacaaaagctaatacgcagaggtgctcagggacgccaatttctttgggttccctataaagagcgtcgcagtccaggccaaacacagggactgactgacggtcacctctgcaggctcggggggcacaggcaagtccccacttggaaagtacagctcaggggcttgaactttgcctttttaatgtaacttcccttcttccattttgctttcctgagttctactgatgtgtgtgctgtgctagccacaacttctttccatttcagtgtttcgtattgtctcttctccaacctctcagttcggttctagcctgcgcaggacacagcttcccaatcctgggtctgcggcactgtcccaaaatgctctccataagtgaggaattatatttatttagcataggtttttctttgtgataatggtatatgaattacctgtctatatttagagtagctacctcaatgatttacaattcacacaaaataatatctttggttcgtggtagcaaaaattagccattttcataggagcaactctaacaatattattctcaattttgaaaatgaccagtctctggaccttgtcagatattattttacataatgcttttctcaggtcatggtttaatgataattatactaattagtgtatgaagctagggttcttgttcactgaaatcttgtagaatttcttcattaacttccaaggagtaaaaaacataaaacacccataagaaagtatgtttttctaatttagtagtctcagacattaaagttgaactgaattttttcaccataattctaatggctcagtatgtataaaaatccaaatcaacattttaaaaaatagttcttcaactatttcaaatcagacacatttgaaaacatacacttgtttcaaacatcaacctatcataataaacttgtgttaaattgaactaatatatattcttttttatataaatttagtttttggtcaataaaatctcgagaaatgcgtaagaatggcatgtcaaaatccatacatttaaatcaaattcatacttttaaaattagatttatcttatgtaggtaagttctaatcaatgaaaccttaattttgtatacatacaaagttatagctatccagttgtctcagcagtttttggtcctagagagaattgtatttttcctctggcagaaaattaaaaacactattgcagcctaatggattacactctggttttattactaagagaaagaaatgctatacagtttagttacaaatgatttagtaacagcacctaagctttaataagtattaaatataaatatgtagctctcaaagaatgactatgtatagtattgaaagaaagctctcttagatactatttaacactgtggtatcatatattctttcttagagtaacttaacattttaagaacccattcaggcttttgtttgttcatctgactattcacttattgaaatgtagcagacatttcttagatgctagaaataaagagagagagagggagaagtagaatgtagagagagagtagagagaagtagaaataaaagaaaaagaaaacacagattttaagctttcacaattcttagctactgagggctatcattaacttagcatactttaatggagtaacactctccaacatatttaaatctataggaacacgcatttttgaacttctaccacaagtacagtgagatgctagtacaaatgaggggtgaagaagatgcaaagaaaatctcacactctgctgtatagaagggcttctgagcttgatccaggctcagccacttccgtgcaatcaagtcagctaacttttgagccaccatttccccatttggtatctcatcggtacgctttgaagtacaggctaagaatcaagatatggtttagaaaaagaaaatcttctaaactgtaaaatattatgaaattgagtttttattaagataatttttgttactgtcagcccctcacatcagaaaccccgtgacttcacttgtgctcctcctgctgttaaattaagccctctttgggccctgtttcttgggctttgcaccttttcatccaaaattctttgtccaattccgccctaaaacccccttttccatggaatcaccgaaaacgtatggccaacaaattccagccagactagatcttcttctaggtgacgtacttagagcctggtgccctttttgaaagaattcactcagaatagcgactgtaggcactttggcaggggttcaagggctatggttttaagcgttagtccttttcattatcctgcaaatctcattttaaggcaaatgcagcattttcttcttgcgaatggaagtggacttgctcaccacaatatcaggctccctcaagaatgagtgattcgtgtctttatcatcggtgatgagagcaattaaaaggtctgttttacatgatcagtgaagacgaagggcttgcccaagtgagaatgaaggaatgtgatctattctagcgagcatgcattttgtccaccacagctgggtaggataattatacaatccaacctgggcagcacaaactatgcagttcatttatgcatctgctgctgagcacatactctgagctgctggggctaatccacaatccacctcggtgggagtcaccggtagaaccttcactacagcagcgaggtcattctgaaggcatcataccatcaaaagataactgtgtgggttctctctcagagaaaaatagtgatacctggcatgtgacatactctgcaaacaacattctttaaaagcataattgacttagatcataaaagaattgtgggacactctagtgtaatgaatctgatgattcaaatgccatcccaaattagagagagggaagaacaggaataatttctcaagcagggaactcgtgagaaggcggttcagagaagccactgagtagggagggcctccccaccagaatggatcaccatcctctggggctagagctgcctgcacgacacaggaatggcaggtgctttcggctcctgctcctaagaggttgaagagatttggccaatctttacttatagggggagaggaaaggagtccttgttttcttgtctcttggagaatttctaccttcagtaatgaacacagcattttattgagacatgcctttttcataagtagtattgaaaacaagccctattttctactctgaacggagcctgctcttctcatttatttcataaatatgaagaatttgctatatgatagttaatattctaggatacggttttcatggcgagacacacaactaacaagattggtaagagcaatacaatagtgtgttaaaaggtggtacttatgtcagagaaaatttaagcaggaaagagaagagaaaatgccctcctaagtagagaaacattttaaaacccaaagcaaatcactacactgatatttgtcttaatttatgatcctcctacggtgactatattgtcacctgctaaatacactgaatgttgtgcttctctctttattctggagttagcatcattatcaaccttctgctttatactcagttgttgattttgcatgccttgtggcacaaggcttttccacctaccatcatcctggtctctagatgaatgagatgccaatgtcctgtggcccaagcacatcgaatactgtgtaaagcctgggatagaggctaaaaaaaacatcgaaacccagccaaagcatcatttgtaaatgtctctattcatcaactgttcaggtctcttttctgtcataacacgcaccaggatatctgttgttgctttaagcaaaggataatcaatgacaaatacactatttattgcagaaactaccatatgttctgccttctacttaccacaccgtatattggctctgctgatgtattagtttcactaagttatccatcttccaaactctatgtagaagtagaaataaaaacagggcactcagctgtgcccccaccctctgttgaaatatgactgatgaaaatccttccttagaagaacaatgacatgctaccaaccaactcacagagaaaacccacaacatgtttctactccatcaccttggcacataaacatcatgctcaaattcctttctcttaaatggaaacaagaagaaaagcaattcaagcaaccgattacaatctttagaaagcacacaagcaaatcatcatcctttctacaagagaagccagagtgcaccatctgagttggaaatgtgtgcatatggaaatttgttttcttagcatggttttctgctcctttgaatactttttaaatctgaaactaaggaagtcacattttatttgctgctgcagtatcatatttatgacccaagtaagggtgaaactctggaaagtgtggctggctgtgcgtcagttcccattccttgttagtttctttgtaactgttcgtgaaacggtatttatcaaagaacagacatcaggattattgggttcagcattctgagaagactcacggggagaaatcatagtgttttcattctaaattatttattgactggaatgtctccagaatttaaatttttagtctaaaattcaagtttgtagggggtgaatagcccacacctgagttgcagatattcaaagaatactcaaagtaaaatgcatttttacagacttaattactggttaattattgaataggtatttagtagcgtgttagcatcaccattgtgaacatatgccccttcgggagagttcaccactgtgaacatacgccccttcaggagagttattcaacaaagttattccggtcctgttactctgaaggttctctgctgcagacactgggcagtaattctgcttccttaactcactacaattcttctaataagttctaagctactggcattaattaatattttccctttgtcacggtgaccagttctgacccaaaactgtgtgtgtgtgcctgtgtgcgtgtgtgtgtgtgtgagcgcacgctcgcctgcccatgcagtctccactcgctttgctaatttcactgccacatctaatattgtcatgagtcatagattatcacagaaaagaaaatctattgattgatatggattagaatattcttaacaaatctgaaaactttttcattaaagggttaaatgttatctttagagagaatatgctcattttataaattttactacagatttcttccaaggttacttttagtttgacattggagtatcacaaaatcttacattaaacgtaaaagccatttaaatgttcagcatagttgctaagcggtccttgatagtgtaaacacttcatatattctgaaggtgtttagaggtattgccgtttggccatggaaataaggttaagacccttcttgagaaaggaattccaagaaccattagtgatgacttgtggttagcacgtgtattattttatttttattttactctagacttctaaaaccatgcttgtttattcaggaaaatgtcaatgatcttgtacagaggataattatctgttcttggaatgtaccagcgtcaaaagtttcactttaataattccagtttagtaatttttaatttataaatttaccaagttagcaatttcaacttaagaaattcattgcaataattttaataattacatatttcataaataatatacaccatctagatgcattaaaatgtgtaagtctgggcctgtatgacacattgtttaaaccataagatgttttgctggtaatttggaaagccagggtgtggatttacggcaaaaagagaaatgcaacttcaaaatcccgggtcttgttttgtctctagattgtcaagcgccactaatagaaaattagccaaggtcttcatggttccctcaagtgcctgtttaataaaacccttgtttaattgaaaaaaaaataataattattattatttttttgagatggagtctcgctctgtcgcccaggctggagtgcagtgggcgatctcggctcaccgcaagctccgcctcccgggttcaccccattctcctgcctcagcctcccgagtagctgggactacaggcgcccgccaccacgcccggctaattttttttgtatttttagtagagacagggtttcaccgtgttagccacgatggtctcgatctcccgacattgtgatccgcccgcctcggcctcccacagtgctgggattacagggtgaaccaccatgcccggccctgacttttacttttactcacctctctagaaactgctgaacagaaaattgagttgcttttttaaaaagtagtttagggttatcaagattcaatttccttaggataaatatgtgttgcaattaaatggtttagaaaaccttggattaaataatatctaaaactcttatgggcaatgcctcttaatttcatagtcattattatattttaatgttaagattttcctatattttgaaaattttatcagcataggtcagatcttttttcactttataagtaattctgagtggttcgtgatccagcaatgagactaagagaataccaaggacatacacatctaaataaaattaaaggaatctagtttattacaaattcattgtgattaaactgtgtattgagtttcccaatagaaacttgacttttgtcagtaaataccgaattacttcccaaggaaaaaaaaaaaaaagtagtattagcataaaatgtttcgttggttgcttttttatgcttgtttcagtatcaagggtctactgatagctgatgagatattgggatttagtgaagggactgtgaacacccagagaagcagtactaggtcttactaatttggatagctccattgcctggcataatgttggtgcttacagccatgtctgtattgacactttaagggaaggctttaacctggattgtcagacccttatatggtggctatttgctaagattatcaaatctttcaggaggttcctcacaccaggtaaagtttgatatacatgtgcatcgttaaagagagcatgtctgcctgggagcagtggctcaggcctgtaatcccagcactttgggaggccgaggtgggtggatcacctgaggtaaggaattccagaccagcctggccaacatggcgaagacccatctctactaaaaatacacaaattaggcagacattgtggcacgcacctgcagtcccagctacttgggaggctgaggcaggagaatcgcttgaacccaggaagtggaggttgcagtgagagtgagccgagatagcgccactgcactccagcctggacgacagagcaagactctgtctcagggggggtggcggggcaggaaaagagagcatctctataaaattaatttgatttcctcagtagttcattaccctaaatagcataaaaagtgtcctggattttgtggaatcatgagctagataactttctaaagttattttatccctttaattccaagattttatgatcctaatagcttaatctcacctacagataaaaaacagagtttattcaggataaataaatagcagcctcaagggtgaaaaatgccactatcaccctcagtgaattattttaacatttttaatggtcagctaccctttctctgaaacacagaccaattttattttccctgtcagtctgctgtggagttaggagcttggtgtctgacattgaggacctctgcgtttgcattctagctctgccccgtacatgcagagtccacatgatgtcttcggtttcatgttctctgtccgaaaatagtgcattggtgtgcagtttagtttccaattaatcatccactttctcagtaaagtgttagttccagagtcaggaagatccatgtaatctgagagtgggggaagtgcaaagaatatatacatatacacgactgtatatatgcgtgtatacacaaaatactgattagtatctacattaaatatgtatatgcaaactgtgtatatattaatacaaaaacatatgtatattcatgtctgtgtgtgtgtacatgtatcacatatatatatcacatgtatatatcatatatatgtatctcagttgctctttagttccttaccacttctctaggaagtagaaaaaaaatcacttcatcataaacagtactatcatatcttaatttttttgtctcagtgtataactgtgtacttgtcttgacaatacaatttcatttatgagcatttaaaataaccctctttcaccttgcttgaaattgctttatgtatttctctgtgagcaatcttttttattctcttgaacaatagatgaaacaaaagctctgaatttctgtaaggtcataggtatggactgaacttgtgactgattgtttcataaaaccttaggtactacctcgggtgatgaaggagagatctttgctagtggctttggttataagggctaaaacgtgaatacctctttgaaactcaaagttaaaactctgtacccagatgcacagagtgaaaacgaagtgaattaaatgcatgagtgaaattctagaaaaatgtaggggagcaagagagaggggaaaattgatgtgccatattttctctccagcagataaaatctgatggtgaaatgggattgctctacacaggggtggtttacctttggggcaacgaaaaagttgcttcttggatttgctccgtggaaggacaaaagtgaggtattgcagactaaacaggagagaaggcatcagtacctggagaaagaaggatggaggcaaagttcctgaaataacaagttgaggaactaggcagatcagcatgtcttttctcccaaagatcctgcaccacactttccagcgctattacagggcttcccagtggcgtgatgatgctcacagcagagccaaagaaaatcattactttaaaatacaattatggatggtttggtatataacgacagttattatttatccaatgcataataagagaaaatacatattactttatctcatttaaccctcacaccatccttaaaagatggatgctatttttggaaacattttatggataagaaaagcgaggcttagaaagctgaagtcacttgtctgagatcatacatacaggaggcaatggagacaggagtaaggcccgggtccccatgatgagctcatttgcttttttctgctgttctgggctgagtcacaaaagaaaatttcccttatattgtagaggatgatgaggaattttggaatacatttaaatgaccaggataaaaggggctagcactgtctgctttcattttgtcgatattgtaaggtctgtttttgtctcttccctactttccaccataaaccacacacacacacacacacacacacacacacacacacacacacatgcgcacacactcctttgtgtcttatgaattttcccctccattcttctttttcatttcgtacaagcccacactcgttgctcggtatactaagtcttgggttcatgattgcacctgccttccatcacttctcattggcacccatgaacctgacatcctcacagtatcaggcgtctcactgttccgcagcaggacatgaccttttgatgctgccttcttctcaggttccctggtgtctcttctgaccttctgctcctttaacagctaataccaccttcaaggcagagctcaagtataaacagtttacattctgatgggaacattccctttcctccccaccactgcctcctcctttactccatcgcactttcttcatcctgttattatttcgcactgtgataattgaactagattcctttacttcttctaagctagaaggtggcagggagttgttttcctgttcatctgttaccagcacatgcgagatgctttatgtgctgccaatttaaaaaagcaaatgaacagcttcaaatacaggaagagtaaaaatagtctgcccagctaaagattcgctttgaaggttgttaacattgacataacataaaaggaaaaatgtatgcgttgctcaccatatttagaaatgtgaaatatgaatcgtatgttacattaaacatttattcttggtggtagcaataaaatagacacttctgattgagcaaagcatgggctgaaacctgtgcactccaccattcatctctacaactcttaacagtcgggatctgccatttccatgtctcagagaagaaaataagattgactaagaagacaattgccagaaattgcactgttacccggtagagaaagtagaatttgaccaacattcaacttgaaaccttgtgttctggctacagcgctatcccacccacatcaggtattaattgatctgtagtgtcatatcccaactgggtcacatacaaataagtagtaactaacttgtatacttcccaaattagcatctgtgtcatgcatgcaatttttgcacttccaagtttagcataaatgcactcccaaaattagcgtctatgtactgcacactttgtttttttttttttaaagccaagtagggccaggcgcagtggctcatgtctgtaatcctagaactttgggaggcagaggtgggtggatcatgaggtcaggagatcgagacaatcctggctaacatggtgaaaccctgtctactaaaaatacaataatttagccaagcatggtggtgggcgcctgtagtcccagctactcaggaggctgaggcaggagattcgtttgaacccaggaagcagaggttgcagtgagccgagatcgcaccactgcactccagcctgggtgacggagcaagacttaaaaaaacaaagtcggatgagtgtggtggttcacacctgtaatccaagcactttgtgaatccaaggtgggtggatcacaaggtcgggagttcgaaaccagcctggccaacatagtgaaaccctgtctctactaaaaacacaaaaaatcagccgggcatggtggcatgtgcctgtgatcccagctacttgggaggctgaggcagaagaattgcttgaacccgggaggcggaagttgcagtgagccgatatggtgccactgcactccagcctggtgacagagggacactgtctcaaataaataattaaataaataagcaaaagcaaagtcataggccaaattttaaagttctcttgtaaaaatctcatgtccacgcagtatttcctgagtctttgttgtttatactcatgtaggacaatatttatgactttgccttcaacttggaaatattttcttctttatagcacttgacaatcttatgttcacttttccttttgggatattatcttctgctttgcaattagctataaccttcaaagtgctgctttctcctgaaatacttggttctgatgacttcaagtacttatttactatcttaatttttttatttaaataaatttactgtttctatgattgacatttatttttggcataacgttaaaattgatgtttcctgctttcaactctgtcttatacacctgtcctgattttctatttgatgtaattttttgatgttctactgtcacgttgattttatcagatggaaagttacttttcatcgtctccagcccccagaatctgccaaacacatctgtcaatggcattattagttttcaataattcgcagttaaagtttcacacaattttgaatcttgcttccgttttctgtatgtagagttacatattcattgctttttgaatctccctccaaaatgtcttcatgaacgctattttttccattcttaacgacactatcttattgttacattaaatcactcctagatgaaaccacaccaacctggtccaacgtgagaaactcataatgggctgctcggccttcagttttttcctttccagtgaactctacacattacctaaaacactggtttcattgtattattaacaaaatcaaactatatgatgaattatttagtatgtgtgagtattaagtcatttgctaattgtttagttcacaaatacaaatgctaaatctccaacctttttaaaacaaagacctttattctatgtatgttccaaaaaattctttttcacaggagtatatagtaagcatattctgtatcaattaaactttatgaattctataattgcacacacatttctggaaaactgttgatctatttaacatctagcataatatagggcatcatgatgatgaaatgggttatacagaaaagagctagtataaaatcacattgccatcatgcaaaattgagaaagttttaaatattgaagatttccagaaacaccataactcatcaattcaggcatactggccatatttttaaaagtaacacttggtttttttctgacccgaccaagttgaagaacagtggtgagttcatcatgacagtccagtttcctaaacgctaaaagttaatttggggaggaaataaattatatataaatgtaaataatatttgttttaaccccatgcttaatattattctggtctactccaacgaggtatgtataatgctattgaaatagagcatgcgttctagacttgtttttgcagatgtatcttcactttggctcactaattgtctcactccaggattaacttcgccctggaggatcagaaaaaatagaagctagacagtcaatttctagttttcaccccatggttccatatttcttttggagttacaggaaacaggtaaaataaatgtagcagcttcctgggagtcatcttgggcattttaggtctatattttctatgtctgctggataatagaagagctgggcccaggtataacacagtgactgaaaaagggtggacttcactttttaacctgaaagcaaacttggcagtccaaatcatcctttaaccggaaacagctgtgaaagctgaatgtttttaaaagaaacctgttcaaacacataagctggtgaggaaagagtgcagatatagaatatatttagattttattagtagactgttcttatacaatatgcaggaatgcattgtgtttaagaaactgaaacagaaatggcaagaaacaggataagtaggacaaagaacaaacacaaacataagtcacattagtactgagaatagatgcgaataaccagatttcacttctataaacatgactggatttactttatcaatattagtttagctgttttacttcaggttctccttagagaaaacaacttgcaattgactacattttaaaagtttgcaaaatgataatggaaataaaagatatacgtgactaatcataacctggctatcatgtcttgaatttctcctgtgtgctagctaggccccaactcagtctttaagatgattcaatatacacaaaaactcgttcatctatacaatagtcaccaattatgagctgtgatcctggagagcaggaaggttaactgacttattcaacatcaaacagataatgagtaccgcagctaggcacactgcaagagggagaactgggatttgcatccctaccatgtaggtgacacagactattctggataggctaagtctgagcaatagcctacaggagacatatctctaccaagttggattatgtgctctcttcagcttttatgaataacacatcataattttgtgtaaaaagcgacattatgctgggcatggtggcttatgtctgtaatcctatcactttgggagggtgaggcaagcagatcacttgaggccaggagtttgagacaagcctggccaacatggtgaaaccctgtttctactaaaaataggaaaattagcgaggcacggtggcgcacacctgtaatcccagctactggggaagctgaggcagaagaatcgcttgaacctgggaggcagcggttgaagggagccgacattgtgccacctgcactccatcctgggcaacagagagagactttgtctcaaaaaaaaaaaaaaaaaaaaaggaaaagagaagaaagcaccacattatccttgagacaggatttactgcacaaactccctttaggatatcttctttccttctctctgcgttacttttctcaggtgagaaatttccactgaaaccaaccaaaggaaataattggcaacattgaccaaccaaaatggtggtgtttttctgcttggaggtgtttgcatttccttctgataacaagagttacctggctctgatgctgttcctgtctttatctgggtaaggaggaagcccaccgactataatgaaggatttatatttcagctgtttcccaacgttgccttttgaatgttatgcttaattcgctggttctgattctttgtgttatttagaatttgcctctatgtattatgcattttcaagttgcacccaatcctggtagaatgagcaaggccatagattgtagaacacaaaatggcataaaggtgacataaaggaagcgtgagcaaggaaggagctcagaaaagaaagagatccctttggactgtgctggtcagtagggccttctagaaggaagtagtgagaggcagaaacgtcagtgtattagtccattttctcactgctataccaagacttggcaatttataaacaaaagatgtttaattgactcagttccacatggctggggaggcctcaggaaacttacaatcatggcaaaaggaatagtggacacatcttacatggcagcaggtaagataaagagagtaaaaagcccaggggaaactgccattaatgaaaccaccagatctggtgagaagtccctcaatgtcatgagaacagcatgggagaaccttcccccataatccaaccacctcccaccaggtctctccctcaaaacctggggattacaattcacaaagtgatttgggtgaggacacaaagcttaaccacatcattcagtggtgagggatgagggggatttcagtagcagacggtggagggtttgcctgttgcacagagtgaagtgcattgcatgactttgtaagaatgtcttaaataaggttccccaggaaacagatgcggagatggagttgatgtgcagaaaagttattaagatatgctctgggagcaatatctgttaaagagtgagggaaatgcatttgggctgagggagaaggtgaactttgacacatttgtaaaggcctcagcctgcctgcagctataattcttgttagtgttgtcttgacttgaggccagaggctctggtctctttaacctcaccatcagtgtcgttggatgatgactgccctcaggaaggatgccaccagggaaggaagctctttcacaagccaagagggcatctggtctgaaagccccagcagccagcaatgccaataaagggcagtggacagggccagcatgcaagaggctattatccaatggcatctgagcatctctgaaaaaattttaagttcaagggtacatgtgcagaatgtgcagatttgttacacaggtaaatgtgtggcatgctggtttgctgcacctatcaacccatcacctaggtattaagcccagcatgcactaggatttttttcctaatgctctccctttccccgaaccatccccctgtcaggtccccatgtgtgttgttcccctccctacgtccatgtgttctcattgctcaactcccacttataagtgagaatatgtggtgtttggttttcggttgctgcattagcttgctgagaataatggcttccagctctatccatgttcctgaaaaagacaagatctcattcatttttatggctgcatagtattccatagtacatatgtaccagtttctttatccagtgtgtcactgatggacatttgggttgattccatgtgtttgctattgtgaatagtactgcaatgaatataggcatgcatgtgtatttataatagcatgacttatatttctttgggtatatacctaaacatggaattactaggtcaaagggtatttctggttttagaactttgaggaatcaccacagtgtcttccacaatggttgaactaatttacattccaccaacagtgtaaaagtcttcctatttctctgcaacctctccagcacctgttgtttctagactttttaataagcatcattctgactggcatgagatctaagcatcttaatggctcacacaggatgtctgcaatagtcataggctgcaacatcagtgaaccacaaagtgcattctaataaatctatgtaattatctattgttatatgcactatttttagagtactatttgcttaaaaaggaatgcaaatataccagcctttggcatgtgaagataattcttctaatccttataaacttctgtgctggtttcctagtgaaatcaacatgaaggtgaatcgaggacatgtctgctgcacaaatgagattaaaattctcagctgactttatgatacctttgtggctagaagagtccatggcatttcctaaatgcctaatatgctactgactaatcctgtgagaattaaaacccattaatttcccaatcaatagaaagcttttaaatttgaatattctttagacatatattattggcaagcaggaatatttttatttctagaataattatacctatgaaaaaatagaaaaatataaaatacagcacaatattgttgtataagtatgctggtatcatgagtaacattttgtctatttcctttgttcatattcttcaaatttactctaataaaaggtgtattttgtaataatgattaagtttggggaaagtattttatcagctaagttttagaactaaatttagatctgtcaaaaacaaaaacacgcaaaaagatctgctgcattaggaaggaattcccatagaataatcataatgcctgtaatatacaactcatgtcatgaccttttagaaagtgtgcagcagaagttatggtagcatatctttctcaagcttatttataatttattgacttatttcagaccaaagttgcattattagcttccacactcacctccctttatcattgtgagtagcagtttggtgtcagaatacacagtatgttgtatctcggagcccagagtgattattagcagaagtatgtgtttgttaatcagactgcaggtaaatgtattcagtgaatatgcaaaagagtcttctacacgtaaaggaaatgaaaaaagtcactatgaaagcgaaatctaagggactagctgaaggttggtgtctaccagagtagccaggaggtcacaggagactatggaacattcaaagtgggctcttcagaacaggaaagcatggtcagtgtaaaatgcacaagggattttgaacaactaatggaaacaaaatgtaaaagtcaatttttacattaattacatcttgaaatcgtgttacttggtgtgtgtgtgtgtatatatatatatacacacatatatatacacacaattacataaaatatgttgctgaaataaattttacctgtttcctttataatttctagtgtgaatactaaacatttaatattgcatatgtagtttcatcataaattgtatatgtacttgggcagctctgacttagagtttgaaattccttatgttaacatagctgcgatggttacctcttattataaaccatttatctttaacactcccaaatgaaatcattataattcagaagcatatagactacctttattaaaataattaggtgtttttgctcaattaaatgatgcactgtttattctgaagtaatgaattagggcagaattatatttaactactgagcatgtaacttgttttatctttttgtcttaatattgtgaataaacctggtagtaaataaaatagcaaaatagtaccatgcatctatctatctatctatctatctatctatctatctatctatctatctatctacctacctatctatctatctatcaatctatctatctatctatctatctatctatctatctatctatctatctatctagattcccagtggaaaagcaaccaaaattaacatggaaaactcaattacaacttttaatatattaagactcaggatactgattaagaccaaataagtctcaaatgatgtaagtatagtagctggtgttttaaactcaatttcccctataaaataatggaactgaaataaatgtaaaaggtaagatgtcaccacctagcaaaagagaaccaaaatatctcgtatatttataattgttgtgctaaaatcatatctgcatggtacctgcttgcgctattttaaaatctaaactaatgggataattgtgtggtttacgggtaattggggagagagaaagaatagctgtttactggtataacatttaataagtttatatttataccagtaaactttgtttactgctatacatttaataaaatccattttatcggtattctgagctattacatatattttcatgctatatcaaacgtgtattttctcaagcatctcagttatttaacatgctgtgatttaaattacagatatcaaatttacataggtaagcatatatgtctcctaaaaaacatcaaaaaagtaacctacatttcaaaaattcatagtcccatcaacacaggaagaaccagtgcatccctctgagcctgagtgatgggccccgcatttgcataggacgcagcgtctccacctctgctgtagctgtgtggttctctatcaataaggtcattattcaggcccagatgcatcaccagagcgagctattgtgcttcctccatctcaattcagtgctcctgcagcctgaatctcctctgagctctttgaaatgaggccaaaaaaatgtatctaaattacaccatttactaacgcgaagaaaagatctttctttggtatgtattggagttaataatatttattaggcatctcatttatacaccctgccatagcagcattgtaggtagggttataattttaaaagtctagactggcttatatttctcaatatctggtggcgtgtgggaggagacagataaggaagccctctgcaaagacagactgtgagtttaccctgcacccctagcaagacttccagggtacagctgtaacatccagtgtcaaaaattgttgaatggacagaaaagataccaaactcagcatgaagttacaaagacgaagaggttaatacaggaaataaaaactgtcaacgatcaatttaacagcttaaagatctgggggtagaattgacttcaaaactgttattccgtgttttctttctgaaaactcttttggacaaaggaagaacagtccttcgtgaatttcatgtgctttgtagatataaagtaactctttccctcctgaatgatctcatccccaattatcacagcaagatttcctattgcattcacagtccttcctgttctaggtttttaggcagttaattcagtctgtgctgagagtaaaatataggtcacttacaaagaagggtgcattatttataatagtgacatgatgagagctccataatcattcaataatttattgatgacttcttataatgtatcaaccatttttctatggttggggcaccatagaaagagcagatctattgtcttacttgctgcgtattttctgaatgacttatgcctccactctttgacctcattttaccaattatacttaatggattaaatggtcactgagatataaataaagattgagtttcaagcaagttttgattgaagtatattattaagcagaaaatatgcaatgtactggttctggaataccatttcaagaggcagggcagtcgtttctaactatatgttaacttatctaaaagactgcaattaaaattattaaaggatcatggtttaatttccatttgaaatattttcctgaacggaaagaaaactaaaatacatgattaagccacgactacataaccctgagcacttcaaaatattgagtctgaacaaattatattccttatgccacttatgacatgtcaaaatatcagaccctgatagaaaaccaacgtctagtttttcatttagatcttacaagaagcagctgctagatgcccatgaattacgctggcaacagacagcactctgtctgcatcatctatgcaatctccacctccagagaggtaatctactttatatgagatttcgcattattcttgtttttcttgctttctctaaggagcacccactgctgaaatcatgagagtgaccatgtgtttttcagaggtagataataaaagttagacagtcgtattgtacagagattagggaaatatattctctataatattgggggtagaggtgagactatctttttgaaaacatatagtagagcaaaatgtataaatttagaacctagaaattagtatcaattcacaaaggagcaatcatgagattaataattttctggcatattacttttttacaattttatcaagtttggattcaaacaaattgaagataattttacgttatcgtctgtattcttaaaagtattaagtcgagaagacaattagtattccaaggaatggaattcttcaaattaagtgttctgcccaaattggaaaccagccaagctgctctctaaaaatatcaatttaaactactgttttctaaaaaagagtggaaagatttttgtctactggatttagataattctctttggtgttcttaacccacttttcaaaacataaaaatttgttaaaaaaaaaaaaacccatctctactaaaaatacgaaaaattagccgggtgttgtggcggctgcctgtagtcccagctactctggaggctgcggcaggagaatggtgtgaacccaggaggcagagcttgcggtgagcagagatcgcgccactgcactccagcctgggcgacagagcgagactccatctcaaaaaaaaaaaaaaaaaaaaaacaacaacaacaaaaaaaaacctttgctgaggatggttatttgaaggtaatttccatgttgcacactctttatttaaaattctagagctgtttattgaataccctggaatggctatttcttgtttaattaagcaactgcatgttttcgcacctatgtagagagctatcacacagcatgaggaacaggtatgcaacgcatgggctcattcactgggttcaaatcttgggtctccctctgatgttcacacagttaatatagctcgtgactttttttctttattttttagaaactgtgttcttccgtctcataaaaaaaatggcatagctcttacctaggctgaatcttacaataatgactttccatatgtgccacacaaagagtttagctattaaacagctctaactcaggggtagcaatcccttctgtgactgggatcattttcacttcattgttctccacaaaactgaagaagcacatcatcggattgtcagataatacattgaggattatagtctttcaagataattcactgtatactgtttcaaagcgtaattcaattaaatgcagttcagttcaaaaagtgtttgcagatgcctatttagtttaaaattatactgctgggaaggaaatggaaggcaaagaaagaaatggaaataactcactaattgatcaactgagatatggacaatgctatcaacctcctgagcagctgagaaaaaattggatgcaaggcagaaaactgctcactaaagatatatccaagcaaacttgctgtgctggagcaaacgaaggagtggctaattcagattgtgcccaattgggcaggcatcaagaggaggaattttagttggggtttaaattattgggataatttccataatagagagagcctgggggttgatgaaaggtagctggatgtggagttaacaatagttagagagagcttagtaactgggctgatttctcttggcccagaagctaatctgttgatttacaaacatttatatcattaaatgccaaaagggtttgaagaatcgagcttagctaattccacatagtttccaaacatttatgtaaagattaaaaaatgtattacatagtttggcattcattcaaatatatattttttaatctttacataaatgtttggaaactatgtggaaatctagctagaagaaagacattttttcaaaggttattacattaataatattttacagccaaataaacttttgataaaatgtacaatgctttgtgtactagtcctgtagacctgatgcattttccatgaacatatgttgcctactaacagagcatgtgctggtgcgttggcaacaagtggaatgaggtatggagtagcagaatatcctgtcgtgactatcttacctgctagttacctttttcattcggtgagccaactatgtatgcatgatgtgggggcctggtgtaaggttgttaggacacaagaagaaattaggtttgtggattgaacgagaacatcgtccaaagccgtgagacagagttctccttcgatcacgaatatatacagaaggctaacgtgctttacaaagaaaagaagagagctgcaaccagaaagtcaggcaactatgcaacgacctaaaattcactgcattgcattgtcaggataattgagaaatatgctttctgcccaaatcttgcccaacatgcagcagggcatttattgcgtgtttactgaatgaaaaagcaacaaaatcaattaataataaataactcaggcactcccatggagcccatggtggctcctgagggaatgaactccgaactcaggcttccaagtaaacagaacctccactaatcctacggtgtttcttcacgcctgatttatgaaggtttgtacgcacaatgagagttggattctacatatgttacatcaatggacattatgttaaccatgatttcttatgatttctcatatgtataaatatataaatatacattaaatcttatgttgatattttccgcagggcttgaagattaggccctattaaaaatatgtacagagacactttgactgagttaagataagaagatagtctaaaaaagaaaatatttcttagctcttgtcttcttggaaaaatgtactatggatacaactaaataatacctttcaggaaatactgctttataatgttatctaaagtacaaatcctcccaactttttatatctaaaaatgatttggatttcgacaaagcgatgcagtgggttaataacagtttggacataccatgttaatgaacactgaaaagcccttagcttattgaaggccataatttgcagatgtacactgtcgagtcccaaatggatgcaaggtgaaaagaaacaaaacttttaaatgccaattaaaacaagtagagttgactatcatggtgatagaaaatagacatttattttcaaatgtagagacttgtgaagaaaatcacatttgcctttacgaaacataatccctttctttttattctggtacctgtgcactatcattctcattaaaacatcatcctgaccaatcccgcacatagctcactggggctctgcctccctcaccgctggctgctggtctacctgcctgagaccaacttacccccacatggattagtatctcaccatcctgtcctgtgtgttctggggcctctcctccctttccgcattcatcaacacagtcctccctaggacctgcgacctgctattactttaagcttcttcgtctttcgttattctacatttagctacccacagtcacctttttatgaaagcattcacaggtacccaggctggatgaaacaccacttctgtgctcaggcttgattttgcatttatttatcctttgtgcaattatttgcttacttaaggggttggtgttcccaaacacttatttacccgaggcactggagcacccaactgcccaggagtgtccctctcctgagtgatgctactagctagtttacagtgtaggcacatcttattgtaaaagatgaattaataaaacaaatggaaagtaaattttgcatccttcgtactcgagggcgtgggtcaatctagcacagagtgtggagcatggtgggcattcaattcacatttacgttcaacagacacatgcgttgagttagtcttctttttaatgtcttcagccccttgcataggaccttccacccagcagttatgtgttctctcataactgtaaaagaaaattataaacagatgttttggaaaacaaaactagtggtgaaaattagcaggacattgatggatgactttgggaagatgccttttatgttggaatgagcttcccatgagtgctgctctgtgggctcctccttcatgtcagcccctaacctccgagagagcacaggtaagaacccaccacactcattcgtatactcgcctatgatcgtaacatgagccggtacacagaggaagacaagtccatcaaagcttcctgttctttccattcagaaaatccttccatacagtctgccgggtgtcagcgactgtgttaaacgtcagggaaacaaaaatgcattatttgcagttgattctcttaaaggccttggtgcttagctccttagctgagttatttgggatgaaactctgtggtaatcatttgtttgagcctcttctgtagaaaatgctttggattgcacgagctcagagctgtttctgatttgttctgtttacctggtcttctctgcgtggaaggggtgatacccgcaaagtacagtcaatcacagatgggagggaaaggtgttggcgttcccaaacacttacccgaggcactggagcaccaaactccccaggagtgtccctctccttagtgatgctactggcttgtttacagtataggcacatcttatgggaagagaggaattaataaaacaaatggaaatagaagcagttattattcatatgggaaggggaggtggctgagacatgacttccacttctcccctttttcctagccgagtcttccagcaatcttgatagacgttattgattcctcaccatttacctaaaagtcaggtaaataaattaacttgtgactaaactgttatttcatgtgaagaagagaccaatatacctgactgtaaggtactacaaagccatctcggggaatatcatttagaatgtgtgaggcaaacagttaacagcttggggcttgcagatggacagatctggttcaaaatctacttgctctatgaccttgaccatttatttcacctttcttgattttagctttgtaagatgtggctaataacaccacatacctcatggctttatagataagatgaaatgaagagatgcatataaaacactggaaaaggcagccagaacaaattgagtgcctgaaagtacacctgaaggaatctttctcagtgtgattaataagctactacaattaccgtttaagtaagtatactatgggttttattcaatgagggaattatgcatgaggagcaaacaagtgcaattttactattcttggcattttgggaaaactttagaataaggtattatctgaagatcacttatgaagataaatacctatgtattaatataacatttgaaaaaaattatgaaatacttagaatattttcttttgaagtaaaaatacctatgtcaccaaacagcaattttgccaatgttgcaaaataagcattgtaaattaatgaatattctaagataatttctgatctaaatttcatctgttgaaaaagaaacgggaggcttggaaaggctgacggatttgtggagctgcacgtcagttgcataggaggtgggaaacgaagtgaagtccaaaccaggtaagtcaaggcacagcctgctgcccctcccttgccttttacaatgtgaattgccacgtttagcattttctacttggcattttaaaaagcttatgttgttgttattatgttctcttaaagaatatatgcatcccaccactaacatcattttttcctttaataaaaatcatgaatcctcatgattaattgggattaaaaataagaacaataacaagttatttactctcaaaagcaaaagctggacagaaactctctctccctccctttttgcagaaagacattattctgttactccggttcctttctcccattcaggaaataaatcacagaggacacaaatgcatgaaaagatacttcatgctcatagatcaaaatacttaacgttgttacaatacccatagtaccagaagcaacatacagattcaatacatattcctatatataaatttttatattcctatatacttataaattactgtatatatatattcctatatacatattcatatatgtattcctaattacatataaaatttgtaaatatatatgtgtatgggaatatatattatatataattagcaactatatatgtacatagaaatatatatataatatgtaattaagctattatatatatatgtagtacgtaattaagcttttatatattatatatatttcctaattcttatcaaaatcccaatagcattcttcacagaattttttttttaatttctaaaatgtgtgtggaaccctaaaagacctcaaatagccaaagcaattctgagaaaaaaatcaaaagttgaaggcattacacttcctgatttaaaattatagtacaaagttatagtaatcaaaacctatggcattggcataagaaaaggcacatggaccagcggaagagaatagagagctgaaataaatccaagcatatatggtcagctaattttcaacaagagtacaaaaaggatacaatggggaaagaataatcttgtcaaaaaatggtgttaggaaaacaagattttctcatgcaaaagaatgaaattggaccctttataccatacataaaaatcaactcaaaatgaataaaaatcctaaacataagacctgaaaccatgaaaatcccagaatacacaggggaaatgctcgttaacattggccttgacgatgatttcccatatatcacaccaaaaattcaggctacagaacaaacaataaataaatgagactacatcacactaaaaagcttctgcacagcaaaggaaataatcaacaaaatgaaaaggcaacttacagattcagaaagcaatatttccaaaccatatatcagataaggagttaatattcaagatttgtaaataactcatagcactcaacatataacctcatgttaaaattggtgaagatatgattcagtttaaacacacattacacagagaagactgaggcccagaaatggaggccgctttgcctaaaattagcaattttcaagaggcagagctggatgaggaagtcagtctacattctgtaattccaagtttctaataccaatgttctctaccatatctaattgtattaaagtttctcccagctgacaataaataagtcgattaaaaagaacaccaggctttgggccctcttcagggaaattgcattgctactgcagagaagcttgcattccattttaaaatatcaaatccaaatcaaaacattactttaaatacacatcctccgtgcgaagctcagtcgtgagaatgcgcagttatgctgcattactgattcatttagaagttattagtttgctgctaggcattttccactctaaggaacgaaatcctgaaaagaaatgggatgttgaaatattgagtaattaaatgttgaaacgtccgtgaattcctgattaacaccatgatttctacgcagtcaaattaaaacatacgcaaagtaaaaacttcacccgtgtcccctgtgtccagcatgtcaggctagcggagggagaagtctatatgagagatgatggctgtcatttcacagcgcaagttgttgactttccacatccctgatgttcccaaagtttgtttttatttccatcaacgataccttttctgttgtggttttaatccacgagggagtctgtgctcaaagcggtgggcatgaagggagcctccagaatctgcccctcggctgctactctagcccatcccggggatctcgtgataattcctgcaacaatgatcacaaacattctggcttcaaacaagacccatgtctcgtttcactgctctgcaggttaaaagtcccacgtcggtctcactgggctaaaaccaggtatcggcaggctgtatttcttcctgcaggcttgacggggaataggcttccagggtcatttgggtccaccgagagcagaagtcagttccttgtggtggtagggatgaagtcctgttttcttgctggctgatgtccacgcatcattctctgcttccagcagcagcctgggctcctcaaatcctcacactcctctatcctaaaagtcagcaacagtgaaccagtcctttacacgtcaaatctctccttcacgtcatctttacgcatcttctatccttgctttttttctgactccattcaaagaaagttctcggcctttgaggacttgagtggttaggttgggtccaccctgataatccagaatgatctccctattttaaggcctatagctttaattatatcatgagcgtcatccggtcatggagcaaaacataatataacattcacaggatctggtattacagcatggatattttgagaaaagtttttagcagtcacatatgtcttaaagtgtattgaaaaatatcaaagtgttttgaattaaaattttttcttagtatttttatcataaagaaaaatgtaaagatgtggaatctgaaggtacagaaaagaagccataaaaatgtatctgtgaaaggatgtgcattgagttaagtttgaggcttgaattcagatgaagtggattcagatcccggaagaacctcttggctaacagatcagtcttccagggcttaaggtactcatctaatttcggatactaacatttcctaagtttgatatgtatgtctgcttctgaatcattccatgaaatgtggatttaatcctgttattaatgatgaataacgtaagaaattgggtttcttacaatacttcatccctgcaacattgctggaatataacacatgggacatttaaagatacatggatgagtatgacttctagcactgaccaattaacaagaaatgctcatacaggttgaatatctcttatctgaaatgtttgccaccagaagtatttcagatttcagatttttttcagatttgggaatatttgcatatatattaccagttgagtgtccctaattaaaaataaagtatcagaaatctgaaatgttcctgtgagcatttccttctggcctttcctttgaatgacatgtcacagctcaaaaagtttcagactttggggtatttcagattttggaattatagattagggatactcaatctacaccaagctagcagtttggtgtttataaacttgcagttctgccttctaagctcactgactggtggctttttgtttcaggaaagcagaaactgaccagaaaatcccaatagctccttgtttctgcagcagttgctttactaacgtatcgctgtttgggggaggcctgtgcaccccagagcagcacagagattctttgtgttcatggataaagaatactctcagattgcttcctcaaccagtttttatgattcagttgaaagaaagttacttttactttcacactgaatcctcctttctcgtctatatcaggataccaaggattcctcaggagtgtttgtcatctccttttgggttattgaacgagcactgcaatgtgtttgtgcagcctttatcgtcaggctttgcacgccacgctagtgtataagcaccactcttatgatgaacattacccatttcccttaaatactgatataatcatattaaggaagcaattaatattatcaatctacatgccatgtcataaattcccaataaagttaaaaaaataaaaatttaattgtgtgaattacttttgaaactcaccagtgcccaaactattaaatacgctttctaacacaaaaatcctactcttggctgggtgcagtggctcacgcctgaaatctcagcactttttgaggcagaggtgggtggatcgcctcaggtcaggagttcaagaccagcctggccaacatggtgaaaccccaactctactaaaaatacaaaatattagctgggcatggcgatagatgcctgtaatcccagctactcaggaggctgaggcaggagagggttcacttgaacccaggaggtggaggtggcagtgagccaatatcgtgccactgcctaccagcctgggtgacagagcgaggctgtctcaaaaaataaaaataaaataatcatcttttctttccttttaaatagacagcatttgcgaatggggcaatgttaaattaacagtgcagtttgaatcttactttcctgagcaagttatagtaattgagggcaggtctctcaaaactgaaggaaatccatgagtaagatcagagaaccaaagcattcttgaatcccacctccagttggaaacatccgcatgtaaatgtaaattaattatggtagtaagtatactcctctaacaatgccatttagagtaatatgcttgatatttttttacatataggaaataaagtactttataaaaaagaatatcatcatgtccaggcagacatatagacattctgataatacagaattaataccaaaagtaagtttgggagttaatcaactgatgtggtttggatccatttccccaccctaacttcatgttcaattgtaacctctaatgttggagatggcagaagtattggctcatgggggtggatccttcatgaatggtttggtgccatgcctttgttgctattctcataacagacttcccaggagaccttgttgtttaaaagcctgtagcacctccccgccaacccccactcgctctttctctcttcctcctactggaggcatgtgaagtgttgattccttgtttaccttccgccatgactgaaagttacctgaggcctccgcagaagccaggcagcttccagcatgatgttctctgtacagcctgcaaaaccttgagcaaattaaaccccttttgtttacaaattacccagcctcaggtatttctttaaagcagtgtgagaatggactaatatatgaacaataggaaatcaagatatacaagagcaacagaaggaaaaatttaaaaggtactaaagagcaacagaaggaaatatttaaaataatatgtgtaaacagaattttccccaggaaaccatgcagtaattctaatattctcaacatcaactagaatttgattatttttttctgattgtaggacatatcactaaaataggaaaaatagagcttgaggatgaatcatagaaaaactgcaatgattacatcaggtccagcataaagtctccagaggaatcaaggtgatatgtagcagtgaatagatggaaggaacactacgaatttttatagaaaagtgttattcaaagatagtgtttagagtttataaacttccatgaagtatacaataaaacagaatctaaataaagtctgtgcttattgacttcaattagaaattaagatattggaagggtataaaataagcaatcattttccttgtaagaattcaggggttcctatcagaaggaccaagggtaacaaatatgatttatttatgaaagacagaataaaaaagatattttaagcaactaatcaatgttaattacaagcaaactttagacaacacttttattttcaaaaacatcatcttatgctgtttaagaggaaagactgctggaccaaggcagcgtctgtcatggcccacgtggggatgggatatctccagaatgtgtcctgccatccaagagtctgctcactcgtgtggatgtggatgcactggggatgggtcctcttaggcattaaaaccaatcagaaagttccccttaatattgttaagaaatatttcttcaatgtaatgtaccataggacagaaaaggcagagagaggacaagttagggagtggcacgccgcagccatcctgaattagtcaaggcagttggagtccatgaccaacattaaatgagacggagggaacagcaacctcagaaatgccagcacaaaaatccaggacttgagggcagtttgacaaattacagatgtgatgattctaggaaatgagtgtttggatctcagatttgaagaagcaggcaccggcccagattgccaggacaatcacagatgatccagaacaccaaggtgaagaagagatgaggcgacccacattagtttagaagagagcctgttcccatggtcactctaggaagtattttcacaaaggcctaaatatagagaaacatggagttcatttcaagaccctcctgaaaatttaaactagcagcatgtatataatattacttgttgctagttttaatattaatatgaaaatattgctactaagttttgaacaactgcacagtgctactactatatctactatacgttaactcaggttattcttatggtgcctctagagaattcttcggatcctcatgttatattaggcagcactcgggctcagagaacaagaagcagagttgtggttaggaaccaacagcgtctcagggccccataggaatggtggcaccatatttctgtgaaattccactacgggctgcattgttctccacttctgcataaacgttcgcgttcaatgatacctccaggtactatcacatagaaaatatttaaataggggggttgtgaactgacataagtcaggattctttaccacagggagacaaccagaacactggcttgattccaattttaattttgtagcaaagtgccacatactacactcagttatattttagaaaaagttgtgaaaatacaaggaatattatattagagccagacgatttaaattttaattctcttactgatttctgattctggagcttccataaattattttactgttttctgcttatcttcatctttaaaaggagatcataacacttccacaacgttactaagattaaaggcactggtgtttgtaaaattacgagctaacaattatttgtcaatatcaatttagcgtattcttgtaaaacaggtgactgatttctatctagtaaagttcggtgtgttgcatggtgaactccagcctgtatcctactgaaaacattttatttagatcagtccttggtaataatgctgccagacaatagattcacagtgagctccacattgagacggataattaaacacagtccatttcaacttcctgttttaccttgtggttgttattttaccaaagacagctaaaccatgctgagaagcagagcatcctctctgaagcaggaggcaaggcagtgcgagaaacaattaagtctaattgactcagtaggtggacgaaaccagaaaactgggactagtaaatgagagagtgcctttggtagatgagatgtctggttttgagcttggggatgatgaagagagagagatgtctcagggggacatctcaaaagaacattctcccttaggtcacaattgttagggacagatgtgtgcctagactcctataataagatcagatttaagaataaaacaatcatcccagtgtatacctgaaacataacacattttttaaaagcagtacacagagctgttgttccttatcagctaatcctacatgtgcagtaagaatgtacataccctttgattgtttttagagaatttgcttttaaaatactgtattagcttggtacagaagtgattgcagttttgccgttaaaaacaatggtgaaactgcaattacttctgcaccaacctaatgcatgtgtgtttcaaaatgtaatacatgcacatgtatctacacaaaaagaagtcaaagagtaaacatgaccagggaagcatgtggtgtttcagacttcacatctacaaatctcaactaacggcaactatgcacttgacttctgacacactgaaataaatcctcaaataaactacctatcccacatcaaagggctactccctataatacggttgtagtagggatgtgtgacaaatacgttttacatagggttaagcttttggtttcatgatggcaaattcttaaatatattcccgttctagatggtagtggagagttaaaattcagacacataaacacacacaggcatactggtgcaatattttaaaattaggatcagtataaacatataaaatacagtttatgtataaattaatataaatatacattacatataaaacaaatatgtcataaaattttccattcattaaaattacttatgaaaatattcagatttgcaattattaatgaataatctatatcagacatcagcaaactgtggcacatgggctggtcatctaattttgcaaataaaaaggtcagagctatttgatgataccatatgtggcctatgatatccccattgttttgatgatttttccacaaaacttgattttcttctcattcctttcaatttattgattctagagctccggtggtaatttgaagtacctggactttttccaggaattgtaatgtattttctgcatgagataatgcacaaaaagcactttgcactgtaagtggcacggtataagcatacagcaaatcataactttatagatcaatacttcccgctaggaagatcaacctggaaattccgtgagagggaggtcatgtgcaggtcctacttctaccactattgaccctctgaccttcatgggagtggtctagatctgagtcaaatacacctgagtagcactgtccaatcagaaatactttccatgggactatgcccattttatagtgttaatctttaggattaaaagctctcatagtggtttgtttaggagaacataacatacacttcattagggctgcttagaatagcagatgagatgcaatgatcaaaagtcagatagtatttactttcaagaactgctatacaatgtagttaggacaaaagaataaatgattaacatttacaatatatggaagcaacctgcttatcctgtgggttttaaatagccataatgttaagaatgtttagaaagaattgataggtgggtgtttaacagtataggtatgcaatgaccagattgatatatcttaatcaacatttcaggaattgacagctgtacatacagaatccttacgagaggccgtatcctcattttaaaactgcttttattgtttaaaattttagaactcctccttgggaattaactgaagtcttcggtttaaaatattttccagtggtggcaaacatatgctaactggtctgattaatattgttatgttaacgtctcccagcctcctgtagaaattgacattacttctgaatcccttccatgtataggggttttaccaaaattttcacaatatatttatttttaaaaaatcaagggaaactaactcgaactggctcaaaggataattttttacagaagagttcataatccctttaaaacttttattactaccagcaacattacccctgtgaaagagaaaactcaccacaatgtatatttaatgaagctcattaatttatttttttcttatttccctatgcagagtcctaaacccaatgcagttagagaaaaggaacattaaccaagggttataaatgtcaagaacaaaacggatatcatgtttagctcaaaggaacacaggaagcattagctgtacgcctccagcacttctcaagcttctctggcaagctggctttagcatttttataaatagtctccattgcaacatttcatcactgaaaaatccagacacgaatgtataaaaccaaaggaaagtgtaaataagaaataaatcctgctaattgcggtttgctgatgccagagcccttttggcaatgacgacccaggggattcctgggcctggaagcctgctaagcagcatcttccacttccaaacagcagcagcaactgctccccaggcttgctgcttcggggccttgctttttcttttttctttttttttttctccaataagaaaataaatacaccttactttggccaaatgattgttaaataaattcttggcttttcagcaaacattcttttctcttctctttcacaaacaatggaagcaacaagccattcaattctgagaccctcatggggcacgtacttcaggatgtctgttgaatatgatacacccgcgttttgtattttagcaacatttactacagtcacagacttgtgccataattggccagaccttcagcatctttgacaacctagtgcgcctatgataggggattatgtgtaaaaatgcaaacaaacaaaacctttatttatgactgccctgaaggtgtgcagattggcatgctttctgagcccaggctttgtctctgtatactgcgctatataatggggctttggctctactgcataatctagaactaattaggacattaagcaggtgtgatttaaaaatcagtggaactcaaggcagttcattctgattgatcagtcgatctgtctgtctgtctgtctgtctacctacctacctacctatcatctctctctggctcctttatatagcccttttaaccttttatctgaagaaaagagaaacgaacctgccttgatgttttgtgcccaaggtcctattgtaattattattatttatatttatttttttccataagttattggggtacaggtggtatttggttacatgaacaagttatttagtagtgatttgtgagatcctggtgcacccatcacccgagtggtatacactgcaccatgtatgttgtcttttatttctgacccccttcccactcttctctaccaagtccccaaaatccattgtatcatttttatgcctttgtgtcctcatagcttagctcccccgtctcagtgagaacatacaatgtttggttttccgttcctcagttactccacttaaaacaataatctccaatctcatccagttcactgaaaacgctgttcattcattccttattgtaattattttttaaaagcataagtctttataaggctcaagcaatgacctgtttttgtcactatctctcaatcaaaggtcagtgtcttaccttaaatagggtaattaccacctgcaaatagcttttcctgcttctgaacctcattttcctttctgtgtcccgccgtcttgttaagatacactctcatcttctggtggtgtcttttctttcgagtgcaggtgtcacctgcaatcccacatagtggctgtgctttgtgcccaacctagcaaatacatctccgcaagaaaggaaagaagcctgaagggcattatgtggtgaggcacaatggctaagcatgatgagggaatgccctcctgcagtggatcagcatcatgaaaacaaaaactctcccacacaaaacacacggggtcacacttggtttacaaccacgcatgaaacaagagatccctttctagatcactctcttctctatagtcatttatcttacccccatccaagaatgcttactgtcagatttataaataactgaccgtcatcttatctgatgtttagcatggaggcaacataatctcagacaccagccttttagaaagagatcacatacaagagataattaaaaatcataaggccaataggataataaaagtttcacttttgtgggtcaattagatcttatttcaaatctagtcttttgtctattgttgtactttctgatcctgtacttaatcaaatgtcctcaatgtattcaactgtaaaatggtatcggtcatgaagaagtcaggtgatggagtatatatgcacatttctgggaacactagaaatgcttactatatggtaaccattcttaatcacagcaattaatatgtgaggaataatgatcatgcagcttctcacctaggccagtaaaacatcattcacgatgacggttccatattttagtttacatatcgagagggtcaggaacatggagtgacttataccacatacccagctagtaaataaaaatcaagacttacaaaaagctctttgtaaaaaatatacaaatgacaataaaataaactctgacttcatttctccagagtttccactcttgcctctatttatgcacctttctcagtccaaaattatagcccactaaacaccaattatttcaaattacagtagcacaagcagctaggctatgccttttaaaaagacattacagtagggaggaggaaggggagagaggttgctcaatgggtacaaagttacagttaggaagaaagagttctgctgttctattgcacagtagagtgactctgcttaataatgtatatctcaaaatagctagaaaagagggttttcaatatccttaccaaaagtaaaagataaacctttgagatgatgaatatgctagttaccttgatttgatcataacacaatgtatctaagcattaaaactactgattataccccataaatatgtacaattattatgtaggtcaattaaaaaataaaactttataaaagacaccacagttttattttcattacatatagaatttgaacactttagatttaaagaaatcttatttaaggaccagaattgtagattttggtctatccatagcaaaaccataaatatgctctaagacattttagttttgtgccactgagcttagaaacacctacatttcacattctttgtaggtactgaaaataaactctgcatgtacagctattttttactgtatatttttgtacaatatagctctactgtgactcatacttctgcagatgagtattttatctttgtcgctttaatttgaatccaaaaaaatgaaaatacatgaattttggctatattattttctagttagtaatagtttccaagattcctgattatatctattttcacatggtccaccaatttaaatttagaaagcacaactcaagctatttttttcaataaatgctaaaagctttatgatgtacatgttttttggaggcagaaaagtgccatatttggattcttataaaacaatgtttttaaagacactcaaaaaaaaaaaaagacgacttcagattagaaagaattgggtcaaatgtgagatccagatggtcatgtctggaaatggtagcattaactctataaacactgacctctttcataaacttcaataaatgattgtaaaatcaattcagtccacagatattcaatcacagagttaacatgtcatatgtaatcagcaaattcatctctccaacccacctgaaattttgtagatagttgaaatacacttaacattaggcattaaataagaattgtatttcgtgaaacatatcatgatgtccactgtcagaacaggaaatcaagatggtgaataatacactcaaaaccacacaaggtaaaactgtcctccagccagagtgccccaagacccgcagcgccacagcctcctaatcagaggctgggagagagctgtacagtggctgttccagctgaaactacattctgactcctcactctcaattcagtgctttggctttggtaatctgctgccctggtcagaacaatgtatccaagattaaaccggaagtattgtcattaaataaagaaaaacattaaaacgtttatgcaaattacatggctttccctggttctaaggaaaacctagctgtgagttgttcaaatgtgtgggttagcagtttctcattgcagtgcctcttttcacttggcctcctgctccagggagctcttgtcatgaacaggctgaagccagcccgaagcctgtactcagaagggtgtcaattattcatcctccaaacttgagtggaaactgcaagcatatcctctttctagtaggtcatccagctggtgatgcctcatttgtaactgtggaggctttgacacaaggcatcaaccagcctaaggaaaacattcttatattggtgatatcactcctctaaagcaaatactttatgtcggcttttgtgacatatttccacacactgaatttgaccgtgaataaaagttggctcaatatagagttaaaagagcttaaaagttcccacagattggatgaggtgcatggctacaattaatcagtacgattagtgaaaattatggataaaaaaagtgtatttgataatttgtaaactttaacatatttttgagggattgtcataggatttggttctctatgtcttgacatttattagaagatagccaagggtacacagaataagtcagttgcctgattcatatttatgtactcaagtaaaagtttgttcttacaaaatgaatattttatttgacttgtttgaacattgcggcctattgtaattggaaaagtcaagcccaagtaaacaggctttaccttcctctagttctataactaaagatttggctcccaactcaaatagaaaagcgtgtagcattctgtctaggaaaattccccctgcagggtcatttaatgaactgtgctaccttgtaacacaagcaattacaaagggaagaacaaactcatatggattttttaaaattttgaacccgtgattaaaataacacttgcattgaaattttaactgctgttttacatagaccaaatatcttcactggatgagaggagacagaccctttagtgttttaagatttagttttttctacctgacacaatttgtttcctttataattatttcacttactgttaaatttcttttttcaccgatggttttaaatatccattatgcctccattaaaagaagggcaaatatttttgaaaattcagaaggacctagtggaagagaatgtagataatgtattggaatgttaataagagatttaaatgaagtcatatctgcaaagatcttaaacacaattctctcttcatataacatgaaaagaagaatctcagcaaagcattgtgggttggcaggaagactagaaggatatgattccattaaaactaaatttgctgaggtctattccagcccttgagcgaatctcatactgacagcattgaaagtttatgtttgtaaagatgactaaattaggctcataagtggtaaaaaaatgcaatactaaaatggaagtcctcaagttttaactgatatcagaaattctgaaatcagttctgggcactgaattattagaagtggatatttatataactatcaggcaagaaggaatctctctgggtcatgagtgccttctttcttctttcaggagaatttttaaaccatgtggaaaagatagcatgtttccatagctttgctgaatatgactcctagcctgatctattctgctgctcctagaagattgtaccagctcatgcctgttagtctagagcagtcatgaggaggtgaacattggcaaaggtgattttcataatggggcacattgggcaagttactggggtgcaaagcattggtggaagactttgctcttaggctgatggtgtggaggtggtctcagagctggtatggaagaggtacctcagttcagaatctcttaggtaccaaaatgcccccacagtgggttagatcaccattagctcatgcagccctttgctaagctttggacctcaagaccagcagagacttagaaagctgattaccctagacagcaccagagagcttggtttcctgaaatgctgtgattcacatccatctccatagtcctgagccacttggaagtcatctgacttcagggggctctgagaacctcagctcacacacagactcagagtcccagactttgcttttagagaaaaatacaaactgacaaaatgaagaaaggagaaaggaagggaggatcaccctttataatagagcacatcttactctcagtgcatcatacaaataatagtacttttattctcccgggaaccttataagatataagtgttgcccagactcgttaaatggtgaaactgtcacttggaaatgattaaagatgttcttcatgatcctaagacacaacggggcctggattttaacccaaacagtgacagcaccaaagactgaaccctcctcagtcatgcccctgaattaaagttttcaacaattataggaaagacatcctgcatggtagccaggttagtgcagcttacccagcagtggctggagcttcctaagaaatagaatagccaacatttgtacataaattataaaaatacgaataaaatggctactgtgcagatgtgtaagaccaaaaaaaataaatatcctgtttgcttctaaaaatggattttaacagccacttatgagccctgacaacccacctgctctaccatcttggctcttaagcaagaatcttatttcaccaattcaattcactaacgggttaaaaaatatccatttaggactattttttctttcttctttctttgttctagaagtaaacactcctacaaccaggtttattttaaaaatgtgaatttgggtataatattttacagcagttgagattaaaatggcaggtgcagaacatgcatcggtcaagtaaatgaataaataatcacttctaatgtggcatctccagcattcatcatgtatcttgctgattctctgttgaacaccacagatatctcattttattttattggcaatgagatgtaaattggtggttggtagttttctgcttttagacaagatgcttatatttagagagcatttaaaatacagcagtgtggcatttgaggcatcaacattcgtaagatgatgcttgaatctctctctgatctgagcctgaatccaatctagaatacgttcttttacaaaattctgttctatctggttttcttcaacatgcaagaacaatttgtgaaagtagtccattatctttatttttttttcttaacacatgtttcttttgcctcaaacttcaagcatgcatacatagatttgtcaattaatcctaaaagactgaggtctacacaattcagactatgaatgatacttccaagaaaatagtaattatttaagtgaaatgctaagaaataagataaaagtagtttagctagtacttcatttaaaaggcactttttaaatcttaatgtttttaaggcaatattgttggtatactaactgaagactggagagaccccgtgtgtgtggcaatgtggaaggaagcagatagagcagtcaccacttctaattactggtaatttctaatattagatctaattactgatagcagggtgatactcggcctccgctggctcaacttttagagggaaactatccgcctatacccctccgggttcggccgctgtagcggagctcggaaagagtggcgcagggtcgcggggccccgccagggggcgcgcctgggggccgcgcctccttccccgcccagagatgctctctgatcacccctcttttctagagctctgcctcacttaccggcgcggtcgcagccctcagcccactcaggataatggcgacagctgaggtactgaacactggtaaaaaattgtatgagggtaaaacaaaagaagtctacgaaaagtcctcctgcagtccaaggacaagattacagcaggaaatgtagctagaaagaatcacctggaaggaaaagctgcaatctcaaagaaaatcaccagttgtatttttcagttattataggaagcaggtattaaaactgccttcaccagaaaatgtggggagacagctttcattgcaccccagtgcgaaatgattccaattgaatgggtttgcagaagaatagcaactggttcttttctcaaaagaaatcctggtgtcaaggaaggatataagtttacccacctaaagtggagttgtttttcaaggatgctgccaataatgacccacagtggtctgaggaacagctgattgctgcaaaattttgcttcgctggacttgttacaggccagactgaattggatatcatgagtcatgctacacaggctatatttgaaatgctggagaaatcctggttgccccagaattgtacactggttgatatgaagattgaatttggtgttgatgtaaccacaaagaaattgttcttgctgatgtaattgacaatgattcctggagactctggccatcaggagatcgaagccaacagaaagacaaacagtgttatcgggatctcaaagaagtaactcctgaagggctccaaatggtaaagaaaaactttgagtgggttgcagagaaagtagagttgcttttgaaatcagaaagtcagtgcagggttgtagtgttgatgggctctacttctgatcttggtcactgtgaaaaaatcaagaaggcctgtggaaattttggcattccatgtgaactttgagtaacatctgcgcataaaggaccagatgaaactctgagggttaaagctgagtatgaaagggatggcattcctactgtatttgtggcagtggcaggcagaagtaatggtttgggaccagtgatgtctgggaacactgcatatccagttatcacctgtcctcccctcacaccagactggggagctcaggatgtgtggtcttctctttgactacccagggtcttggctgttcaaccacactttctccagaaggatcagctcaatttactgctcagatatttggggtagacaaccatttagtatggagcaaactgtgagcaagcattttgaacacatgtatttccttgaagcaggctgacaagaaaatcagagaatgtaatttataagaaacaatgccattgaaatttttaggggaaaaactacaaatttctaatttagctgaaggaaaatcaagcaatatgaaaaggtaattataaattagagaacacaaataaaatgtattagtgaatcaatgcttctctagatccatactaataaacatgaaaacctaaaaaaaataaaaaaaaataaagggaaactatcatgcttaacttaacatgacatctgcttttgaaacattttatacattttaaatttatgacacagaaactctccctgctccttcctgactccagggcaggcacatgcccagtgttttcaggtgttggaggttggcagcatatgagaaggacagactgtagatgcagagttctgacatgaactgagatcagacagcacttaaattcatggttaggactctcagccttgaaatcagactaccagggtctcactccttgttccacagtttatttattcaacttcttgggacctcagaatcaccatccagaaaaggtaatcatgagaaagctacctcttgggattcttgtaagagttcactgaaaatgaaatacaatgttgtatgttcagatgaatgctttgtgcttagaaaatattcaataaatattatttgtagttaatataaagaagctatcctgccactgtttctcatctatgaagatgatctgaattataatccccggtttctaataccaaacatgcacaacaccatctgtggtttaaaagcagtcaactatagacaataaagtatgaatttcagctctgtgtctttgtagctctctggctctgggtgatttttacctacactctcgtatctaatattgatagtactgtgtatccccagagtttacaaaataacgcatttaaacgcctggcacctggtttacattggataaatgctaaagccacctcacctatataattttactgtgcatctacctgggatctaccaccaaagcttttgttcacaatctggcaccctaggtttgggaataaactgtttttctcactccagtgtggggaagtttgtgttgcatttttgaatgctggcatactagctgtatgtcagaatttagcatgttccagaatgtacttatttatgatcctgtataagataaaggttgattgtatagcaatgctcccaacatagttcatgtagtaaattttttaagttatcactgtgtaatttagggaagagatgccattttggttcttgctattttgtttatggaaaataagtctaactttcttaatctcttttagtactcttttattttacagacttgcctaagtaatagaatttagtagtagccatcagatctgttctgccagagaaaaatgtacccgaaaaacgtatcttaaaggtgctatttctctcttcccttcatgtgcaactcaatggaggccaagttatagtgatgaaaaggaatccaggattatgtgtgaatcttcagagaattctaggaggaaaacattcgatgagttttgtgggaaaatactaagctccatcacttgtgatatccaatattcagttcctttggacaaacaagacaaatacatacagttcaacataataagaatattgtatcacatccaagctgagagccaaatctgagagcacaacacattcaaaatagccataaaaagaataaaataactaggaatacagctaaccaggaaggtgaaatacctctaccacgagaattacaaaacagaaagaaatcagagatgacacaaactaatggaaaaacattccatgctcatggacaggaagaatcaatattgttaaaataaatagccatacttcccagagcaatttacagattcaaaactattcctttcaaactaccaataacattttccacagaatgagaaaaaaactcttctaaaatttatttggaaccaaaaaagagaccgaaaagctaaggcaatcctaagcaagaataacaaagctggaagcatcacacagcccgactttaagctatacaaccaagctacagtaactaaaacagcacggtactggtacaaaagcagacacatagaccaatgcaacaggttacagaacccagaaataaagccacatttctataaccatctgatattttacaaagccagcaaaaagaagcaaccaggaaaggactcccctattcaataaatggtgctaagataaatggctagccatatgcagaagaccaaaactaaattcctacctttcaccatataagaaaatcaacacaacatgaattaaagacttaaacggaaaacctaaactataaaaaccctagaaggaaacataggaaataccattttggacctaggccctggcaaagacttaacggcaaagactccaaaagcaactaagacaaaagtaaaaattgacaagtgggacctaattagactaaaaagttctgcactgcaaaataaactatcaggagagtaaatgggaaacacaagctagtagggagagagacggtgagagagacggtgagagagacggtgagaagagacggggagaagagacggggagggagaaacttttaagtgagacaagaaacaaacacatggagataagccaagaaaacagaccactggtcttgagaggagaggtgcgtggaagaagcagaggcagaaggaacgtgcctggggttgcaggggctttgcctgtcatggacacagaccttcacgaaggtgggcctctttccataccaggctttcttactacttcttggtgtggacttgtttttactcctttctttgacaatgttttccaattttctttccaattcagccctttgactccctgaaagtttatgtgttgtgggtgggaccccatcccttggtctataaggtttgtgatcttgaaaagtgaacctaattttctcaccacagcgctcaaggagtaacaaacaatccaatcccctaaagttgtataagagccactggaaaaatgttttgtctctttttggctagaaactaacgtgaggaaatctgaagcaggaccttaagcagcaatgttaccaacgtaagggttgagctcacttaaaaatgggcccaacacagaaggctagttaagacatggagagagaggccaggatctggtaccattgtgcaagccaatagttcaagtattttctgacgaagaagttcaatttccttcattagcatcgtgtgctaaacatttcactttgagattcctccagtttgggtggcattctctgacactgacctacaaaattccaacagatatactttttttcaaaaaaaaatttttttagcttgcattcagcaacaattggttcatcttattcgaaaaggtagattaatttagtttctttatgttagttttcctttttttttaaatacaagattgtttatccaagtgtcctttatagtgtgtgtctcaaaggttaatcctaaatcctatctcactagaaaagtggtgacattcttacccaagattcactgcctggttttaactttaattctttctatatggagatcccttcctccgtattttctaacagaatctctctccttattttattctttccttcctccttcctatctttctttcccataggtatttatgaaataaacacaattagccagacacaaaagtagagattaaatgtatagaactgaaaaataacagtgataaaacaagcaaacacatcctaactacacccctataaaggtgcatggtccctaagagttctaaaattcttaaagtagtccagtagcaagaaggaatttgctttaaaaaataaaactctagtttcaattccagagacatttcgtcttttcatctctactcaatattcagcagtggtacagccaatcagtctatctttgaactcatcagctgttctgaatattcttcattttctattcccgttccctgggcagttgtggttgctgtctgtgctttgggtgatcacgcacccattcagccatacaccacactcaacagttgtcagcacgtccatgcaagaaactgttgaatagagtctcttatggccctcttttagactactgttttctaatcttttgtaattatatgggacactcaatttataatcaatgggtccagaaccaaaaggaacaattctaggaagagctgccaagaagctgcattcaattacaccgatgcccattactacggggtgttttgtcactcagtaccatgcgttccaggcgtacttgtaatatttaaagtgaccaagtgtttccaaagctcaattttaacaggtctctccagcaaacctttccacctactggttttgtgctctctgccagcacatttgagttcatatagagttcagtatgattaaaaagggatgcaaattatatatgtatatggaatatatgtgtatatatgtgtatgcaatatatatatatatatatatatatctccacacacatacataagccattaagccattgcataatttgacattcaaacatccaagtggaaaatataatatagcactgtcatatacaattttttcttttgtcttagaaatatagcataacaggtcagcaggtaccaaattctttaaccttcaatgtccttgatcatggagtaattatgagtaaataaaaattaattgcagcacaagacatgatcatgagttagttttccttcatatttacaagacctaatctatgtatttgttttaggctggaaaaatagaacctattctctcaaatgataacacagaagaggcatttttattatagtactataactactacactgatatcattttgaaacatagaataaattttgtttcaaaatatggtaaaaatttcaccttttccctcctcccccagctctttatcactttctcctccagctccatcccctctctcctccccaccatctcccacgccatctccctggttcccagacacctacaccagggcacagtcatagctgttctgcttgcagaaattatttctatcatttactgatacaaactttttagtttgaggcattgctcactatcatactgtttcaaaaaaaaatacagcactaattattgctgtcaatagcaatgttgacgcctctgctcaggagaagaaagtgtacatggagaggttggaggccaaatcttcttttacaggggaaatgacattcattgggatgtggacattcgttttaccatcttgaaagaaatctttctatgacaaatcatggtcagtgatctagaaagcaggccacaaccccagaataggaaaaaaaaaaaaaaaaaactcctctgattaaaagtttgttaataagaatgatcaggtagcatgtctgatgaataaaaatgtgatgtaagttgaggtttgtgtgaaaatgaactggcacttctgttaggaatagttaactacaaaggcttacaggagtatttgcatacattttaaaagcagtttcttataaaactatcttagtgctcttgaaataatttgccttaaggttggatttatatttttctcaaaacttctggagataagtcagataagtactgttccctcatataatgctttattctctaatagacagtcaaactcaatattgttctcttcaattgttaaatatattattttacattttaacaggtcacttggatcatttttatcacactttttgtcagtaatattttgaaaaatcccacattgtatataaaaggcctaccattttgatattcttgcaatttttgttaaaagaaggtctctgcatttccttagaaatgagtgactatttctcatataggagggatttcttttctaacatccccattagaaaatcaagacactattacatttaattatcttatttatgacagcatttaaaacaaaatggttcctcattgctcttaaaatccagtacaaaatgggcagcaagtcactgtgttctgtcccctgctctcctctccatctctgcctgactctccctcccccacgtccacctatgtgctgagagattcttccccttctctcacccctcacacgcctctgggctgcaaggctgatgtgctccatagtcaggaacctccccattgtccccataccttctttcttctgctgactgctattggcccatctctcttaaggccatgtggcagagtattttctcaggaaaaaagctctgaacagattattgagccatttgaattccatgcccaaattcggggactctgaagtagtttgaatagaagcactcaatggtccaagttacaatttaggaaaactgacctccaagacaagaactggagtcaggtgatgatgactgcagattgcaggtggcaagaaattaaatcaggagttggtcatttagaacgctgggaagggagtcctactattgtttccatggtggagtaaagccagagaagagaaagaatggtgccttaggaagttgggtagaaaggtcaaagaaagatgtggggggtgggtgggtgtgtgtttaagtttctgctgtctttaatatatggaaggtaatagtgaagaatcaggtggaatagatacagcaaaaaataacaacagtagacagaaactggtaaagacgtctaagaatgtagtagccacatttttaggtgaaaagacgcttaaccagctcacatattgaggtgcaatcagaacacatttctaggtctgctggtgtcatagctttttttttttttttttttttttttttttttttttttgagatggagtcctgctctgtcgcctaggctggagtgcagtgacacgatcttggctcactgcaagctccgcctcccaggttcaagcaattctcctgcctcagccttccgagtagctgggattacaggtacccagcaccacgccaggctaacttttgtatttttagtagagatggggtttcaccgtgttagccaggatggtctcgatatcctgacctgcccacctcggccttccaaagttctggtattgcaggcatgagccaccgcacccggccagctttcttaagctttttttcaaattttctgttttttcttctttaaccataacaacacacacttgttcctcagaaaggaatttctaggataaatgagtacaatatggaaaataattatcttctgtgaactgggatccgcagatccaggcggagaggcatcctgacaggtcctccagggctcttgtcagttacctccgtacctgtgcacgccttcaggtactctgagtgcaattcataaatcacactaagtactgtactgaggcagcccttcttcaaattaaacacaaatgagctataaatggaaccatgaggtgttgttctcatgttaaggtagactgaaaatattgccactaagggaaatactcaaggctttttaagccatcactacttgatattatgttatttcttttaagcctctctgatatgtcataaagcaaagaaacaaatacagctaagggcaaggcttcaggtatttaaaatgtaacactcaccaggagagccactggcattacaaagacaagtaaatgttcttattccacaaggagtttactgtctgtggagagatccaggaccaaaaaaacttaagcctcatcaaggtggtttcgacaatgaagggaagaaaatgcaggaagaccagctccccctgcatctagttgctccaaaagcctgcatgaaaatgcctcctttgctgtgaggctggaacaaggagctggccagaggatttggcagaaggcattccatggagatgagatgacaagcgaccaacgtgatgatcttcacatatcctcagccagacccagctttataaagtttattcctgatctccctgtctaagggcatttactttaggaaacttgcatttgcaattttctcctctgcccctttgtaatgtatgtaaatatctttgagagcttcttgacagttttaccaccgagaatggtctttctcaatgacctgggagccatccctcagacacgctctcagactagagagcacccctgtctcccactcactgtgggaggctgcagacctcggctccaagaccactgattagcaaacacaggtggcatacccatggggaaaaacactgggaaacaaatgagcaaccaactcaacgtggtggactcatccattgaccatttccctccttgtaccagggctcaaaatccctcccattttttatttcagtggagccgaattcagtccccttccccttttgcaatcacggtgagtaaattcccctttgcatgtttatcttgtgcagtacaatttctcttggacaattgcaaaggtctggggtcaggcaagccgcacatatgcacacaactgaaacgctatggacacattaggtctctgagtgtggctgcatggagggggcaggacagagcggccctgattgcctggtcatcaggcctttgtaatgccacccaaagtgaggtacatcttattccataaagaaagggagactgtcagctaattcttaagagagaagcaacagattctgtccatgtgttctggaatgcagtgagaatcgaatcagagatgaatacagatgtgattgcagaggccatggaagaaatgagacaaacccaggcagcagcatctcaggctccaggcaggcagctgactgaagcccacacagtaaggacaggtttccaatgagggagatgaggtttcatcctttactatgcatggtgagttttaactgttttgaaaactatgttttaaaacaatgatgctgctcttgcttttgtggcagctgagagtgcacctggaatgaagcaggagaaagggagcatctgtgaaagagtgttccgcctgaatctagggatcaagctgccacttcaaaagctgaaaacagcaaaagcagaacacctaagtaccaaatataggtcatgtttttattatgttggcgcaaaagtcattgtggtctttgccagcacttttaatgcaaaaaccacaattccttttgcaccaacctgacctaatagcaaaaataagtacaatataaaagtacgaaattattccagggtatggggggagagagaaaaagagattgaaacagtataaagcgaagatatagaaatcatgataaaattatctgaagctaataggaatgctttccttaagattcacaagcaacaaagatacctccttaactgggataggtacatacaaatgtagaagataagtaacttttataaatgctgagactaatcattcagagaaatttaaaaatacttgtgctcatgtaacaaaaaatgtataattatcaagagaaaccatataaagacatttcctcatggattttacgaaaatcatcttaaatacttataaaattccacagaagggcatgacagatctccataaatgaagacatacatatgtgcctagactacagttttcccaaatgcatctatgcaaaattattccagccaaaatctcgaagcatttttatttttttattatactttaagttctagggtacatgcgcacaacgtgcaggtttcttaagtatgtgtaaatgtgccatgttggcatgctgtacccaataactcatcatttacattaggtatatctcctaatgctatccctccccacttcccccacccaatgacaggccccggtgtgtgatgttccccttcttgtgtccaagtgttctcattgttcagttcccacctatgagtgagaacatgcggtgtttgttttctgtccttgcgctagtttgctgagaatgatggtttctagcttcatccatgtccctacaaaggacatgaactcatccttttttatggctgcatagtattccatggtgtatatgtgcatttttaatgactaaaaatattctaatttttaagggagatattttatttttaaaaaggagatgagattttgcaatatataaaatgtctattaaaaagtacagaattgaaaattgcttactctgatatgtgaacagacaggttagtatctgacaactagtcacaggcaagctaaggtggaaaataaactctcaaaaagttaccacactgtgtgttggaatgctttttcaataaaaattcgtctaaaacctggtcaattctttcaagaaaactataccagtcttccaccatacaccaaactaattttcagaaaaataccaatttgttaaaaaaaagtagaaacttacatttattaataggtatgtaacattatgctgataaaaacctcattagtagaacttcaaaagtagaaactgggagaagaaaaataatcattttggctgcctaaagtttcatataacctctgtatatcacagatgccataaataaatgaaaagataaagtaagacctcagaccaaagtaaaaattcagcaactgtttgcatcggccattcttgatctgccctccaaattcactctccatgcttctgcacgcccacatcctccttcctcaactcctccatcctctgatatccaggggggtttccagcaggagcgtgggctggtgaggacagaggtcagggcttgcattggccgaccctgcgcatctttccttccgggccatgggtcacgcccctgggatcttgatcaactcaatacatgagagatgtgcttacataaagtcactacatgacaggcactcacaagggaataagaaaaaatgttttgaaaactgtaagagtgaaacggtaagggataacaccgatgtagctcaccagttcataaaaggaatgatcaattggtaaagaagtttatcaaagatgttcaatttaatttataatcaaagacatgactggtaatacaatgacgagtaattttagccctagatcatataagtgttttaaaatagtcatcctcagcccggccaccatggcaaaaccccctctctactaaaaatacaaaaattagccaggcgcgtaatggtgtgtgcctgtagccccagctactctagagcctggggcaggagaattgcttgaacccaggaggcggaggttgcagtgagctgagattgcaccactgcactgcagcctgtgtgagagagcaagactccgtctcaaaaaaaaaaaaaaaaaaaaaaaaaaaaaagtaatccctgggcactcacacaagtatctgaaaaattgggactttattttcactgctttggagattatcaatacaatatttattaaaaacaaaattggcattacatgtcaaaaagctttacatttgacctggaaattttacgtataggaatgtctctttaaaaaaaaaagtgacaatatgcaaagagataagtattagaatgctctttccagcattagaaactttaacctgtgtaagaaagtactcaaacattcaacagacctggactggtaaaatgaactatgcatgcagctttcgaaagcgatgcatgtaccctcgaacatgcagactacactgatgcttctcattttttctaacataagaaaagtttgtaaagacatcaatcaaaatacagtaattatgttaattactgttactattacaccaaaaatttgaatgatataaaattgaatatcctgtgtattttttatataaagcgtatcctttttgtttcctatataattgttattaatacaagaaaggaaaattggccggccgtgacggctcatgcctataaccccagcacgttgggaagccaaggcggatggatcacctgaggtcaggagttggagacgagactagcaaaacccaatcgcaactaaaaatacaaaaaattagctgggcatggtggtgcacacatgtaatcccacctactcgtgaggctgaggcaggaagatttcttgaacctgggaggtggaggttgcagtgagctgagatcagagatcacgccactgtactccaggctgggtgacaagagcaagacttcatctcaaaaaaaaaaaaaaaaggaaaattaaaaattaatcacctttgtcttaggtttaattcctgggaaatcaatgctgacacaagtattcatgtgagagtgatttttaagaagagttttctgataaagacctcagaccgtcagaggcagagcagggaaggacgcctagcaaaggggtagagtcacagacccatctttggtgcaatcccccagggggctgtggagcctcagagttgtccaggtcagctacgttgggctaagttctgcagcaaccctcattccagagctgcattgcttaaggcctctggccactttggtgggatgggcttttgggtgagacaccacctaggaggtgggtttcgggacctggggagggcacctgagtggtgggtgcagggcacaaagtccaagccctgaaacctcaactttaattcttccctttcacacatggaacttacgtcttgtactcatcacagattctgtaatatcggaaataaatctcctgattgttattttttaaaagcagacttctttccttagttttatcccaagttgtaagcacaactgcttgcctgatgtcttcaatatcttggattcaccatttaatacgtaaaaagtaaaagggaaaaaaacctacagatctgaaatgataaattcatgagccaaaataaagaaaagaaaaattggtgtcattttacattttttgtatcttaccttaaatcaatgtcttacttcagactgtctgtgcccttttcctacttctggtcatttcttagctaaatcttattgcggccaccttgaggactgatctatgactttctcagcattttcaggtcacctttaattgcaaaatgaaatatgaagtatcacagacaaggagggtggaagtggaagatgtgagctataaattgctgctgctgctgccagaacccagtactgagcagattcaaagtgagagacaccctctccccgtgggttctatttcggccagtcagctactcttagcggacttgacagcctcagatggcttttttttttcttttcttcaaattgaggggcgcaagtacttaatgtcattttgaagggcagcagttactaaattagaaacaaatcttttctattaatttaactcttttgcatatctcaatcatctcagttagtgagcacctctatgccgctttgacacactctggattctgaaaccatctttatctacaccagtgtcctcagcctgtccaataatggagccctgtccttctacacaaggcagcctaaactacccaccaccccacattaataataggaaaaacacagaaactttgtgaggcaaaaagaaaaaaaaatacaactgagagtaaaaagagaaatgaatacagctactcttttctaaaatgacaaaggatagaattattgtttcagactactgagacttggcaagcccaatgtattttaagcataggtactatttgcaaggcagcattcgtactgtgattcaaggtaactggtacattttgatcatctcttcctttcatatttactgcatccatcattgaagcaaggctcagcattttgcttccctggtgtagacagaccatttgcaaagggcattaatggacgtagctatatagcctagttgaagttgatgacatatagaaaatattaagtgtccacagacagttttaaggccatctggagggatctcaaaatcgaagagcaattgcacaaaggaactcatttagattagttatgctatctataggatgctcattttgcatcaaagtacaattggcttaaactagtagtgtttgcccttttcccttttcctctgcctgcctcagccaaggcttcgtggtttcaggctcatcttgacctatgactggtcctccaactaggaacaagcaaaatgagtgtgtgcgcgcgtgtgtgtgtgtgtgtgtgtgtgtgtagggatagtgagaagcatccccgtggttaacttaactttgggaattaacctttatcatgtgtgccatctcacagtggacttgaaaacaaaccacgaaatcaaacaataaaaacaagacaccacttaagaaaagacagagtgtgaatttccaagcaacttgaaactttataatttcaaactatagtttatgaagagatcacaatgtttttttcttacacttaattcacaatgactctaggtatcctgtctgtttctaggcatggatttccatgcttctgataactttgtaatacctcattaatactgtgaaaggctttgttttcttgttttgatattatcttccaaagagaatgtttaaatatgtcaacaatcatttattgttatactcattctcgcttcctgacatagaaaatccgtgacgtcatagggaaggacagactccaataatacttagtttttgaaaaatatagtatgtccttagagatgcaaatatcatgtcatatccgtgtgttttcaaatcgtgtgacattaaccactggagagaggcagaataaagtgatcttagtgctggcttctacaagaaattatattttcagaatctttatgttattagagccagcagtaaagtcaccagatatcatttggttttctccggtgccatttctaattcaataaaaacagatcttgatattgtgttacagaaaagtacaattgcttagtcttatttaaaagatcatgtatatgatttttttgcccatacaatggactatatatgaatataagctatttgttaatattctttaagttgatcctggccactttccaaagtgaggataaattccaaacttttgaatataaattcatggtttatggtttactgagaaatgttatccaaacagaaacatcgataaagcaattccctttagtgttcagtgaagaattcatggaaataagccttcgaaatataaaaagggtttcagttactattaactaccagtgatgtactcaacatagttattagatacccagtctagatttgtctcttgtctcttttataggaaggggttttgcatgataggagaggagggttaggggtcagaaagccctaggttggaatctgcccgacattcaacagaccagaactaccagagacaaatttgactgtaaatctcagctgttttatttataaaatcgaaagccaggattctactattgttttgtagatcttaattactgaaaagatctatgtcttctatcctccatccaatagaattcaaaatgaaaacatatcagtaaaataaagttaagctcatttctgcttttttccacgaatgtctattctagtaaccttttaaaatactaatataatttttttcaaagaacgttattggtatttatttagtccttctctttgttggtgctctacatttgagctcatagaatatccttgacacagtaattatgtgtgtgttacatattttttgtaagaatttaatgagagccaagtgttaactgcctgagaaagcagctagcccacagagcctccataaatacgatgggcattcatgcaagacaagtctttacagatgtatcgtaagtcaaagacggcaggagccacaactctactcacatattggaaagccacatcttttaaatgccaacaaaacagtattaggggtgtgttctatttcatggttatttggttatttgttcaaccattaaaattatttccacaataacgagaaactatttcctttatacatcaaaactagatgcccttgtattctgaatggaaccaaataatgaattaattttcaggaaatttaaaccatatttaactagatgagttaaaatacaccttctaaagctccaggaaaataagcctctaattattgaagctggaaaaccaacagagcagaagcaattaataattgaaaaactcatgctatggaatgttcagaaattttaaatataatagagaatcattgattttgatgcaggtattttaagacgccaaattacaaagctttctatgcaattactgaataaattgccagtcatatacagacttcggtgtagatttttttttttttatttaaaaagggattcctgactgactttatattaccaccagacaaaagaatggacgtgagagagagagagagggagggaggaacactgggagggagggaattagggagggaggaaggaaggaaggaaagtacgaaggaagacaggggatataaaaggcagagagagataatattacaaagaatttttactgacttttagtgatcaaaatataaaaccaatattatgttcatacattatatccttatgactgctatatgaaatgcctgcaagccttcaagaaaagtatcttagtatttgttctgtttacatgatacaatttattcctaggggacctaatacagatatgattactgatactatttaacaaatacagacatggctcattgtctaacagcctgtacccaatccttctctacatatgcttccctaataaaagagaaaagaaaacacttaaagcggtttacttaacaaaaagggataggaacttgaaattaatttccacttcctggtaaacacataggattaatttaaatctagtagaaggtagaattatacagaaaacaaactttgtaatggagcagctccaatttggagtttcaagtacccaagtatccaactgataatataatactggcatataaaatgaggtatagacctgattctgcagggacgatgttttttccccctggatgtcagtttactcgtttgtatagagagataatatctgcgataatcatagtcctaaaattatatttcaagaatatatgtattgcacctgtccatctctttcatggatgtatttagtatatctttttattctatgcaatatgcttcatgttatagaacacttcaatatcctctgaaaattgtgaagcactctgccaattcgtggtcttattctcatggtgatctaatgtgataaattatttcttggtcttcatgtgaccgagtccttgcctactacagccaggaggctcagtgggttgagaagcctgcgtcgagaagtcagcgagtgaaacgccaccactctgcattgtcactctgccacactccctcatcacatcacttaaccttcccctctcacttgctctaaatgtgaaatggagaggaagacgctgagccaaaactgaggaagtgctacatacattaaattacctagtgcttgtgaaccatctttaaacacataaattattttaaaataaaatactttgcatgcagatgacagaacagacctcataaagcattatattataatttgttcaaattccagaccctgtcatattccattaatgaatacaggatgattcagggtgaacacgttgagatgaaatgtggtcctggaacatggaaaactcgaaagtggaagctcattgtgggatgcagcacagatatgctaaattattgtgaacgtaaccattcatggtgactcaaatgcgatggcttgtggacctcagagcagtaaacctgagcctttgctagacgattttttaattaccaagggcttttctttctcacacaaactaaatactcaaagaattatctgagtcctcccatgaaacagacagtgagatgacggaaacccggattttcggtgtcatttacagacccacaatctctaattttaaaatgaacccagcaaaaacgtttaattacctaactttcaaaagtctctaggaagtgataactcaattgcatgtgaagcacccagacagccacactctagacaaccaccagctctctaggtgcaatttcaaacctatagcttactgaggatcatgcagtgtgcacatgctcggagacctgacccaagtcccgctacaccctaggaaggtggcctagttccaccctagatgggaggctggctctgtcagttttcagcgttgcagtattgaactcgtgtctcacctccagcctgtggatgaagcaaagttctttgccataaaagtcccctggatgatgttagtgccatcaacaccctgcctgcttcccacgcccatctgtgggccatctatttagtttacattgcattcacttctttcctctggagctcttttcctgccaccgtgctactagcatattaacaaagagagaaatcttgacgataatcatatttttcaaaaaggtaattaactttctcttctcatccagaaacagtaattaaaatcatcctgaaaccatacaaagaaaagaagcatttgaaccatggtcgcagtgcctgtgagtttcatgtagagtatgctttgttgagcccattcattgaacgatgaacttcatttgaaaaccacccatttgatcacaaaaatctagtcctgtgacaaccttaaattctcatgctatgaatttgagggaagcagtaaaagatgaaggtgtcataaaaaaataataaaactgcagcctgaaagatggtcttacccttcctaggagttgaatgagcaagtacagatgcatgcctgcgctcttaagctattatttatgttcaattctatgtggcattttgatttttcaaaagaaccacatacaaagactaacttcaaatgttatctggactacctcatcatctcaaaatagacttatcttgaaatagaaaaagaattaaatatttttattctttttaaccacagactaatacattctcatagaaaattaatgggaaatacagaagactactcgagtaatttaggactgtgattaaagtggatgacattattgtacccaacttttcattcccatctgcctgtccaccactcacccgggggttcggcagcttctcccacagaaagcaaaccttatttcccagccacattgactttggacatggccctatgacaggcctcggctaatttccaagggtagggtgacagcactgacttaaaacctattcagggcagtactctcctgagcttccctcactgccgggtgggaaacgtgctccaggcagccaaacattctcacaaaaatgaaagactcatggggcacacttgagctgaaaccttgtcttatagccaagctgagcccagcccatcctgaatcacctaaaccccagacaaaccagagagcaggacaccagtacgtgttcattgttccgtgggcctgagctttggaatgggttgttactcagcatttttacagtaatagtaatgacagtaataatcctaatacatatgaatatacataatactgtacatgcacacgtacatacatgtgtagatacactataaatgttttcttatatgttaaactgaataaaaatactacctgtagtcttctgttaagaatcatatcacagtatgtaaactatcagctctatatctgacatagaataatggatccatagaagccagccataatattaataataatagcaagctatgttattgttaatattactagtaagaggaggagtatattctcaaaggtctccatgagggaagtacaagctctctttctactgcttttctaaattcaataaagcccaccctcagtaggagttcacttggaaaaacttcccaaacagtaaaatacaaatctgttgtgtatcccattgctctcgcccatagatagcacatctggttgacttttgtaaataatactcgtgtgggctcaatgtccttattagcatgcttacttgcaattatgtttcctgggtgctacacaaaagaggaatccaccaccacgattccggcggtgtggagtcacagagggcggcaggcagattggtttcattgccagcaccagtcggtcagcagcggtatagggttgctgcattaggaacgatgatcagagcatttactacagatgctggttgaaaaagggtgctaattatttgctttaaagaaagtgtgtaaatctatctttccaccaccccttcctgcgacaatcattggtagggcactatctagattatagacccttttgctaagttctgtgaattcaaaggaaaaagacggaaacatggatctaaagaattaagctcttgtaacttacttgaagcttgtatctgtactctcaaataataatcatagtgaataaaacacatcctcttggatcccttgtggtagaaaaaggctttcagtgatacaacttaatatgttcctagacacttatcataatgggtgtgatactaatggtttcacccaaaaattaaatagaacacagccagcaatcataccaacagcctttggacaatcggtttcaaccatttagaacatactggtttaaaaatctactgtcgcttgaacacgcccactcagaaagtttgcctaatgggagaacattaaaacataaacttatttagaaccttggtatcatttttcatattccccaggccaacaggcatgtaataaagtgatagtgctttcatgatttaaaagttatctctccatgtctctccaacaagtctggatccaatattctttttctatgtttacaaaaaactgagctggattatttggggtcagagatagaaatcattcttcaagaacataagagatccagaaaatcttgtttaaaattggaggacattttgctcttgatcttattgagttgtcttgccgagttttactttccagtcacacagatgagtacagcttcactgcctctggctgcagaataaaactgaatgaaacagatggaccttattaccaataaaaggagccatagctattaattcagggacaactgttacatacattcatgataaatacacgtcttgatatcatctgaattcactgatattattctttaggagaaaagatagagttttatgaattaggaaaaaatacttctaatgaagggcaataagaaaatcattaaatgtgttatacatattaataatattatacatctatagcaagagtttccggtgtatcaccatgggatgaaacaactgcttctaaaatctcccatctgatactcaacattttaagcagtaaggagtataagttaaatttccaaacattacctgcaatctaagaatactgtatgtataaactaacaagagacttccaggggattgccaatagacatgaataagaatctcagactaagttctactcttcagtaaagaggccttaggtttaaaagcctagacccatgagctctactccctacagctagaccaaaaggtaaagctgtgctctccagtagaaataatatgcaagccacatatgtaattttaacttttctaggggccatatttaaaaaggctaaaactgagtttgatatctagcctagcatatccaaaacatctgtcatttcaacatgtaataagtgaaaattgagataattcatgtttttttacactaaatatttgaaatatactgtgtattttatgcttctagtacatatcattgtggaccacctgcatgtctacaactcaacagccacatggggcaagcggttgccatattaaacagtgccattcaaatccaagtccggccacttaccaagtatattaacctaaatcagtttcttcacctgtttcttctcctgcaaacggggtaattacagtattgtcaggaatatcaagtgaatatatgccaagtgcttagaatgagggttagctcaatataaatgttatacaaaaataccagttaaagttagctcatttggtaactatttccttagcctttagaaacacaaaaccttagttaaggatttaagcctaccattttatataattctaaaatattttatgtaaacttcaagaactgagcagtattaactcacatccattccctgtcatgtattaaaagtaaatggatgcagatttttcatttatgtgaaatgatttacctaataaaattcaaattgattttctcatagtcaaatttaatatgttcctcaacttatttttcttttgtaaatgcacagcttgcatttttgtttttgacttttgataatttattccatagccattcataacgtgattgtaccttcaaactcactatgcagggaaactaaacaaggccttttcttgctttgccacctagtaccacccgagtcatgtttgatgttattatttggcaattgtctgtaacacttagtaaaatacacgtgtgtgtgtgtgtgcgcacgcgcgtatgtgtgtgtatgtggggggtggtggctgtgtgtctgtataattgctactttcccttaggggttccaggaaaatatgcagataatatgattttgtattacatagaaaatttcatagaaactttataatgttccaatgtcaatgagattccgtcatctggaaattttcataattcatatgtaacaatatatttgctctgaaataattgaaaaagctgaagaaagtgcctcgcatatcaccaatataataaatcatataaagaacgaagacgagaactttataaattagttcaaagagatcaaatgatttataagaaaactgtaacagccttgtgtctgaatcagataaaattaactgctacctctcctgaaatatgagattaaagaatggcataaaatagtgatgatattaaagacaagaaagtaaagagatatttgttgtaagagtttcattttctgtactattccacccagtgaaatgggcatcacacttaaacgattaatcagtaaagtaattcgaccctgttagagaaaggtattctgtaagtggaaagcatttttatggcaacacataaatgatcaagtgagaaaaataaggctgtagtggcatcaaccatcactgcttcattaatttctcctcatttctggaaaatggtgaatcacgaggttcaacaagagaactgaagacaattcaattttattgaatttcaatttaacctgcttaaattaggaatgtcaaacctagtattaattgggaatattgactcggagagagaagtttcttctttcaaactaccttgagtattggccccctgtatttttaaccattaaaattagttttttttaagtaatgtattatgttgaatcatataaaattgttgctatttgattatttttgttctagaagaatacaacttcaaaaaatacaattttatcaaatttaggggattggtggcaatgtattgctgccatagaaacaagaggtatttcccaatattgacatggaaaaataaacacatgtgaggctcatcctttggcaataattaaaatgtcttataacacattcacttcaaaattttgatggggctgtcataactggactttttaagttgaaatgatttctattggctcattgagtcacagaaataagaaaaaaaatgaatactgattcattttttttgcttcgtttaaatcttttagtctctttcaaacattcagtttattttaggaatatggtttaaaataccaagttttgcatagacataggaaaagatgtgattttttttcttctatgagacagtgaaatcagtgccacagctgcctcaaatcatagaactgttccctaatgaattgactgtttctccgtatagaattttctgataggcgcattagaataagtcatagaaatacatgctggttttttaaaataataaacgaaagacagaaagtaacagcttccaattacagcaggagtcaagcccaagaaaagacaaggtcctgtcatttataaaactttggctttgacatcatcgaaaattcctacgcagctggacaggagtctcaggaatgagaacacaaccaattatgcccttctgtgaagctcactggctgcttcgtgtgcagcgagataaacacagctgtctgttcactgccttgcctacgtctctaagtgagacacaaccagtcgaagtctgtatttcacagatgaatagttctaagtttgtcggggaggtgggggtttttctcccagtttgggatagtggctgcttccaatcaaagacagatgcttccagtctttttggtacaaacattcagttagatagaaggtataaattctactgctctatagcacagagtagtgactttgtcaatttctaagtaggtaaaaagagtacttgaaacgttcccgacacatagaaataatacttaagttgacagatatcccaaataccccaaatttgatcattatacattctatgtttgcaacaaaatatcacatataccacatgaatttatcaattatatattaaagtcaatccaagcaagctttttttaaaaaaacctacatacaatattttcatagatcatttaaacaaagattcttattctctataatttagtccattaagcaaataaaatatgaaagaaacatgtaaaaaatactattaaaagaaattgcctttcttcacaaagcatctggaaaagaccttgagtttgtgttctcatgcatttttgtagatgctcttatggaggaaaacacatttctaatactccacttttcatagggaatctattgttattgatatgttatcgctatgttttattacacccttgagaaacaggtaatattgcttgtatcagtttatagcaacactaaatcatgcatttcttgacaaaaatgtaagaataaacaattccacaaaaatagtcttgcccttatttatctgttaaaactcacaccaacactggaatccacaagaaacaaaacacaaacccatttttaagatccctctggcagaggtagatatttatgcatgatttacatagttgagaaaaactatttctaaaaatatgttaagctctcgctaaatccctgacaaaagcctcagtcactaatgcatacactaaacgaaatactgcatgttttgggcttaggaatatattcaaggagcaaatgtgcttagaaaaatcaaacatgaaatgcttgtagtaatgatctttctgttaaaaaataaacaaatcactccccccacagagccggggctgtgatgagaaataaaatttgctaagattctggaaaaaaaaaattaatagaacataaagctgccaccaagcccatcttaaaactttaattttatggaactcagcctaccagtctgccttgttttctgtattcttcctagatacaacagaacgtatcaaaaaataaatatcagaagctgtctgatttgctttttatcctaagcataatgagcaaacaccagtgaatgtgttaactctttccagaagccctagagaaacatgttcatcaaagttcaaatctctggcaaacatctttgccatgtttctaaaagggtctccagagctgtaataacatcaatttacacgttgcaagagagaatgacacactattaagagattcaagaatcctcagtaattcaagatggaaacaggataaactaccgacatacagactttaagaaaatgcattttggagtaattttactgttgcttgagaatgtctagggttgccatcgaatttcatcagatacaaggcagtaattccagagtgcatagtagcattctcaggttttgtgtgttttccattagagaatatttacaagtaggtcaatctactctaaatttcttaaatgtttgtaattatacatttttgattaattatttagtaatcagtgattcataattaatcaacaattgttgcataattgattaacaccctttttgagcttcatcacatttaaaggagaaagtaatgtacagttttgatggcaataacctttaaaaaataatttcagacaaaacatttaatcccatatattacggcctcagcctatttcttggaatatataacgaattccgtgaaaactgcaagaaaattaggtttcttccatcttcagaatgattttgtgtgtgtgtgtgtgtgtgtgcgtgtgcgtgtgcgcatgtgcgcgtgtgtgtatgtgtgtggtgggggatggagattcgctcttaatggccaggctggagcgcaatggcacaaactcagttcactgcaacctctgcctcacaggttcaagcaaatctcctgcctcagtctcccgagtagctgggattataagcatgcaccgccaagcctggctaatttttgttatttttagtagaaacacggtttcaccatgttggccaaggtgatctcgaactcctaaagtcaagtgatccacccacctcggcctcccaaagcgctgggattacaggtatgaggtaataataatagattaattatagcccagaataatgatttattcaatgctttaattaggcaaataataaagctatattttaattagtattgatcaagggtcttcatgtgctgtatactagtaggagacttggtgtatatgggtgaacacaacagcaaatcccagctcatgcaggtgtaccctgtgacataggtttccagtatttttgtcctaacattgagatcattgataaggaaatgttctaaaatttcaaaatctatattaattttagcttactgtaataaggtaccccaaaattataatactgcggactcttaatcatttgttagatactattagctcatatttcactgataaaaactatataatcacaaaactacgtatttggttgaataaacattttgcattatgactgtttattatagagactgatggatcctcatatttcataaatcattttccgttttttaaatttattaattatatagaattagtttaaatttccttctgaattatgacttgactggaggaaattaggtagtatcccgctgggtgacctaaatttgaaatgacagttctgactcaatcaatgacatctaggtcaatatcaggaagagttggaacgtgtaataatgaatgtctccagatcaatagatttgaacatgttagaacaaagttttgtggtttcatcaaatgattatttgatgaaaccacaattaacaatttatttgaattggcttcaaaccaatctgcatttgtgtccttccctgctcagccttctgagttaggcaaaaggtatgacatcacagtcccactgtggacagagccagcttgtggacacgtagccatgtggggctactgtactgcaatatattaagaaaggaaccgggcttattggctcaagcctataatcccagcactttgggaggctgaggtgggagcatcacatgaggtcaggagatcgagaccagcctgaccaacacagtgaaaccccatctctactgaaaatacaaaaattagccaggcatggtgacacatgcctgtaatcccagctatttgggaggctgaggcaggagaagcgcttgaacccaggagatgaaggttgcagtgaactgaggctgcaccattgcattccagcctgggcaacaagaccaaagctgtctcaaaaaaaaaaaaaaaaaaaaaaaagaagagaaaggaaacctttaaatctttttaaaaggagtttatataataaacacattttacagatattagtaatttatcttataaattattcaagtaatgaatgcctaaatgttggctcccaagaagggctgtggttgttttaaagagtgggactgctttgtgtgaattggttatgatctcatctaggctttctaggaagtagattttaaaccagatctggaaagtggattaatatttgaaaacggaaaaatgagaaaggcattccagaaatgaaaagtacaaaaatgtcacgctattaaggaaagcaggtgcagaggcttaccaggtgcacagataaacacagcaggactgggtttagggagcagaactgggcagaatgtgaggaaggctgatcacagagcatcagacttcaagtttgtctgaggctttgcatgctttggctcaggttggtcactaaatcacacttgttatttgctttttttttgggacagagtctcgctctgttgcccagtttggagtgcagtagtgcaatcttggctcactgcaaactctgcctcctgggttcaagggattctcctgcctcagcctgccaagtagctgggattacaggcaagcatcaccacacctgggtaatttttgaatctttagtacaaagcgggagatggggggctgggggcactgtggggtggtggagtgagggcggttcaccatgttggccaggctcgtcccaaactcctgacctcaagtgatccaccctcctcaggctcccaaaatgttgggattacaggtgtgagccaccatgcgcagccaaatcacggtttctttctcattttcattcaacacagattttaatcaagagccttctgagtgtcaagcacagtcgaggaaccaggcgaaccatgtgaacacctgttcccgaccgtatggctctacaattcccactggtgaaagctcatcagaaagcaggacttaaacttctacaaagaagtgatttccagatgcaaaaatcaatcaactaggaggctgttgcaggactcatctaggactgaggatggggatgaaggaacaggaaaagatgggagagatgtcacagagccagaactgagagacttggcaattaatggtatacaggaagcaagtcatatgggggtctcagaaacagtcacatgccctctgaggtttggagcataacaatcactcccatctactgccagaaagggaattgcattgaaggacagctaccatttaacagtaaagaaaactgcaccaaacacagataagagcagagggctcagaggctcctggcagggaaatgcgtgttaagatttatagacatatatgaagaactagaccatgtatatacaactttattatgtgtatatacatgcctccatgtatctgtatataaatacatatcataatatttacataaatacacacacatgtatacacactatactcatgtataaatattactgtgctcctatatgtatatgattttaacctagatttgcagttagtgaaaaaatatgaagattttcccactaatatgtgtgccaggcctgcccaatcaagctatacattaaggtggctattattttcttcaagctcacatttttaatatgctaagataaaacatctataacaaattaaaaaaatgaggcctgcttggcaacctacgtcaagtctctggcacagcacagcaagtgttttcatagaagtaggagcaagacgcaccttctctagggaggaggcccaaagggcacgtccaatgatccagttcttattccagccacaggcaaaaggccaagacactactgcatggtttccttttcaaagtaaaattataatttcccacattttgactttgctcatgcaatcaaaatacaatttttgaatcaaaggaaacaatttaataacatgcataaaatcaatggtattacagggcagatgtatcaaaagataatgctatcacaatcaatactttaaattgcataattttgtttgtagtcgaattaatataatgcagctatcacgctgagtaggtactctcaatgtgattagaaatacaccatcatgagtgatatataagtgcagggagcttgtaactacaggatcatttggtgaaaattgaaaatagttaatgatatgatagagtttcagcaaagaacattagaacaatcagcaacaaatattatctgctcaaacattatattttaatctgtctaccctagcattaggtacagttaaaaagttaaatttcacattgaggtattatgcatcattataataaggttcagtcagcgtcacagtgaccagcactttttatatatgaattgcaaggtaaccaactcaggaggatgcattgaactgaacacatgtaatacagaactaaaagtcgggaagcctactcgtaaaattgcataatttatgtgacaaatgagatttatatattctcaatatatcatatcaccatgagttctcctgagcaaatgttttaaaatgtatagcaatagaaaaatcattctttgtaacgattttctcgtaggtcaccccgatttagtctagaaaagctcgatgaaattgaccaaagctagattacaaaagtataaatttgagcattgcctgccacagtttaatgttccttcaataagtgccatggaaagctccccttgaacaatataacatcgttttcttttcttaacattctgattacaagagagctcagtaaatccaaacttaaattcaacctcagcaacaattttgatttagtttagcatacattaaatacatacgtattaagaataatattatataggcatgaatccagagacacacacacatgtgcacatatatttccctgataaatcatgtgtcaggccacttgtcacacccttgagggaaagtgccagtaaaaggaaataatatctttagagaaagggcaaaggtatgaataaattaataaacatttagatgaaaaaacaatcatcatgtagcacagaaagtgcaaatgcaaacataactcatagtctgattataatagctacacatcgcttggtactttgtaaaacaaaagtattttcatttcattagagactcaccatggaattatgcattatcatttttcccacttcacagataagaaaagttaaactgtttactaaagaaagttcagtttaagtggtgagaacaaggtttggaaatgggtttctgattccaagacctgtaatttatattaaaactgtgacttgatttcttcatttgcaaaatgaaaaaaaatattagctatgtttcatggctggtgaggaataaatggcttggaagacacagaatacctggaagagcagctcagcaacaacagcacttgcatgtcacttgctgctattctatcgaaaagcaacagcagcaggcagctcatgcgtccttctgctctactggtgtccttccactctcaaggaacacacattcaatttttttgacagaagaaataataataacaattattacaatattaactagtatttggcattttacaattaacaaaaacaaaacctcatcattaaaaacttgttcatatgatttaccaattgtattagacaacatagctcatattcacatagggaatatgtgtccatttacttgacatggaaataggcctctcaaatttgtttcattttatgtcattctgcaagcttcatagagcaaataaaatttcccaactgacttatagaaatattattgccaaattgacatccaacataatacatatatgctatataggaccctatattaattctgattttattttcccttgtgttagaatctcaaattttgatgactgtctcataagtaaaatgtgtgtatcttgttaagcattttcaaattttctccttttaagattggaatatcaaatactccatcaacaaatatcatctgttgtcacccctgtctcagtcttttgtaaattctgtcccagtgtttctacagagttcttacagataaaaccattgaacggaaaatgctcatgtagagagggacctggctgcttttccatgaaacaggagtcaatgctaagggtggggctgtttgggtgtggaggttccattcctccaaccagaagagcaaacgagtgtagggaacccttctctaagggaagaactatctgccctgtggactttgggggtggggagaaccatttatgttatcataagtaatttttgaaatatctacttatcaatcaactaattggttttattgtaattggtaaacctatgtaattgttctattcatcaacatgtaggtctccaattccatgcttctcttcctgaaccacagcagtctatccacctgccttgtacctctggtccaagaaagccacctaaggcaaatctgagctgggacagaggctagaattcttgcaccacctctctgtgaagggagagctactcaacaagctgcatttaggcagcatcctctcttggcctggacagagaatgatatgcattattgaattgtagcggtgacccgacttcacaaaaaataaacactacagactgccaggaacacagggctgggcacagttagtgcgccatagaagcctgagtattcagaagcattataaaaaggtaagaatgactcatatgcacttctatgatttttaagcattttaatagagcttgcttggcaattaaaatatacacgagagcaagattaaatagtagccatttctgcactggttttcctgtcaatgttaacaaaaagcctaccaaagagccataaggaaatggccaacctcctctcagaaagacagaagaataataagggaatgatccaagtgaagaaaaaaagtgagcaaagaaatgcgtgaaaacaaacgggatagctttctgaaatcactgaagtaattttgagttgaaaaattcagaatgattcaagcctgtgctttgccatcattcaaatggctgtatcatttccttaacaaggctgcatagctcatggactaataaggatctaactttgcattcaggcataaagacatttattcctgtttttcccaccttattaatatgaaacaagacaataagatgaagacagtaactgtaatacttgttgcaagctaaatactaatgcaagaataattgttgttactacttttatatggaggtgatttgagatttttctcttaacttgcagatgtgtatatcttcatgttgcttccatctttcctcaagctttactttcgtagtgctcaaaaatggtaagagacacaatctgcacgtagtcattagaatgtctcagatcgcacggcttagattgctccacaccaagaagaacaatgtggaggggaaagagatcttccttaagtgtaaaaagataccagattgatacttaagatctcggttgtatcaggcaagacgccgaaacttctctgagtcacagatcctctcttctctgtaatcacgtcactgtgacattcaggtcacgtcatggaaggaaaaacattcttacaattataaaggattattacgcagactccagttcaaattgaggcaaatatgaataggctgggaacatgtgccagtataatccaatccatttaagaatccgttagtcagagaaactttatccaaatagttaaatagctccaaagaggtgcgtttatccccataaagcaaacctagatttttcttcttcagtgttttgatagaaaattaaggtaaaaatctcatactacgcagtaagacagtacagggaacgcacttttctcatatttcatgcacattcttcatgaattatgaaatatcttacagtacaacacaaagaaaacttaaagcatcattgaaatcccctagtaatcagggctcttcctacagagtctcatgcagcccttcatattcagaaaaatagggaagtttacttcacctaatgggaattttgaaaggaaatgatgactctgattcctttgaagaaagagccctattcattttggttgaattccaagcaaaatggatgttcttgtgttataagtgatgttacctttcctaacactatattgatgttacaactctctagcaattgggtacgtgtaactaaataaaagccaacaaactcagatcagaaaagctgagcctgtccccactgcctccacacgcttctgctctagcccagctgtaaaatgtgtgtaatcacatttgcttgcctgcttcaggtatttttaaataatctaatcgaataaagcttctcagagaatactacgtaaaataaagttcctctgtaatgcaatgacttctgatgtcatcactactatgggaattattacattccctctttcccttttctattctcttcctttcttttcgggttcagtaaaaaaattaccagaacattcacatgcttcctatcttccctttttgaaagttaaatgttataagcctctgaatttacttctgtgactgtgcattccagcaaagtaaaataaaattgtgtgtgattcgtgggggtttgcaacttactttcaccgtaccacttgctaactagaggatccgattatgggtcttgctgtcttaggacaccagataccactgaagccttgcccactgcaggttactgaaatctaggtttatgtttagagaggacaaaaatgtgttcattgctttatttgacctcaactggcctagtttgatgatttttttaaaaagataatctatatgcctttaagaggattccaaaaaatgtaaactgtcagtttacgtggattgtaacccgatggagatgtttctcatttacctgggccacaggataactaggcagttatcccacctgtgacttaaactatgtgcaggaaaaatttttacatttttatatttttagcaatttttagcaatttttacatttttagcaattcatagaaaacaaaaaaagatacttgagatactttgttcacagtatttatttaaaatataattagccatatacaatgttgtctctcctatatgtaagctttcataagaatgattcactatttttatatataatactgtttttaacctctgggtatggcaatcaaatctttttagaaaatatttcttggtttgatgaaaccatatgtattttgtcccttctgtaattttctccgtcagattgtctttttcataatatgttatgttaatgtgagaagtgcactgtgtactttctgtgactaatattttgttttgataatttattcggactttgcctctgatgatcccatctagcaaccatttgggaaatccagtaattatttgtatttcacaatttgcagttctcattccatcactgtgtctgtgaaatgcatttttgccactctgtccactaaatttattttaagtgatgtcttgatacagcatgaatatactggtgtcaaactgaagctactggatgctttatgcagcaatcgtcacaactgctggttcctgtcagatctgtttaagcctaggttcttattaggtttaatccaaatgtctaaactctttaattgcctaattcttatgcttgtgttttccaatgttgaaactcttggaattaaaaacaattaattattttttccagattttagttctgtgatgacttagtttttaaaatgtattacaattacaattacactctacaagtatgactttgaaaaaaaatcaaagtagttcattaacttttcttacttttcagctacataaccttagtttcctcactcactggtaaaatggggtacttagggcaaccgaggattccatagaataatgcatataaactcacttgcaatgtacctcatctatactgaaggctcacttagtccaagccctcgtagtatatgagcccagtacacacagcaaagatgggcatttgcccactcaaacatacatcgaccccctactacacatagcctttagaaagaatagcaataatcacaacactgacatataaacaagtaattctctatggtgagaattaatataatgcaatacagatactacagaagtgaaatgagttgaaaaacttagccagtgtggtggtggtggcagtgtgtgcacaagtgtctcatggagtggtgagtaggggagaaaaagaaagctcacagaggttgaagataaatgaggcttgagagaataaaaggaaggcttaatattgaactttgagagagaaatactcttaacaagagaagaaagaggaaagagcattctaaccagagaatatagcacaaatctaagtgcacacatacacacccacgcatggacacacacatatacaatcatggacacacacatacatgcacacacaaacatccatgcacccacacatgcacacatacttgcacatacacaaataaatatccacacacacacacacacacacacacacactctccctctcacacgtacatgtaaggaaatggggaaaaacaattgatgcctatatatatttttggacaaagtagtttaattcattctctacctataacatgtaatgttatagattagccaagaaagagggctagagatctcaacaagaaaatacatgaaatacacaagtttttcttgggtacgtatcaattgaaataatactttgtgttatttggttgggaggtagatagtggatgaaagtctgaatgatatgcagagttttaatttaatgtgaaaagtgattaagtccctgagacctctaagctaacatgtggttccgggtagaaaaattgtataattaaagaagactatttttcttgtttaaagaaatagaatggtttttaaacagagtagtcccaattaaaatattttgggaatacaagaaagttctattaataattacaccacggaaacagtctcaaacaagacagtctttcaatttcaaaggaattagttgatgaggtctgtgtatgtgtgtgcgaacacacccaacagaaggaatctcataacgaaagtgacaatttttgcgtacacatttctatccactgaaataactgctgacatcatggaattacttggaataacactgctggaacttgtcactcaaagacaaaagctaacaagagtaataattagtattttaatgtactcggaggaaatgaccaggtatatagcctatatttaagaaacaatctgtatctccaagtgaaatgtcattgtaatagaacgtggccacagggtaatgggctgttactgctacacaaatgctaacgtaaagccaagacatttctcgggaatcaaagtagaagcaatcaaagaatctctttggaaagtgagcgaacctgaatgcactgccatgtttatgacacttaggtttttatcctttttgaagtcaagcttctctgcagtttattctctcccattttaaatactgcatacatttataacttgatgaacaacacaaatcaaggtaattttagatttcaacattttctacctgaagaagtgggataaatgtgacttatctgacatttttgaagagatgtaatcaatattcaaaatactgcacgtttaatatacatacttggaggcatttgaaatatgcatacacccatgacacaatcaccccactcaaggatataaacaactattagctgtcagtgttttatcctgcacagatattttcttgtgtgcggtaagaacactgaccttgagatttattcgcttcaccagttattcagcatataatgcagtgatggtgactctaggcacagtgtagaccagcagttttctagaacttactcagtttgcatgattgaaactttatacctcttgaaagatcgcccgatttttccttcccctggcccctggtaaacacaattctactctctgcttatatgtgtgtggctgtcttagatacttcatacaagtgggatcaaaaagcacagaaaagaaaagaaaaagagacatgtgagactccctcaaactaaaaagcttctgcacagcaaagaaaacaatcaatccagtgaaaaggcaacctacagaatgggagaaaagatttgcaaaccatttatctggtaaggggttaatatctgagatatagagatatacatgaagcttctacaaatcaaatgcaaaaaaaaaagaaaaaaaaaagaaatcccacaatccaattaagaaatgggcaaaagacacttctctgaagagatacaattgtccaataagcacatgaaaaggtgctgaacatcactgcgaaccaagaaaatgcagatcaaaaaacaggcagctatcaccttacatctttgaggatgactaatttttttttaaaaaaagaacaagtgttggggaggatgtggagaaattagaaccctttttcactgtccattgaacatgaaacagcacagccattgtggaaaacaatatggagtttcctcaaaaaattaaaaattgaattaccacatgattcagaaatgtcagttctcggtatatatccaacagaattcaaatcaggatcttgtagagacatgagtaccccagtgttcattgttgccttattcacaattgtcaagacatgaaagcaacctaaatatccattgacagatgaacatataaagaaaatgtgacatatacacacatacgtatatgtatgtgtgtatatatgtgtgtgtgtgtatatatacatataatacatatataattacagctttttccactttttaaaagacgcaatcctgcatatgcaacagcatggatgagcctggagggcattgcgctaactgaaataagctagtcacagaagcagggatatttttagtttctttgattttgctttatgttgtttttatttatttatacaaattcatggggtacatgaaaattttgttacgtgtctataatgcgtagtgaccaagttagcgtagttgggatgtccaccttaaacaactgatggaagagcaaaaaggagataacttgggagaaattgctgcaggcacttgcacctcactctcatgtgtagctttccttcccactcattctaagctcctttccctgcgctctgcctttcgtgaccctcatgccccataacccaatggagagacagttctgttttaaacataggagctccctctgctatatggaagtacaggcttaatgtacttttaccaaatcttacgactctataacatttatgttattagtgccagctgacggataagaaaaactagatttagagtgattatttaacttgcctcaaaatctgagcacttatctagtgccagcttactactcacccttgagtgtaagtttgtgctcactacacgttgaatacgacggtaagaaatcaaattgcttgcctatcttccatggaccacatttatgtttgtatccatggatggctaacagactaagaacagggaaaaaaattaagtccatgttctggcaatgcccttgtcctcaggtgtgaagcagaatcaatcagctagaataattaaaacaaagaaaacaggtatactagcaaagttttcgttgccatgcaatataactgaaaacctcagaatgtatctgcttttattatttttcacaggtatttttgtaatccaaatgaatttaaggactaatatttacttcattactcatgtttcaagcagaaagaccagaatggttttcattttatcttaaccctaaggctagaagagcacactaagacacacaaagcccagcggctgctcgagttaccttcctcgacttcaaagctgtctggatgaagagaaaagctcgacagaaactctcttctttgcagaaacctcttcagcaagtcaaaacaaagtgcacttaagatgaactgaatatttttcaaaatattctaaaattttccaccaagtttcttgggaacactttttcaaacaaggctttgtttatcaatgaaaatacagcctgcattttctttgaggagcttgtgtctcagaaagattgaataggtaagtctttaggaattcccagcttctcgaaatgcttactctgatttagtgaaaaacatccattgagtaggttttaattatctgtagatctaaaaagaatgtgttttactccactgttattttcccccaaaggatttcattaaagattgaaattcagctcctgcttaaacccctggaaaatttttactgtaatctacaggtacagcctgtttaaattcttagtttacttgccctttaccattttaatctttctcgtcctcaagcaactgcttgaaatacaatgaaaaatgtcaaatccaatattcattcatgagtttcaaaagtatgctgactaaaacttagaattttaaccatcacataataaactttataatgcaaaatgcatgttatatatttaagccagctacaatcaaaagaagcgtagtgggatttttttttacatgagtccaatattcttcagtcttttttgacaaaggtatacaaagttgattttccatcactacaacttatcccacgaggaaattcacttccatcccacaaatacagagctcatttaagtgttttcaaagcagcactattgtcacttaatattctacatgctaagccaatattatatgaaaagatatgttccatgcacttagtacttttgttaccttcaatgaaaattatgtcaacaaatgtgctgacttttcttatagccacaagaaaataaggtagcataagcccaattgttgacctgaatatggaagaccacaatgactttgctgtagttatttgatgacataaccacgcaaagcaggggagttgacagataatcttctctcagccaaattcagggagcttctgctgttttctgagtgtcttggggtaagatccgaaagcacctattggtcctttattgcctgagccatcctgtgccttcctgtgctctttcacaaactccagactgttgtgcctaccaccttttcatcaaaacctctcatctggaatccctttctttaaaactgagaacgttactcggcatggggttggcaatatacattgaccagagcccaggtgtgtaaaagtcaacctggcatgacttaaaatcctaacgctactacttttatcatttggaggtacattacctaggctcctcatgcctcagtttctttacccttaaaatcagatgagcccagaagtactgttgtgaagaactgcagattgtagctcaatactgcccacagaaccttcatcagaataatcatgatatgcgttccacatcctcgtcccagtacttaatgtgttcataaaggttaattaaccatccccaaaccatagagctagtaattcctgtaatagtaacctgacacatgattatttatcaaaactgcactaattattattattagagatacattatgatattgaaaagtaatgataacttaataggttacctttctccactaacattttgcatttaacaaagaggtggctaatggttaaaatatctgtttcagtccttttggtttatgattgatcctgcctgttgcaattccacagccaatgtaatttctcctttcaatcttctaataaagactgctcaagttgtttagatgagaattttaaaacattaaccattttaatattttttcagttagagtttgacaatatttagtcataagctttatcccatcaaaccattatattaatctatgttttcatttaacctacattacgtgtctatactgggcaacactctgctaaaagctaaaaacgtagagatacaaagatgacttagtcataccttttactgctgaacatctcaactcagcagtagaaattaacatttaaggccaggtgcagtggctaatacctgtaatctcagcactttaccaggctgaggcaggaggatctcttgagcccaggagttcaagagcagtctgggcaacatggcaacctcatctttatagaaaatttacacaattagctgggcacagtggtcatgcctgtggtcccaagtactcaggaggctgaggaggggggatcgcttaaatccaggatgtgggagcttcagtgacatctttgcacctctgcactccagcttggatggcagagtgagaccctgtctcaaaaaaaaaaaaaaaaaaagaaactcacatttatgtagctgtttcacacccacctagttaatggtctaaagaacagcaagaagcagtcagtgatcgctttaccttggggacaaggggctggtcagagtggtacaaagtttactttgaatgagtccttataggtaatgccaccgttgccctgtttagaggccttctgatgtagaaagaaaacacacacaaaaattttgcttacaaacatatcggacagcttgtctttccgtgctctcgtgatgaactgcctgtccttctctaaggcactaatcacaaggacttatacctgtgcacgtcctgcctaggccagggatacccaggtactgaagagctacattcttggaaactcagttctgcaaaggccctgaatcactcctgagaaatctgacagtacaagaagagtcttgtttacagcaatgggattgtgaaacagacaaagtgcttctaattttcagcctcacctcaaccctatgccacaacacccaaatgaattcaagcttggtaaagaaaggaaccatgaggtttctatttcctttctttttcctacatttctcactgccagcatctaccaagatttgacacattagagataattgatggctgtgaaaaaataacacttatctgtaaaataattgacaataactgaacttgtatgtttggaggaacacttaccgtttcagataatgacttaggatctgtctttttgctagattgtcatcatagaagaatcaagaagctactgcctgacaatggattaccaggagattgcagtttgtgtgtcaagaggagacatcataagccattacaaattagatagatgacaaacacatagatacatagaacaaactatgacttgatcgtggtagttttttattgctaagaggtcacagaaaaatccacttaatgcatgccaactaatgccaatggcaacactgtattgcaaccctgtgtcattgtatcttcgcttaattggaaccattggactttaagaaatataagcataggtcattccagagtcaagtgcagcctactgtgaggttaatgtggaatgagcagggaaagaaagagaaatcagctaagtgaagaaattctgggaaaaaagaaaatcaagatgattcctctagaatagagtctaatgaactttcagtgaacttccttatgttacccagaaattatctgctgcctgaagaaaaaggtagctaatcaacgaggcatttagaggcccttcattttaagggctgcacaaagcacttggtgaataacaggatgatctaccctttacttcaactccaaccatgcgaactcaaagtgggagggatgttttttccattttacctatgccttaggaaaaaagaaactgtaaaacttcgttaaatcatccgttattcaatggacaaagaatctagaatctgaaaaatgcaactattggcagatgtcctttcattttccacacctgacaaaaagagggagaattacaagagcatattgtaggtttgactgggaaattagtgctccactgggagtctttactttggatcacatcttcttcctagtgcttcagcaattactgcaataccttataattaacatccttattcttatgaataaaacaatgacaaaggacaaaactgccgtcatttattgaataactacaaatatccatatgcattatggagtacattctatgtgccaagcattttacactatcatcttagagttttgtcaagatgctgctcattgcatggtacatatttttttttaatatcagaagataatgtgtctccaagggtttaaggaactcttacaaaatgtcatgccaaggtttgttgactccacagccacctggtgacactctttctttcgctttggaaaggtcatggaatgatgatactctgatttttgttcatacttcaatgaaatggtcaataaatatttactagacattcacaaacacatgcctgtacctggccttggggttctagtccaattcctacaactttagggagatgactgcagcaggtccccttcagggaccagcatctcccaccccctcccctgacactcaaagacaaagcacagtgtgtgccacatccagaaggtgcaaggatgaggatgaagaggaagcagctgacacaagcagacacactcccctgaaagctgggaccttcgagatttaaaatttttgtctgggagaaaaagtgaggggaactccaaattcccactgcacacatagtcactttcaaaaggagcttcctccaagcaatgccacatgttaccttacaatcaaaccagaaccaaccaaagcttctatctacccttctcttcgggaaccttttgtgtactgttcactgaactggcatgtatctctgttttcctggtattttaattacactcacgtacatcagcaaacatgcatggaacgccctgagtgtgggagggtttgggaggtgagaggctgggatttggatgaggacattagccagtaatggaagtttgtgattctagttcttcctgagatgttcagtccttagcgcacatgaggagatggacagattcttacggagatgcaatgcctgagtggtatgctacagtggcaatgaacttgacacatgactgaaagatacagtggacattgacatctactaagagcatcaggaagactttggagaagaggcgctgtggccagggaaaaaattacaaattgttcatgtaaataagtaaggggacttctctaggcagaaggaactgtgtgagctaaaacatggaggcatgaggtatgcaaggttttacagaaatgattggttgtctgcttgtggttaaaattattactagctgacacttagggattatagtaagtgtcaaatctatctgctaaatgctttaaatatatattctcatatttctcacaaagaaaactctcaggtaaatgtaacaaagatttccatttaattgttaagaaattaaagtggagagagattactgattggatcaactcttagaaccattaaaaagtggacccagagagccgagacattcatcctcagggtcagtcatctcataccctgtgataaaagcaggtgcatgtgtgtgagggcgtatgagaactgctagataacagaaagctccgaactagctcaagcactctaagtttagtacccttgattctaaaagctcttgtctgatttcatcaaggaaattcctggcctgccctgggcaccatttctgatttaaaataaatggaccgaccttcatcacttcaatagcttacattagaacatcttatgcggaaagtatataccacttgccaattctaacttggatttaaatctgtatttgagttttcatttattcgtcattctgagagtaaaattgatatccactgtattagtccattctcacactgctataaaaaaaactatgtgagactgggtaatttataaagaaaagtggattaactgactcacaattccacaggctgttcaggagcatggctgggaggcttcaggaaacttacaaccatggcagaagggcgaatgggaagcaagcatgtcttcatgtggcagcagaagacaatggtgaaggaggaagtgctacacactttcagacaaccagctctcaagagaactcactgtcatgagaacagcaagaggaaaatctgcccccatgatccaatcacctctcactaggaccctacctcagcattggggattacaattcaacatgaaatttgggtggggacacagagccaaaccctatcacccactaacagttgctgttaagtagataagtcattataataaactgtgatattccaaatggagcacacgatttttgaaagcaaggactttctccgctgatactgtatctctgcaacagagtagacaacactacgtagagtgttgcctgcacagcaagagctggatcaatatctagtggaaggagggtgactcttcaaacctatttaaagaaactcctgatttacattgacttctattcgttatcttaggatatgatcccatggaaggatagatcagctgactaaaagggagacttccaatcaattgcaagttggctacgttggctagctctgtactctagtgaaggttgtaaataacaaaccgtacatgtcacttggattggtgttcaccacccacctccttgattccacagcggcccctgactagtcttcactatcttagcaccttgaagagtctctcacaggaccccatttttataaaaatagacccgggatgcaatatcgtacgtggccagtaggtgccaccattagcaatgtaattttactattggactcctagagatattcaaatgaattccttttgtttcttgttacataattgaaagtttttaaacacctaattcatacagataaaacaaggatgtgttatgtcaggtttaaatctgtaattttagaagacaatacatatttgaacgtggtaaggagagggaagaaaaatatgtttagaaggtaggacatcaagtatctaccgaaaatcatttatgtgctacacgttacatactgggaacagaaaaacaggtaagatttacttgatggcaagaacgcatcatctgtaggaagatatacgttaggagagatataagcaatatagctctaagtcctaacaatattatgaaaaaaaagcaaagaggattgagtgggcacatgcccatgtattcacgcaacttttaggcaggcagtgaagttcgagctgagttgtaagggatcaacacatgaagataagggtgagctttctgaaaacaaccaatagaagggaagaacgaagtaatacgagttcaaaaagaatgagaacaacgtggtccaggataaagaatggcagaggaagtagctagctagtgaaaaagaagaatgaattaaaaggaaaaaaaaaggccaggtgcggtggctcactcctgtaatcccagcactttgggaggccgaggcgggcggatcacgacatcaggagatcgagaccatcctggctaacacggtgaaaccccgtctctactaaaaacacaaaaaaattagccgggcgtggtggtgggcgcctgtaatcccagctacttgggaggctgaggcaggagaaaggcggaaacccgggaggcggagcttgcagtgatctgagatggcgccactgcactccagcctgggcgacagggccagactccatctcaaaaaaaaaaaaaaaaaaaaaaaagaaagaaagaaagaaagaaagaaagaaagaaaaaaaaatcacagtattgggggaacaaatgatgacatttctcacataacaaacaaaagcgtttcttcactgccctatagatattagaaacctgggaatcatttattattaaggcggcaactctagacccagtgagcaagatggacccgagaaggttggaaatgaagcgaaggacaatcaagaggtatttatttattagcgtcagagaggagataaatgattgaattgcaacagtggcagtggggatactaaggagaggttacaatacaaacatcgtcggagattacgtttgaaaagagtggagacaggttgaccatgagggtcaatgcaaagaggtaatattccagaaagattctgaggttagtaatttgggaagctgagcatatgatttcaccattagcaaacattaagagacaagaggtagaactagttattttggaactaaagggagagacagtggattcttatgttgaatttgagatgcctgtgaaacaatgaggtacgcaaatccagtggacagtcagcaacctgagggtggttaagttagcacacagagattttggaattatcctaacacaaattttatctacattttgcatatgcataacctgaattgctcaggtgatgaaatgaaagacatcggtgagtttgcatgtaacatttttcttttatttgccacaatgattgtggtcagtatattttagttcaacatttacccaatctctctcaggtggtagacaccatgctaggtactgcagctgcaaaagtgagtaattctcaacagtgttatatctcatcaagtatccagacatggaattacttgtacatcaagccaactactatggtcactaagtgttggttgatttaaatgctgcctctttttctctttttggaaatgtaagtacagattataagtacaaaggagggaaatttaatttatattttgagaattaattaggtaccttctaaatgtaaaatatcctaccagattctaactaggatgtgaaaaataaatagagatggtttctgccttcaaacgagttcacagtttagaatattggacatacacaagtaatgcaagaaaagatcaactgtcagagcttcagctttccaatttgaaatataggttttataaggctactttaaaactggggttatttaaatcgttaattgtgaattgattcaggcattcatctaccttgaggtattagataggttaattaactaccatgactcatttttcaaattataacgtgaagactaattttcactaccttcttcccctaagatgttaattaacacactttagcagtgcaccatttccatgtcttatgaagacttctatgtggagccatgccacatcttgctgactgacactgacgcctcagctgggattgttatcaccagccagggggaagagatttgtccaaattctccttaagtgctgttccataggactggcgctcttgaatacggcagacagctaacatgaatcatgcatatgctaattgtaataaataatgaaaatatttagacacagagaggtttgaacttgaactttatgaataagttttgattagtatgcagtacaagctgtatactctgcttttgttcttactcttaaaaggcagtcagtacttaatgatgctttgaaattttagttttttattcatctcgtcgcttccacctttctatcatggagcaaagaagtcacaaggtctaaacccccagatatcaaagtacatgtctccacaggagtcttgactcctgtgtggacacactgatgtaatcgggccctgtgttagtttcagccaagaaaaaaaaaagtagacgctgtctccaaagaaatgagcccaaagcttagagccacctctcactctgtctgaggctatggttgctgctgtgtagagttctaatgggaaacctccatggctgttgaaaggaaactctgtagaacagatggcctttttttgttgttaagagaccacccagaagacagggctctggccttgatgttgttgttgttgttaagagaccacccataagacagggctctgggacagaaagaagtggtaattaatgagggcttcactaagtaatctgatttctaatagatccaaataatgttatgtctaaattgaaaagacactaacacatgcgggtgaggatggggagaaaaggaaaccattacatactattgggaagaatgtaaagctatcatatcatctagttgggcatataccccccaaaaaaggaaatctacacatcaagagataatctgcacttctaggtttgctgctgcactgtttacaatagcagagatttggaagcaacctaagtgtccatcaacagatgataaagaaaatgtggtacatagacaccatggagtactattcaaccataaaaagaatgagattctatcatttgcaacaacatggatgcaactggagatcattgtgttaactaaaataagccaggcacagaaaggcaaacacaaaagtatagctttttgcagctttggttcttatctgtggaatctaaaaatcaaaacaattaagctcatgaacatagagaatacaaggatggttaccagaggctgggaaggacagtagggagttgctggggaggtagggatagttaacaggtacaaaaaaaagttagaataaataaaatctactatttgatatcacaatacggtgactatagtcagtaataaccgtacatttaaaaataacaaagagtataactacattgtttgtaactcaaaggataaatgccggctgggatggatatatcgttccccatgatgcacttatttgatatagcatgcctatatcaaaacatttcatgtaccccataaatatatacacctaacgtgaaccccaaaattaaaaaaaaataaaaataaactaaaagacagatatagacacaatctagcaatgctcactgaggcattgcctgtgaagccagcagggggcagcagctccattctctctgttctatgggcccaggagctaactgcaggcaaggcagtgtgaatgggtgaccaggaagggacatagtggatttgccggtaataaaaattagtgagaataaagaaaaacagtaaaacttttttttaaagcaagggggaaatatagctttctgctacttgtggaagttagcttgtgtgcagtgttctccccgctcttcaatcctttgagatctccttagggtttcgttctgggttttattcacttattgactgagcaagtagtgtcaaagtgtcaggagacgtcagtcactgtgctaacgtaagcgttcatggaaataaaattaacagggtagctttgcctcaaagactatgcaatcaattattgaagatagaaaaataaatagaagattgcaacctgatatttgttctatggtaattaagcatagctcaaaccagagggaagggaaacaagaaactgccctgatgaagatgcttcaaacaaatgtgattctgtctcataactttcccttgatggggcaaagcatttactccgcttttacctgcttacacctgggtgggggtgcatgttgaggatatattcataaacaatcagtttgtgctttggcagatggaaacatgctattgcaaaacaatagctctattgcagacgcggaggtgggatgagaagcatttataagagacctttatttgcagaggacacttgcccaagcctcccttgtttcatgccatcggctcaaatgaagactaacaaggaagcagacctcccacccagagtttggtcggaaccgacagacactggctcccaaaccaagtgcttccatgtgaatgtgacacttcttgtttctcttgctctatctccagtagcaatcttttgttctactgcccagaacttaagctctaaaggttacataaacttattttatgaaagacaaatttgacaaattcagcaattcataatttttttaaacaattacttctacctattttgcctccttaacattcagacttgtggttttgccagtataactttttggaattggttttttgcctgtctgctttgtatttctgacctggtattttactcctctgagtcagtttcccacctcaaactccacgacttcttcaaaagctgtgtgtcgtaactaaaaccatccttctttcccttcatcaggttccaagaaggaagctctgtcatgagtcactctgaatatgcaaacttccttttaataaaaccacctaacttcagtctcccaattatctagtcattcattcattcatctatttgtttatagcagacagaagggacaagaaataagatagcatatgcaatgaatgcatacaaccaagcaaatatatttcataattatgtcaaagtatcacatcacagttagctcaacactttacacattctactttgtatttctagttctgaaaaaaagttgctagacatttagaatgacatttgcactgaaaaatcctaactcagctaacaactgtgattttttctggggctctgggagcaatttctttttccacaagaatggaccactaaaatgaacaacgatcggcccaagagatgaaataacatagttattttctgtttaatacttcacttaagaagaacttgttcctcacacatggttgggcatgaaactaagacatcagatttcagaattctcacttctcatgaactcaaagataagtacaattttggtaataactatacaaagtttaatagcctcgaattttaaaaaccttccacagaaaagcataaacaacagatttagaccttttgaattaaatatcgttaaaaatcatcttagtaaagttgatgtttgcatgctagaatgtatatctttcaattcttagtactagctattctgaggaacaactaacctcctgcgcgtctcctcaatacaactctacaacacagacccggagaccaaaagtcttcagtgtttgcaagtgtaaaataggaatgtggaacttacaggtgctttttgtcctgcatgcacaaaagcctggtttggggttcacagctatggctttcctcggtggaccgcatccataggcttgggaagagcctacctgtccactcacttagactccacggaggcacttgccagctgtggactctttaaggctgttatgcacatcacctgcacctgcgtcgtggcccctccactcatccctgatcatggtctatgagtctttcctctgccaccatcacatcgccagctgatagccctttcaggtaaagtattcctgctttaagatgttttgctactgttactcttccaccttctattcagcacagctgttaactgttatctgtaatgcaatgatgataactgtatgaaactagccgattacttgctactaatgttgaacatatgtcgaaaacattttaaccacttatatgttgaagactatagtcagttctgaaaacatacgatataacacgttaggtcttttgttttattcgatgaagtaaattaagttatggtggtgagacttgctgaaggagcagctttcaaaataaacttcccagagaaagaaaatatgaagaaataaaacaaatgtaagaaaatatagcttaacacagcagaattacattaccgaatgagcattgctatactttctgagtgacgtgtcccaaaaaaggtgcctgttattactcagtgcctgcaagagacaacttttttatcttctgaagaccactggcttttcagtttctctttgcccactaatagacaaaactattaaaatgtccatgtcgttatgcacagggcttttataccaggtaggattaagtatagaatcatgagtaatcattaccactattaataaaaatacattcttgttattaagtgcctaatatttgcgtgtctcaatcaacaccactactgtaaagtgaatacaaatatccctaatctatacttttaaaaaacaagtgcactgggctagtccgataaggagcatgtcctcttaactgagcgtttgccgtcagccccctggctccaccctgtcagcaccaacgttcttcctgtattctttcctgccttgagaagagcacctgctctaaaggatctttgtcgactgcagaaacaattggtattacaatctttattactgaatgcatatataaataatggtcagagcttctcctctccttgcaaaagcaaatattatacattatgttgatatatctagataaaagggaaacaagtgcaatggcatgtttcacttcaccaatgcagcctttggttattgattagccttaagatttttaaacatattgaaaacaatcatagacttatgctggttttggaactactttattctacagtttggaaccactgagcttcttgaaggcagggaccacaccttttctgccctttttattctaaaaatataacaaatccctaccacatgttatgtgttcagtgttaaacgaataaactagcaaaggaaataccactggacaagtcactaagttttcttaagtaaaataaaaagtaatgtgtcatacataaaacaaaggtcaaatacaaaccatgaaaccattacgctgaaatataaataggagatttaagaaaataatcatatagaagttcagaacaggtcaggcgcggtggctcacgcctgtaatcccagccgtttgggaggctgaggcaggcggatcatctgaggtcaggagttggagacaagcctgaccaacatggtgaaaccctgtctctactaaaaatacaaaaattagctgggcgtggtggcacatgcctgtaatcctagctactcgggaggctgaggcaggagaatcgcttgaacctgggaggtggaggttacagtgagccgagatcgcaccgttgcactctagccggggcaacaagagcaaaactccgtctcaaaaaaaaaaaaaaaaaaaaaaaaaaagttcagaacaatggatataactgtcctgaatgcatttttgtcctgcctctaattgatagggaaaccctagaaaaaagcaatttttcaagggagctgagagagatgcttttcaatcaacatgtaaatttcctggacgtcacctatgtgtaccattctgtatgagagatgtaaaaaggtgcaaggcaccagccaaaccgccttagaacttgcagtattattgaaaacataagccagacacacatgaaaagaattgtagctgtaaacaggtgaattgagtgtgggaattaagggaaccagggaagtcaaagcttattttcatataaatatgaatcttccagatgcattgaattttggccttccattggaaaaattatttaccagaattctacaatggacttttaatatctgactttggcttaaattaaaacttcttcttaatttttattccccttttgcaatctttaaaacttcaaatgcaagcccaattatagttattatgctctaaactgcattttggtaatctttcatgagttgtcagatgcaatggatagtttcaggaaatgacttactaaaaaatgtagcaagtgttcacttacagcgagcactaagggtcacaacgtaggagccatattgagcatagggcacatgtatccctgctgcagggaacccgggtgcctatgtgcaaaaccacactcagtagtgttcttctctgttggacagtagcctctagaactcaggaattttaataaaaacaattattatgagctagatgctactagaacaaaagagtttttgaatgttatttattatgctagcattgaaaagcagaaattaatagtcacattacacattaatggtaacaatttcaaaacagtgagtcactttctcaaagtagcgtagctgttaaatcttttttcaacgcttaaaggcttatcaatagaacaatggaaacgtagaattggaataaatcttaaaggttatataatcctggatgaccagtgtatgtgaaaatcagcagattctcatttcctttgtgttcagagcttgttgaatagtcatctaacatgctactccaggactctaacatcaactgagtgaagtcaaaataagagatgctaatttactctcttaaagctaaatataaccagactcatttgttaggatgtgcgaattgagagtcgaggaaatgaacaaacatgcccaagggtacactaccagtcttcttcctgggcaggaacattccaaaccactacattgattatagatggaacagggcgctttcctgcatcttgtgattctaggggaatacgatgtctccctaaccaaaaacatcccatctatggcccagtacttgtaccagtatttctaccaccagagattcactcctgaggctcaaaacttagtatcttattaaaatatataccttagggatgattacgaccttaagaacccttcattgttttcatgactttccttacagtacatttggagagattacaacaacaacaacaacaacaaaaccgagagagaaattgtgtgtataaaggaaagtagcaaagactaatcgatctaactcccctatttctgcacctccaagtcttcaccatcataaaggcccaatctaaaggtactgtccaattccaggagacatttccattgtccaagccaggagttctgttttctatggacctagggaactctgcctgaatcttattaaatgaatttcactgtaattattttggtatgtgttttatctactcttccagaatatattattctgttttacacaatgcctatcacagtgcagtgaggttgtacataagaggtctctggaacgtatccgttgaatgaacaaactgatacaacgtaaaatagaatcagtggaagcacaggagagctgaaccctgaatttggagtcaaccgcaatttaacaaagccttacctaacacacccagtgagctcttttctgggtgcacaggagttagttcagaagctaagatagagaaagctgtaacggaaagtgtgtttctcatgaatcagcaggaaaaatgagattgtgagacatttgagaaggatgctctcagcctgtagactacggtcactgcatgcatgttaaatgcctcagctttctatctttaggggaaaaataatgcatgaagtgtttgtctaagagctgacactggttttgatttacaaatcatattttttcaaccaaatatgagtcaagttctactacacgtagcactggaaaaaaaagtgttagttgtaggcacctggtaatttcaagtagtaaggttacattttccagctaaaactagcatttggggactcggtgtttttgtttacctaaatgtcctccagcatcagtagatagtgccgttattgatacattttgttttttttgcagaaaagatcactgggaaaaactcatgcccttcccataggaaattaacagatctgaatatggatgctacagctttcacccactccttttattttcgatttttctttactcagcataatgccatctttttgctcataacagcctcaatcagcactcttggccgcgtcaaggtcaggactgcctgctgcgactggctcgagattcaataaccagccatgaggggtgcacaacattaaatggacacagattgctttttctgtaactccatttaataagcgtcttttctaaacaatccatgcaaaaaatataattttttaggatcaaaaagaaatagaatttactcattattatcttagactctaaacaactaattgtagtgataattatgattatttcaaaaccatctcagtgataagcttaattaattctccaggcaaattcactaactgacaaaagttttctcattcacgggacaatccaaaccagccttaaaaatttaaaaagctaagagatatgccagtactacatctgcttaacagtacccccacagtatacaagagtatggttttacttaacttcgtgtttcccaaatagacaccagtcaatttggcagctcatgaagcttaataatcagacctatagcattttaaaaatcattttcacataatacttagcattttacatgcatatttacaaattaagttctactaaataatgtaaaaactatctatctaattttctttattacatatctgtgtttttattctcccctaagcagttttattagtatataaaaattatcactaacaataatcacctcttatgagaagtagagtataacacattattacacaaatatttttaactacatattttggttattgtactgttcagtattatatttgataaagacacaagaaagccatcaacatttttcgatttagaaaacgaacactgttaatgtgctggttgttttcttgatgtagacactagctagccaggggatacatatccacaccaacacacaccatacatgggatgatcctgtttacaagtgatatccattgctctcattgagaacttgaatcaaccaataatcaaccaaaaatcttcaagtgcaatcagcaaaacatctgaacgacaattcaccaattttgaagtcacgttctcctcaactacgtattttggccactgttgaactttggcctacgtggtttcttagaatttctatagtcaaccaatatttattgggttcctaccatgtgccaggctctcttttaggagctttgcattcagtgttgaagaagcacagacgggaaagaaagatgtgtaatattttgacaaggtctaggagacaatggtgtgctgtttgccgaaagcacagagagggagcactggccggtgctcagggagctgctcaagaatcacgtgagtagtatcacaagggcggattttactaaagacaattgatattcacatcagaaatttacatacgatttgtagctgaatttttcccactacctaatgaggattttgtcagtcaccgtggctaactaaaatgacaaggttacgctagcctatgaactttgcctattttgcatacacttacaaaagaatagagaatcggctataaatttgctgagtcagaacattatactggccatccactttctcacttctttgtttttccagaatgagcacttttgccaatcccggtttgttgtgctacgtcccaaatcaaacagttgcaggagttagaacttccacgtggccattgagtacctcatctctttctcctgtcctgcatactattgtgtatgaaaactagcacatgcaccaaagtaccaacacatgtccaggatcttttttttctttttgacctgtacaaaaaatatagctcttactttcaaatttggaaatgtgtgaagtaagatctttaacttgttatttccatgtataccttactatctaacagcctgtaaggagatgtgtgcatatgggtttatagatgggtttccttgcttggagggctgacatggtggttttcctaaagccatcactaactcagccagtgccccagccaggcttgtccttgaggttttggcagcacggctctctgtcttggttgactgagcctgtgaccagcctcctgacagcaactcccacaaccgacattgctgttttggtccagccacaggctcctgtaagattctgctttaaactcatggtacttttctaccccctgtaggaggctcagccttggtgactactccagcaattcctagaaattgtaatagctaaggatgacaacatggacttgtagactaacactttaaatttctcctttcttgaacttggtcccattttagattaaaatcttgttctgattcttaatcttgcttcccaggtcaagggtatcttatcttttaactaagttagaaagtaaattagacagcaaatgtgtttgcaaaactatatctggcatatatatgcgtatatttatatatcaactatatctgtaaatattcttgaaatagaataatagtgaaacttactggaaactaaaaaccatgtgcttctaaaacaggctattcattgggagaaaaagattatgtagtgatttttttttcaagatcccttacatcatttcgttaatgatttgtcagtagaagaaacaacttgtgtttttaaaaagcattcttgttctgataattggcgaactttgtcaaaatagggcaccacgctctgctcgtgtatcaagctttgatgtgaaaagagaacttacagatacttctttgtttctgaatgccactctctcgtaagtcactctctttttgcatgcaaatctaaggtctctcactatatgaaattaattaatgcttaaagtaataatgcgtttgatgatgcattatatctttagcactttagaatctcaaagaagattttaagagaattggcataaataatttcagacaacagatcttgcacatttgaatcctaaacaatgacactaacatcacattttcagataccaaataaaaataaatctttttcaataaattttaaaatttcaaacacttttggatttacagaaaaattgtgtagattgtacagagaatttccatacacctaatacccgactaccccactattaacatgttaaattagtgtcatacacttgtcatggttagtgggccgatactggaatattttattaaagagtccatactctattcagattcttttcagttttgcctaatatcgtttatctcttccaggaccccaccgaggaccctgtataacatttagacatggtttctccttaagctcttcaatgactatgatagtttcctgacttttcttgttcttcacgcctaccttgacagttttcaggaccgttggtcaggtcttctatagaattcctctctatcgggatttttttttttttttttgacggcttgagatataagttctatacaatatacctatttaaagtataaatttcagtgtttcattatattcccagatatatgcaaccatcaccatagtcaattttaaatattttcatcactgcaaaatgaaaccctgtaccctttagcaagcaccaccccccatcccttcaaggcaaacacacaccaccctctccttccagggcccgaacaacaactcgtcttcttttgtctctgtagatttccctgttggggacatttcctatgaatggagtcatagacatgctgtatggttttgcaactgtgttattttttttggatattgtcaaggttcatccatgctgcagcatgtattagtacttcattcttggtctggctgaataatatttcattgtatggaaatggcacagtttgtctatcctttcatctagtgatagactattggggtgtttccactttttcctagtttgaataatgttgacataaacattgttgtaccagtttttgtgtgaatacagtcatgtgctggataaccaccttttggtcaaggatgggccacctatacaatggtggtcacgtaagattatagtggagctgaaaaattcctatgagctagtaatggcctatggtcttccaacattgtaacgcagtgcattactcatgggtttgttgtgatgttggtgcaaacaaatctatcgtgctgccagtcattaaaagtctagcacataaaatgatgtatagtacataatgcttttttttttttttgagacggagtctcactctgtcacccaggcctgcggtgctgtggcaccgtgtcggctcactacaacctccgtcttcttggttcaagcaattatcctggctctgcctctcgagtagctgggattacaggcacccaccaccacacccagctaatttttgtatatttttatagtagggactgggtttcaccatgctggccaggctagtctcagactgctgacctcaggtgattcggccgtctcagccttccaaagtgctgggattacaggcgtgagccaacgcgcccaacccagtacataatacttaataataataaacaactatgtttctggtttatagttttactatattgtactttttattgttgctttagaaggtacttgttctacttataaaagtattaactgtaaaacagcctcaggcaggtccttcaggaagtattggagaataaagcgttgtcatcctaggagatgacagctctacacctgttatagtccctgaagaccttctagtgggacaaaatttggtggtagaagacagtgatatgtatgattctgaccttgtgtaagtctaggctaatgtgcgtttgtgtcttagcttttaacaaaaacgttttcaaaaagtaaaataaaacaaaatttcaagctagaaaaaagcttgtagaataaagctataaagaaagaaaatattattgtacacctgtgcatgtgtttcatattttaatgtgttattacaaaagagtcacatgtttaaaaaattaaaagtttataaagaaaaaagtaataaggtgaagttaatttaataaactgaagttaatttttttctttattcaatagaataaagaaaaaaatactttttgtaagtttgctataccctcagtgtacaacggttgtaaagtccacaatagtgaacagtaatctcctagatctcacgttcaattataactcactcaccgactcctacagagctacttccaggttgcaaactccatttatgacaagtactctatacaggtgtagcatttttcatcttttataccataattttagtgaccttttctatttttaaaaatgctctaatacacaaatacttgatattgtattatagttgtccatattatttagtgcagtaacatgctgtacagatttgaagcttaggggcaacaggctataccatacatcctaggtctctaggaagctaaaccatcttggttttagtaagtgcactcaatgatgttcatacattgatgaaattgcctaacaaagcatttctcagaatatttcctcattgttatgtaacatgtaactgtatatgttttcattgctcatgggtatattagaaatggcatttctcgattatattatgatgctatgtttaaacatttcaggaattaccagactctttgctaatgtggctgaacttttttccattcccaccagcagcagacatgcgggttctaatttctccacatctgtgttacgtacgtactatacttggctttttttattcttgccatcctggtgggtgtgaagtaggatctcatggtggttttggattgcattcccctgatgcctaataacgtcaaaaatctctttatgtgaatattggtatttgtaaaatgtatatgaagatcattaacctattttttaactgggttatctgtcattttattactgagctccaagagtactttctatgttctagatgcaaatcctttatcagatacacaatccccaaacattttctcccattctacggcttgtgtttttactgtcttaatggtctctttgaagaataaatgtttttattttgatgaaatccaatttatctttttttttttttttttttttttgctcttgcctttagtaaaaaacatctttactcttttttcattgattgctcaggaagcttcctctcccttcagtcacatgacaattgcaaacattggttattttccaaaatcttccatttccctcctttgcaccactcctcccccagcactctctcccaggacttcagcgaagtagaaatccttcatcctctcttcctcatcacttagtctctttcttttctctctatgactcttccatcagaacaaagtccttgctccttacccccttagctttgtctctctctctctctggatgaagtgcagagtgtcgtgaagcagttgtgtgcactcattgttccagtacctcaattttctttcaaccccaaacctagtggcttgcctattattttacccaaactgccctcaaaaattcaaccagtggcatccttttgctgaattcaataaagtatgtttagtcctcatgtcacatgaacctttatgcattgaagattgtttcccttgcccccccactttttgtggttatttttttatccttgttaatttcctttttttaatatatacactttgagttttagggtacatgtgcacaaagtgcaggttagttacatatgtatacatgtgccatgttggtgtgctgcacccattaacacatcatttagcatgaggtatatctcctaatgttatccctcccccctccccacaccccacaacagtccccggagtgtgatattccccttcctgtgtccatgtgttattattcaattcccacctatgagtgaaaatatgcagtgtttggatttttgtccttggcaatagtttgctgagaatgatggtttccagcttcatccatgtccctacaaaggacatgaactcatcattttttatgactgcatagtattctatggtgtatacatgccaacttttctcgccccctttttaagctccttctttcactggctttcatgatcccaccaattcctgcttttccttttttgtttttttcctggctgcatcttcttcgtcaatttcttaaattcttcccttgtcaacctctattttttttcttttttgatatttgagtatttcatccatggcgcttctcactcccctatacattctccagggttgaggtagtctacccccataggttcagaacctatgacctgtatcttcagttggcattcaatagcctatccaactccatgtgggagtttcataataatctatgggattacctgacttctcaatgtctcctgctctccctctcctcactaagagtcccattgtgtggcatcggcaatcacccatatgactaacaagaaccttaagacttcttcttcttcaaagacaggtctattgagatgaacgtacttttaagtcaccctcccctttaacttgtgtgattaaatgtttcccaagataattacagagtgaagccaccatcactaaaattagatttcagaatatttctcacaccccatagagaaaatttatactcatttgctatcactcttcattctccctctgccttgtacacaggctgagtaaaccactagtctaagttttttccctatagatttaatctctctctggacgcttgatctgtcactaaggtctaacctgtaatacctcctcagcagggcttaatgtgtatacttccttacatcagattccctctctctttatatcttttacttgtgaaactgctattttctcccaactgggaacaccatatatgtttgtttactctaatctatttttgccagcattgttctataacagtaaacatacttatatggtttggatatttgttgcctccaaatctcaggttgaaatgtaatccctagttttggaggtggggccttgtgggaggtgctggggttgtgggagctgatccctcatagatggcttcctgctatccttgcaacagtgagagagttcttgcaacatctggttgtttaaaagtatgtggctcctctcctctctctctcgttctcactcttgctatgtgatgcactgtctgcccctttcacttccaacatgattgaatgcttgatgaggcctcaccagttgaggcctcatctacaggtcagccaattaaacctctttcatttataagttacctagccttgggtatttctacatggaaattcaaaaacagcctaatacagaaaaatggtaccaggagtgggatgttgctataaagatacttgaaaatatggaagtggctttggaactaggtaatgggtagagattggaagagtttggaggactcaaaagacgacaggaagatgagggaaagtttggagatccttagaaactggttaagtggttataaccaaaatgctgatagaaatgtggacagtgatgggcaggctgatgaggtcttagatgaaaatgaggaacttactgggaactggagtgaaggtcacctatgttaggccctagcaaagaacttggttgcattgttttcaggccctaggaatctgtggaaggttgagcttaagaatgatgagagggtacatggcagaaggaatttctaagcagcaatgcattcatgatgtggcctggctgcttataacagtctacactcagatgcaggcacattaaatgacttaaagttggtacttatatttaaaagggaagcagagcataaacatttggaaaatttgcagcctacccatgtggtagaaaagaaaagcatgtttttagtggaagaatccaagtgggctatggagcaaacactttctagagagatttgcatgactaaaagggacccaggtgctgctagccaagacaatgggataaagccctggaatgcatttcagagatctatgaggcagcccttcccatgacaggcccagaggtctacaaagaaagaacaattttatgggtgagactcagggctctgaagccaggaatgcaaggtggctgttccctgcatccccactgctccagctctatccatggctcaaagtgccacaggtacagctcatattgctgcttcagagggtgcaatccataagcttggcagcttcaacacagtgtgatattaagcctgctagtgcacagaatgcaagaataaaggaggcttggcagcttccacatagatttcagaagatgtatcagaaagcctgagtgctcaggcagaaggctgccacaaaggtagagtcccacacagatatttgaatagggcagtgccaaagggaaatgtggcattggaaccccatggaatgtccccactggaacactacccagtggagctgtgggaagaagaccactgccttccaaactgaggaatggtagatctaacagcatcatgcaatctcgtcatggaaaagtcataggcactcaactccagcacatgaaagcagccacactgcaccccacaaagccacagtggacctgaccaaagccttgggagcccactccttgcagtagtgtgacctggatgcaggacatacagtcaaaggagataattttggggatttaagatttaatgacagctctgctgggtttcagaattatgtggggcttattacccctttcttttggccattttttttcctttggtatgagaatatttacctaattcctggaacacaattgtatcttggaagtatgcaacttggtttttattttacagtctcacagggggaacgaactcatctccagaagagacattggacatgagacatagaacttttgagttaatgcagaagtgagttaagattttgggggctattggcaggagatgattctattttgcaatgtgagaagggcatgagatttggggatgcaggagtggaaagatatgatttgggtatttgctctctataagtcttatgttgaaatataatccccagtgttggagacagggcttggtaggaggtgttgggttgccgaggcagatccctcataaatggcttcctgctgtcctcatagtagtgattgaattctcaaaggatttggttgtttagaagcgtgtgccactccggatcgagccaagatggccgaataggaacagctccggtctacagctcccactgtgagcgacgcagaagacgggtgatttctgtatttccatctgaggtaccgggttcatctcactagggagtgccagacagtgggtgcaggtcagtgggtgcgcgcaccgtgcgtgagctgaagcagggcgaggcattgcctcacttgggaagcggaaggggtcagggagttccctttctgagtcaaagaaaggggtgacggacagcacctggaaaatcgggtcactcccacccgaatactgcccttttccgacgggcttaaaaaacggtgcaccacgagattctatcccacacctggctcggagggtcctacacccacagagtctcgctgattgctagcacagcagtctgagatcaaactgcaaggcagcagcgaggctgggggaggggcgcccgccattgcccaggcttgcttaggtaaacaaagcagccaggaagctcgaactgggtggagcccagcacagctcaaggaggtctgcctgcctctgtaggctccacctctgggggcagggcacagacaaacaaaaagacatcagtaacctctgcagacttaaatgtccctgtctgacaggtttgaagagagcagtggttctcccagcaagcagctggagatctgagaacgggcagactgcctcctcaagtgggtccctgacccctgacccccgagcagcctaactgggaggcaccccccagcaggggcacactgacacctcacacggcagggtactccaacagacctgcagctgacggtcctctttgttagaagaaaaactaacaaacagaaaggatatccacatcaaaaacccatctgtacataaccatcatcaaagaccaaaagtagataaaaccacaaagatggggaaaaaacagaacagaaaaactggaaactccaaaaagcagagcgcctctcctcctccaaaggaacgcagttcctcaccagcaacggaacaaagctggatggagaatgactttgacgagctgagagaagaaggcttcagacgatcaaattactctcagctacgggaggacattcaaacgaaaggcaaagaagttgaaaactttgaaaaaaatttagaagaatgtataactagaataaccaataccaagaactgcttaaaggagctgatggagctgaaaaccaaggcgcgagaactacgtgaagaatgcagaagcctctggagccaatgcaatcaactggaagatagggtatcagcgatggaagatgaaatgaatgaaatgaagcgagaagggaagtctagagaaaaaagaataaaaagaaatgagcaaagcctccaagaaataagggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaaggaagcccatcagagtaacagcggatctctcgacagaaaccctgcaagccagaagagagtgggggccaatattcaacattcttaaagacaagaattttcaacccagaatttcatatccagccaaactaagcttcataagtgaaggagaaataaaatcctttgcagacaagcaaatgctgagagatttttgtcaccaccaggcctgccttacaagagctcctgaaggaagcactaaacatggaaatgaacaaacggtaccagctgctgcaaaatcatgccaaaatgtaaagaccatcgagactaggaagaaactgcatcaactaacgagcaaaataaccagctaacatcataatgacaggatcaaattcacacataacaatattaactttaaatgtcaatggactaaatgctccaattaaaagacacagactggcaaattggataaatagtcaacacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatgctaaagggatcaattcaacaagaagagctaactatcctaaatatatatgcacccaatacaggagcaccaagattcataaagcaagtcctgagtgacctacaaagagacttagactcccacacattaataatgggagactttaacaccccactgtcaacattacacagatcaacgagacagaaagtcaacaaggatacccaggaattgaactcagctctgaaccaagtggacctaatagaaatctacagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagtgcaatcaaactagaattcaggattaagaatctcactcacaaccgctcaactacatggaaactgaacaacctgctcatgaatgactactgggtacataacgaaatgaaggcagaaataaagatgttctttgaaaccaacgagaacaaagacacaacataccagaatctctgggacgcattcaaagcagtgtgtagaggaaaatttatagcactaaatgcccacaagagaaagcaggaaagatccaaaattgacaccctaacatcacaattaaaagaattagaaaagcaagagcaaacacattcaaaagctagcagaaggcaagaaataactaaaatcagaacagaactgaaggaaatagagatacaaaaaacccttcaaaaaattaatgaatccaggagctcgttttttgaaaggatcaacaaaattgatagaccgctagcaagactaatgaaaaaaagagagaagaatcaaatagacgcagtaataaatgataaaggggatatcaccaccgatcccacagaaatacaaactaccaacagggaatactacaaacacctctacgcaaataaactagaaaatctagaagaaatggataaattcctggacacatacactctcccaagactaaaccaggaagaagttgaatctctgaatagaccaataacaggatctgaaattgtggcaataatcaatagcttaccaaccaaaaagagtccaggaccagatggattcacagccgaattccaccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatctttgatgaacattgacgcaaaaatcctcagtaacatactggcaaaacgaatgcagcagcacatcaaaaagcttatccaccatgatcaagtgggctgcatccctgggatgcaaggctggttcaatatacgcaaatcaataaatgtaatccagcatataaacagagccaaagacaaaaaccacatgattatctcaatagatgcagaaaaagcctttgacaaaattcaacaaaccttcatgctaaaaactctcaataaattaggtattgatgggacgtatttcaaaataataaaagctatctatgacaaacccacagccaatatcatactgaatgggcaaaaactggaagcattccctttgaaaacgggcacaagacagggatgccctctctcaccactcctattcaacgtagtgttggaagttctggccagggcaattaggcaggaaaaggaaataaagggtattcaattaggaaaagaggaagtcaaattgtccctgtttgcagacgacatgattgtatatccagaaaaccccaatgtctcagcccaaaatctccttaagctgataaacaacttcggcaaagtctcaggatgcaaaatcaatgttcaaaaatcacaagcattcttatacaccaacaacagacaaacagagagccaaatcacgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccacgctcatgggtaggaagaatcaatatcgtgaaaatggccatactgcccaaggtaatttacagattcaatgccatccccatcaagctaccaatgactttcttcacagaattggaaaaaactactttaaaggtcatatggaaccaaaaaagagcccgcatcgccaaggcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgtcacatatctgcaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaataacctagaagaaaacctaggcattaccattcaggacataggcatgggcaaggacttcatgtctaaaacacaaaaagcaatagcaacaaaagaaaaaattgacaaatgggatctaattaagagcttctgcacagcaaaagaaactaccatcagagtgaacaggcaacctacacaatgggagaaaattctcgcaacctactcatctgaccaagggcaatatccagaatctacaatgaactcaaacaaatttacaagaaaaaaacaaacaaccccatcaaaaagtgggcgaaggacatgaacagacacttctcaaaagaagacgtttatacagccaaaaaacacatgaaaaaatgctcatcatccctggccatcagagaaatgcaaatcaaaaccacaatgagataccatctcacaccagttagaatggcaatcattaaaaagtcaggaaacaacaggtgctggagaggatgtggagaaataggaacactttgacactgttggtgggactgtaaactagttcaaccattgtggaagtcagtgtggcgattcctcagggatgtagaactggaaataccatttgacccagccatcccattactgggtatatacccaaaggattataaatcatgctgctataaagacacatgcacacatatgtttattgccgcgttattcacgatagcaaagacttggaaccaacccaaatgtccaacaatgatagactggattaagaaaatgtggcacgtatacaccatggaatactatgcagccataaaaaaatgatgagttcacgtcctttgtagggacatggatgaaattggaaatcatcattctcagtaaactatcgcaagaacaaaaaaccaaacaccgcatattctcactcataggtgggaactgaacaaggagatcacatggacacaggaaggggaatatcacactcaggggactgttgtggggtggggggaggggggagggatagcattaggagatatacctaatgctagatgacatgttagtgggtgcagcgtaccagcatggcacatgtatacatatgtaactaacctgcacaatgggcacatgtacccaaaaacttaaagtatataaaaaaaaaaaaagtgtgtgccactccacccttgctctcttggccctgctctcgccatgtaatttgctggctccctcatcatcttttaccatgagtaaaagctctctgaggcctcgctggaacttgagcagatgctcgtgccatgctttctgtacagcctgcagaatcatgagccaattaaaactctcttctttataaattacccagtctctgacatatttctttatggcaatgctaatacagcctaacacacctactcacaatgtttgaaatgttcctcattcactctggaataaagacaaatacatttatgtaacatacagtgctcttcgtatgggcatacgttcctggtaatttatcactacatccctgataataccaaattgcaacttcctgtaatcatttgcagtgtccccaacacagcataattatttctgcgtaaaaacgttcacatccctgcttctcctgctagagaaaccttcctctgactctacatagtgaatctctgttcatccctcaaacttcagctctgatatcctcagtttcaagaatgtaaacctgtgctgccaaaaattcacgttctcactactattgtaatacatattctaggtgcttatttatctatgtctccttttcctctaaaagctccttttgttctaaagctccagaatcttatcttatttttaggggccagaaatgtttcttgaatttagtacgtatttagtgaatgttcgttgaacaaatacataaatggaagttgataatagattctgacatttatctcagagacctgctctaatctatttcattacttctgtagacagtaatatatctctgcggctatacattcagaaagtcacagcaacaaaggtacagtatgcacataatcgtgaacttacatccatatcaaacaaaaatgtgaagcttgacatttcaggctttatgggttcaatagttccttctgaaggcagcttgactctattactacgctgtaaacatccagaaacatgtgaagaaagcgaccagagttcttggaagtgctcgtagacaactaagcaatcctttatgtatgtttgtatgatgtgtctgcgatttagtgtcaagtgaggggtatggagaaaatgacataggtggatgttacgaagaaaaatgcaaacactatttaggattgtcaactgaagttctttgaacagaggctgtggataattaaaatttgtctaaaatatatatgcatttaaaactttgtggtattttctaccacataacaacacagtgatctcaaaaaataggttaatttgctttaaatatggcatacgttaaagaatgtacaaaggatgtacattttgaacaaaatgtctaagatataaagctctaaataactttttgctcaaaatttattaaagaattatgtattgatttcataatatgtgtgagaaacaatggttagttctcaagaagcagaggaagagagacagagggagaacctgaagaactttccacttattatacttacatttcaaaacggggatgcaacaaatataaataaatatatagaatattatgcattaactagtattgaacatgaaaataaagtaggattttggagttactgaacaggagggattgcgttttaatacaggatgctcagggaaatgctactgggaatggcgtcttctgatccaagaaggaaggaaggagtgagtcagctctaagggtctggggacaaggaggcatcagggagtgaacgggagctgaggtgggagtggtttattgttccttgaacctcaacgaggcctggggggcttgaatacagaaagtgaggtagagaggagtgaacgagatgagctcacagaggtactgggagcctgtaagtgagagtatcaatgtccatcatcagaaccttatgaatgagatggaaaattattagagggctttgcacagatggagaattaacttgatttggctagcagtagttctttcaaagaatcactgtagctgtgaagtagatgatgaactctgtgttgggtagaggcatgtgtgactacattaaaagtaaaaagaatggttaaaagtctgcagtgataagcagtgaaatatcatcgtggtttggacgaagaagagtagtggaggtggtaagaagagactagatcgtggatatattttgatgttagaaccattaaaataagataaaaaattggaatacggttttagagaaaaacagaaaccaaggaggacaccaagtttcttgaattaacacctgcaagtgccatttactgagataagcaaggccatgggaggaactgttcaaggacgtctgggccggaaataaaaacacagtagcgacaacttggaaaaggttcttggaatcatgaaatccggtgacagcctaaagggatttggggtagctagaaagttgaagacctcccaagtgtgactccaagtcttaagatgttcagaagtcaggaacatgaggaaggactggtagagccgtgggagacacagcaccaagagaggctggagggaaactaagagagataatggccacaaagccaagtcagggtgcccaagagggaaccagcaaatacccccgtagatcaaggggaacacactctgacagcgacccttgggcttgacaatgtgaggtccctggtgattctggtgaacactgttatagtagccggaaagctcagtggctaggatcatgaaaaatgaaataataaattactgagtttacattaataattagaaatatgaattgacaaggtgcttcatttctcttcacctcagtttttactattcatctccaaaatgaggaaaaataatcatgtgttttgagaattatctgagaatacatatacaaatttttagaacggcgcatggtatataaaaagctctcaataaatggcagttattgtcatattatcataaaatcatagaagtccttggccaacattattatgaatgcaagccttaagtaaagagaatgcctttggccctccccatgagactcaatagaccagagcatgaatccagattctagaacattcatttttaaattttatacatattctagtaacatttagttcagtgttgaatattttaatgaaaagggtaactcattcctattggtatcccatattctcattcctgcatttttttagcaacaattttgcacaatctcttcatattctcacaaaaacaacactcccacctctccatatccacccaggggacacagcaagaatgtctaatttgaatctaaatgtgtgcatatcttagatttaattaatcaacaataaaagacttatcctttgaaaaatgtatacaatgtaacttgtgcttttgataaatgtgttgatttgtatattttctttacttggagtacatttgaatagaacatgaaaatcctttaggaaaaagaaatgaaattttttatactttttcttgattttattctgccttcacaaaattgtataaattaaattaaaagcaaaaaggaagtgaaatgttatttttcttcataaataaatcctaaaataaatgtcaagacatgattgaaaaatgattcatattttattcagtacatgtctatatatggcaatatgctttacattaatagcatgtttatttcatggaccactttttgccatgttacaagtaaaaaagtgtaattatataactcagtctataaaattatagttgaaaactttgtctgggtattttttattaaattgatcacttctgtggattttcccgacacctcaaataataatgaagtacaaccaaaacagactgaatttcaagttgctagtaaagtgtccaaaataacatacttagcattttgagaaatacatacctacacacacaaagacacacacacacaaatttagaactaaaaaaggatgatgccaaattgacgacatataattagaatgaaaacaaaaaacaagtaattacgtaaaaatgtatttgtctttcaatggtttaaaaaatatcacttccttactttactatatccacaaatttgcctttaattatctacttcaatagacaaaaatcattgctcagaaaccctataacattgtttgatttctatttagtttttgcatatgtgatttttttatgggcagagtgatcatcataattatgttttgccagagttcataatgatctttattttatatcattattatagttactagctttattaattttaaaattgtattcaatgaatacacacaagcagatattaatagttctactaacctggtttaaataaaggtctctgcagaaactacctttgaattttaaaaaattcgaagtatattttccatatgagtcataacaatttgattattttcatacgttagctaaagcagataatttttgtattctctgtaatcttttcattgtatataacatttaaagtaattggcctaatatcactgaaatattggattctactacacacacacacacacacacaaacacacacacacacacttgatataactgttctacaacactggtattctgaaagacatatttaaatattataatattattatataatttgaaaatttagtctgattttttaaattttaaaattttatttttgtgtttgctttattttttaaatttttatttcaataggttttggggtacacgtggttttctgttacctggatgaattatgtaatagtgataaaattcaaagttttataacattttacacaactaatcttattcttgttttactttaatgacatgttctaatatcattctcatgcataatgataagtcctttatttaaaaaattaaatacttgtaccaacataaaacttctatgttattcatcctaagaaaatactacatactgcttctgttttgaataaagagaaaatctcattaagaatctcgtaacttactgcaagacgaaatcagcaactgacttgtcattttctttctgcctataactgatgactttgagtaatatatacacagcttcaataggttgtcattttctttctgcctataactgatgactttgagtaatatatacacagcttcagtaggtttcctcgtactttaaacatgatgcaacaatatattagaaaatcacttggagaagaatgtcgctcatcaccccaacatggaatgcaatgattccaatttccactgttgcatacgccttttcagtttccatttttacgaagatctaagtacaatgcacttcaattttgcatttttatttttataatcattgggaggggtacttccatcaatcagatttgttctaatgcaaaatgtatctaaatttacttaatataagagagaaaagctcaaccctagccccaaacaaaacctcaatctatgcattgcccagttttttaaaaggtcctcctttaaaaattaatcttctttcttatgcattttgggacctattttttccatttaattttaaccaaatttaatcataggtttgaaagaaaaatcactgaggagctttcatcttcctgtgtagataacttgaaaattttttaaaaatatatttacacaggaagtccttgagatgtaacttaatagcaacatctaaatttaaaaggctggtattatgtcatattaagtctctcagtttttgacaccttaatggttctgtgcctatgtgaaccatcaataacagtaatccaactgcactactaattcaaagtgactagaattatgtcatcctatgctgcaaagtttatgacatctgtttaagaggtggatgaccaccatttcatttaaaatgaaaagctttctataaaaacttaatgtaccaggctctcttgaaattcacattaaatctcttcactttcttggttcttagtactcttgcaaatattttattatctagtgatctattgacttctccagagatttctttacaaactgacaaccaaaaataacaactactgtctttgaagagtaacctcctgtggttaacatctctctaattgtttctctaagataatcttgataaaagaagtttgttctattctcttttgtttttttctttaaaaagtgcattttagcatctactttatgctaggtacttttaatccccacaacataagtgttattggcttttttaacaactaaataaatagaaacccagagaagctcagctctttccccaatgacacacaacttataagtagctgagtcataacctcaaatgagattcatatgctggttctaatgctctcttctctttaccagatttacaatgaaataaataaaaaataagatactaatttaacacaaacaataattttcaacctcgatcgttcaaactcattttttaaaattattataaacacaaggtaatggacgaaaagcaaaaatattccaatgatacaggatccttaccttttcatgatttttaaaaattataactttaccattaatataaaacttttacattttgtgacctccttaattataatttatttgccattattttaatggcaaaaaccacaattacttttgcaccaacctatatggaacaatcttaaatactagagacattgtatttcctcagcatattactactcaattctcggcaggctttgattgcgtttttgttttttgctcaaattaagccatacagaaagtaatattttgcttagaatttaagaaaataaagtgacccttgtgatatgaacttcatgaactacacacatattatttatatttacaatttatttaaccactgtgacagcaaaaaactaaaaaatggtgcatcgttccaatcatttgccaagctaagaaagctggagtgtttgggggttgttaaatatgcaaattgataaacactccctactcatcaatgtgcttctggaaaattaattgccccactgtttatatcttgtcattgaagagcattcgattaatttctttcctctttaaatagttggccaacacttaattatttgaaaggtattactaagatgcagaacttaaatacacccctgtaaataaagacattccaataaagtataattatttataggcagcaattatctgaggccaacactcttcctatcccagccaacctcggatataattttttttacctttgagtaagcaaattgcaagggatagtcccagagcagccataatttcgcttttttcatcagcgctgtatttttgtatcaccttgcacttaactttattatgtcgcaatgccagattggaaatagaatgatggtgctgagaaaagttatatgtttagaatcccttgatttgtgtgtgtgtaaattgtcaaacaaaatgccgtattagtattcaatgcagttaggtttttagtagcttaaagataagagtgttttgatccctctaataaatacattcattttactacatgtggcaacatttaacagagtgtaaattctcaatattttatatcattacagtattacacattaaatatgttgccacaagacacggagttgaattttcgagctaagaccctactgtctacgtgtgtgtgtttctacaagtgccttagatatttacacgtttgtacatcctttaaattcagttcacaaaactgctaaatgcggaaatggctcttgaaaaatcactgctttccctggatctctactttgtctcttatttactggaaaaagcaatttaaaacgacctctcaccaaactgctgtagttgccttacctgcaaaattgagaaataatgggttgatgggagaattaaataaatttacatatgcaaactgtttagaaaaatgcctgagcctactctgtatgttattttattagtcgtattattttctttcctttaagacagagtttcacactttcacccaggctggagagcagtggcgcgatctcggctcagtgaaacctccatcccctgggttcgagcgattcgcctgcttcagcctccccagtaaactgagatgacaggtgcacaccactacacccgactaatttttgtacttttagtagagaccggggttttgccacattgatcaggctggtctcaaactcctgacctcaggtgatccgcctgcctcggtctcccaaagtgctaaaatgacagtcgtattattttcatattagtgttagtgggatcattattgttaccgttattattaaaaaaccaatcattttcattcgtctaaattgaggcataatgaacaagtgttcaatcatctacttaattctgaaggtaattgaaaattattacctaagaataaaaacacaactaacagtatggtgtcttggtcgaaagtatttgatgcggtaccagttagaactagatttgacactggtgactgtcaaatattggctgtgtaagcttgtaaaaattgtaaaaaaaaagcttgtaaaaatatcatgtgctgtatcagctcctctacaaaatagaaattgataaccaatttcagatgatttttgagaggattgaatgaagtaatatttgcacgttttctaacagggcaatcactcatatgtgtgtagttataggtatagattatacctatatacacacagagacatacaaatagaatagatgatataaagataatatatatacattttatattttgttatatattactacataccatttccaaacattatcatcagtttccagttgaattttaaaagagaaacaatttctcattgtattatttttaaataaatttataaatgtcatcaaatttgtgacacaaaataaatctatctagtaataaatatggcaataataattttgtacacctgctataatttagaactgtattttcccatagaaaagcatctgtgtggctatgaacgtatatattatcatttaacatagtgctaattccatcctgttttatcatttgatggaaacagtggaggagttgtgtctgtagggaaactggatctctttcctttatgttaatgctctctgtattttaatcactcgaatttcataactttgagttacttgactttcacttaccaaatatttggtaatcactaaattttaatgaaagcatatatctgcaaccagactatataatgcagtcaaaagtttaaactcaaggtagttgatatctaggatagtgtatctatttatatttttttactgcatggctgttatgaaaagcctattttgtgttaaatgttgtagtttagttaatgatcacattctttaaaaagtatgaatttcttcttatattctctgctaatacagatttttaaaaaacattagggcaccattttctctgattattaatcttgaaaataccttcccaattcatgaagtaataaaacgttccatggaatagagcaaaaccaaaagcaaacacattctacttacacatctgtttctttattgtctgcctgatgttaattatggctggtctttaatttatcatatattctctctctcttttttatattctcttttttcaatgaaaagaagttaatgttagatttaagaattttagagtataaaagtggtctcttatattgtcctaatctacaataatcttataattggttaaggtgacatttaagaattgaaaataatgcataacacatgtccgtttttatggacaaccgtaaagtatgtattcctgtgtaccagaaccgcagacttcaagacttttgtgaataaaagtgatattcaatattgcacactcttgatttatttatattcagttaatctaattacatatacttataaaatgtttaaacatcatggaaatttataaagtaaataatgaaaaaataactgttaattccctggtccttcttcatcccacaactcaaaagtaaaaactggaaacatctaggtttccctctataactttttatatatgggtaaaaattggaacagaaagacccacatcacttttgaaaactaggcaacaatcatatttttatgcactgctatttatttcacctaacaagagttcagaaacccttcaacagagctagacctcaattttcttaaaggatgcatagtattccataacttgaatgcactgaaatgtatagagccagtctttcttttgatagacatgtttgggttttcactgtcacatgcaacttggccaaggagtctgcatacattcctcttctcgtgtgtcagtctcagccaggcttctctagaatcagagcaggaggcaagctttcagtgtggatactttattaggaggtaaaatcccagcgcaccacgagtgagggaatggagaaacagagtacagaagtagggagagcaaagggaagatgtcacgggacaaagccagcctttgccttccagacattcatttaactatgtgagcctgctccattcaggctgagcagaaccctggtcctcggaaaatgccaccgaggaagaaagagcgaggagtgcatttgctggctcccctctgcttcagatgaatccaagtttgtcccacagttcctgattgtgtcacctggccctttgggcttcaaccatggagccaggtatcacacactgcagggatggagcctcattcaaatccccagtgctgagaagagtcagggactcaggggatgccacagggtctggtctgggtgtcagagctgtgctcaccctggggagctgggagagtcagcagtgctgggaggtgaggcagttgcaacagctctggcctgggccatgggaggaggcagtagctggggctgggagataggtgcagccgtgatgagaatctagggaaggcaaataagtagcatgggattcatcatgtatgagtatttccataggattttgttctaagaaaggaagtgggtggtccagagctagcatgtggctattgtgacagcccattttcttaggaaattttaaatttccactgcaatgcacttcttgccttctttcacggatttagattttctgatgcttccagctatgcatattgatataaatggcatttccaaagcccaacaggtattttcaacctgaatacatttatctaacaccatgagttccagtacagtggcaattcccgctgagccacataaagaaagatgcgtgtgaatataatcaagttgacccaacgcccgtgtatctgtaaatgaatggtctcaccaagcacccaacatattagtgttttgtttttatgttttgcttttattatttttgataaggcaaagatcaaatggttttcatgaaacagttggaaagccatagcagtaacccagatagcaaacaactcttctttaggaactatatcataaaattaaatattaatgaatctagcaaaaatcccaagtagcagctcaatgcataatttcagagttcatattattgtatgggagcttatttttccctcttttgaaactgtacatttagattgtacacttttgaaaaacctttccagtaacatcagaggacaggcaggttctgtgcttgccagcaggtctccagttggtcattgcttgatggatgacacctgtctttccttgcaattctgtactctgtctctggttttcatttacccactatctctatggtctggaccaagcataggtgacagcagcacggccccagcattttgcagaaacacatcgtgctgatcatttgcaaaatcctcatggctcctgcagacaatattaataaataacttgcaaattccctagtatgtgtcaggctctgttgtcactgctttaaatatattaactcattttatcctcacaacaatgtattgaatatgtagcaaatgaatgcaaactaaggcactctgtgttagcctgtgtgactcaagtaaggcatagaggccttggagttgggacgacaatatttacttcctttttctctgtgtgtgtttttgcaatactgcctgatatggttaggctttgtgtccccacccaaatctcatcttgaattataatccccatcatctccacatgtcaaggaagagaacaggtggaggtaattgaatcatgggagtggtttccctgatgctgctctcatgatagcaggtgagttcctatgaagtctgacggttttataagaggattcctcccatcactcagcactccttcctgccgccttctgaagaaggcacctggttccctttcaccttccaccatcattgtaagtttcctgaggcttccccaaccctgcagaactgtgagtcaattaaaacactttcctttataaattacccagtctcaggcagttctttacagtggtatgaaaacagtctaatacactgcctcagaaattgcgagagtagaattcacaatacaacttgcaaggaacacagagacagaaagagacagagaagagcctgtggattaaaagataattaaaagatatcttgcacatttataattcatagttcactttttgtgatcaaaccttctgtgttactgtttttgccctttatgaaacaagttgaaatttgaacacttgctggatattggctcatactggagtagtactggcgaatactttgtgcgatgtctgaattttttgacatatgttttattttatttccatctctattgaagtatgactggcaaacaaaaattgtatatatttaaggtgtacagtgtgtgatgctttgatatatgcaagcattgtgaaatggttaccacaaatcgtatatatttaaggtgtacaatatgatgttttcgtatatgtatacattgtaacatggttaccaaaatgaaggtatataacatgtcatctgattctataaaatgacatgttggtcctgattcatttcaaaatgataggaggtggcaacaatgagtaatctgtatttaattattggggtttggtggtgggaattttgcagaggtttgaaattcactcagatcaaaatctcttaaaaactatctaaaaaatgccttttaaaattcacattcgtagacccattccaaacagtgagatatgtgtgtttggtttgtatgaacatgacacgcagatcagcgatagaggagagactcccggacactcagcaggaaatcaactaagactctagaatctaactcagagaatattcccttcttgagaaaaaattccagaaattttacttcttaaaactgaccttagtggaactggaaatgcttcaacttgtgtgtagtatcttaacagcatctaagaacatatgatacttcaaagttgctgacaagaaacaattcaacttttttcaaggctagaaatctaattaagcaatcgatcaatgttcattcctccattcaactttccatctatccattcagtaaacacttattgatgatacagtagagaactaatcaaactaaaccaatatttggcttcaaggagctcaaagccttgaaaaatatgtagcacctattttatagaaagtagcactgtgtttgaagctggaatcaacataaaggccatttcttataagttgttttatattttactctatataaaggtgattagatgaatactttttgaagcactacggcttttagacaaggcaattagaaagaagaaaggaaagaaggaagtatggaaggggaaaaaaagcaaggaactatttcaagctataaatatgcaatctcattcggagtaaataaccactatatgtgttgtaatcgcatgattagtctatcatctatctatctgtgtgtcatctacctttaccttaaaactttaacataggcaagcaccgcatcaggccttggtctgtagtattccacacctcagctactgatagataactttatctttttcaaaatagctttatacttgcatcataatgaatgaacaatgaacatgtgtgattaataagatcaagaaagccactgtataattggccgtggttttcatcaaattacgtgggatactgcctaaaatcgcattctaaaatctaaatttctatttatcaattagtttattttaatttgcagtacttattaatacataaatgaaaagaaagggatggtggaggagatctttcaatccgattgtatttttttttttttttttctgagacggagtcttgctctgtcacccaggctggcatgcagtgttccattctcgactcactgcaatctctgcctcccaggttcaagcagttctcctgcctcagcctcctgagcagctgggattacgggtgcctgccacctctcccggctaatttttgtattttttagtaaagatggggtttcactatgttggccaggctggtctcgaactcctgacctcaggtgatctacccaccttggcctcccagagtcctgggatcagttggcatcttatgtagaatagctaacagtgaatttacttatttttgaattatatctgaattcttaacaccttaagttatatagatggatatttcatatagacagaaagaaatagagatagactttttgtgtgtgtatatatatatatttacacacacacttaattctggtttatatatatataatattaaatatagtatagtgtatatatagtatagagtatagtgtatatatagtatatactatattagatatttccacaagctttatttttcatttcatttttatcttttgcttttttctcctttatttccttctttcccttcccttcccttcttttcttccttttctcccttcctcttctctctccctctctgtctttctttctttcttcctttctttttttgtaagaaaatctttcctggtatttggaattcagagtaaatacagaagccctccttccctcatggtaaggtagtatgtgctctgcctacaaatcttgaaagattcgtgtctctttctctgtacagtagtactttaaaagctgagaaggaaaataagcatgagaattatatatgaacaagcgctatacccaagtcctctggtaatatacaagctcactgattctcagttcgaaaatatgatatgaccttgtaataacatgcgacggttattgaatattttggaactgaaaagtgacttgttttcttctatcaagcctttatttctccagaataaattgttaaacaggggagggagttctatcctaaatatgaattaaagctaaaagccattttacatgtttggatgcaaagcgtctcacttgagcaactccatgagatgaagctttggcatttgtctagcgccatctactgtccaactcaagcagaagcatagatcttgtcaccatgattcgaagctggttttgccctctaagcgtagcttgagttgtttgcaataggatatgattggaaaaagaagagaaattacaacaaatctgagaaaagtaatcagttataaacctaagtagagctgagaaaccaagataaatactaacaaatatgtatataggtatgctcaaacaagcaaccttaaattcagaggatagggaactctaagatataatggtttgtatataaaaatgaacacacagagacagacacacacacacacacacaaacactagtataatctgaaataatttatgaaagccatttagtgaatatttaattactcaaaagagtctttaatagcaacaatttaaagaattttcttcattaataagagatgctatttttcacattttcttatgaacacgatttttatttttatagtaaagagtaaaaagttagaattttagtaaggggaaaaaacctatcaattcaattcttcagaaaactagcagatagcctaatgagtataacaaaaaagtacagtaagttcagcttggtttgaacaatggtaaaattaaggaatacaaatgactgcttagtctatttccctgctgggtaataacataaatttacctaaatatgtaggccacttttggagctcagtctttcagtaatctgctactgtggtataatattaccctccatgacaattcatatgctgcaatcattgcttctttaaaggagagtggtattcatgggcaacagaattaacttaaaatctacaggtaacaaacaattgtgaaaaaatgcatacctctctgaaatacagagcaaaccgttaaaggagtacaagtggcctgtttttgtaaagatctttacttcatacatactaagaacaattttaaaaattgtacacttagttattggaattagattgcttttaacaagactatgtgtaaacatttaagcaaatcagcacatttcaatgctttctcaattttcaccgtacaaggatgcttattcataatatagcctttttttgtaaacttagcacatcagttcacaataggttatttaggaaaagcacaatgcaatgtgttgtgttttaagtgccgttaggtgcatatagtctccttctgtgctaatttctaagacaatatcatgacctctttcttgtgtgctgagtgtaccagtttacatctggagtcatttctcagttttttgggggtgttttatttttccttctcagatctaaattagttcaagtaatagaagttaagatcaagaagattttcacaacattgtaggtaagaatgagcaaaaaggcaaagaacacattgattcaaggagattagctttctcctaatccatgcacacaaaaattattacacattatgtaattttatgacaattaaaaatatatacaataagtataatacaaagataaaagagtttctcagaaagaaaaataaaaggcatcctccttatgtggagattaattttaacagttatttctttcaaatacactacttattgaattccatttataaagatttaagtttttctttttatcatgctctttttcatgacacattttacacttgaagatgtgtcttttgacaatggcccctgaatgagtatgcaatgtagctgaataaaacaggagcataaatctaaacagatgtacataagaagatcccaatttgtagccagtattttgactattacaggaaatataagattggctgcatttaaaaattttacattaatcagggttaagataaattatgttattttacatttctgtttatcataaagaactacagaaaaaaggagtaataattccattgtaaagaaatatcaattatgtatttctgtcccttataaacaccagatgttataaagtcatatttgctatttcaaagtagctcctaaaatctcttcccgatcccctaaacttcctcctagttcttcttcatatcaatgcattgcactaagttcagccagttacccatgccatttactcataaccatttctcccatctcactttcctaatttcctaatcctatatttccaagtcctgccaaatatagccaataaacacaaattgaaactatctcccctattccatctggaattatttccatattatctttaaagaggaagacagactatgtgtttgcactttcaaaggatgtattcatgcctgtaaaaagtacagtcctagagatttggtgactcaaatcttttcactaacaggcccgtcttctttgccttcaagtgaaaatatttaaacaacaaattgctctacccagtgtagcatcaaggaacatcattgagaaggaaatttccatcatgtacaatgggaaagggacctacccaaacagagacacactataatccaaacacatatgtatgtgcacacccatgaccctgttcagaaataggacctgtcagcatcccatcaccacataaaacctatttgatctgagcttaagaatctctgtaaaatgatgccattgtctgagtatgtgaccagtaaccctcagcgtgttctgttttggctttcctcagaagtggagtctaagaaaattattttagaatgagcagtttgttttggaggtggttcttaaaatcactcacaagaaaagataaggtgagaaaagaaaagaaagggtcagggaaggaaaggaaaaaagtaaattaatggtgctttcttgaccaacttaacacaacgcgaggcaattagaactcatctttctgcagaactcgggaaaatgtacacataagttgtgtcatttgatggaagcctaaactataccattaaatatagctttcattttgtagaaagtattagtaatatatgattaaaaatgtccttgtgggttttttggaggaaggtaggtagaggtaagacagcatagaatcatgatgatgatgatgatgatgatttttattattattcagaatgattatttcttgtacaacccccaaaagtcaatagaatacaagacacaaaaagagagcataatttctatcaccagttagtagaggtgctggaaattatgctctctcaaaatttcaaaggaaatttcattacttgtgaaatgtgtagggtcttatattctgtattttacccatttttacagttgaaatggcacccagcagtatcttttgtgtagaaaacattcacagtaaatttgtgggttttaagattatagtttgagtttatccctcctctatgaagctgaaaaacagtacagaggagaaatttttaatatgtcaccgagacttgcaggataaggcagaacccagacacacaaaaagctgatgatgctccgagcagagagaacgacaaggtgaagaggacgacaaggtgaagaggacctgccaaggcacagtgagaagcagggagaggggtcatgggagaacaggatgggtgagggcaagggacaggatatttggggtttgagaaaagatttcaagggttaaggtagtaagacttgatattgtagacactaagtaagctttgcaaacaaacaaaaaaagatatcatttacgtattgagcaaacaaaatatggtggcagctttaaaaaatataataaaggaaggagaataggcaggcacagagagacaggccaatggctgcagcgtttcatgaacagggacaaggacatcaactcgaggaaaggttgcggaaatggaataggggagatagtttcaatttgtgtttattggctatatttagcaggacttggaaatataggattaggaagttaggaaagtgagatgggagaaatggttatgaataaatggcatgagtaactggctgaacttagtgcaatgaattgatatgaagaagaattaggaggaagtttaggggatcgggaagatattttaggagctactttgaaatagcaaatatgaatttataacatctgctgtttataagggacagaaatacataattggtatttctttacaagaaaatgaatacgatttctagggagatttttataaaacgaagaagaaaataaggagactgtagttacagaatcaacaacagttaaagagccagaataggaaagtctgagataaactggcccatagaaagcaggagaatcgggagaggtggagcactgcgaaaaaaagtgctattagaaagggattgggactttcataatgttatagaaccggaaatctcaagtgacaggggacagatgaatgcatttaaccatgtatgcatctctcaaaacatcatgttgtgtaagataaaaatatgcaatttttatttggcaaataaaatcgatcaatcaaatcagtcaggatgttcttacaagtctggattttatctcattaacttcccaaccagaattcattttgtcgttgttgttgaggttcattccctttgttgtaaaagcaatattatatctgaatcatccattggctgatttatttctggctttaaaagtatttttggctttaaaagtaatctcctacctttctgctgaacttattagttttggccgttgtaatcttattatttcggtctaagaaactctgccactttctgctggaagatattgtgatatgtttcccagacatgtggctgaatttctctttcaggagagagttaagggaagaacacactgctatcatttttcggagatacgcattcagtgacctgttccccaaaggatggagaaaaaaaatgaagttagctttggggatctcacacaccaccttgattccactgcaaactcataggctgcagctaagatagtcaaatttacttgacgtctgaacacacaaaccacttgtttgcctccaaaagagaaggcatcagagtatcgtaggactccttacagatgtatgatgactcggtgatgtctgagaagagaggaatttcctgtgctgttgtgtagcccatgaattctgtcatacagaaccactccctttaaatgtcaccttttccttcgcctcctcctctgaaatcctctttactacatagacacacttcctgtgttctcaaagcccacattgcctctattggatttgagatttactcagttcgaagcgtcccgatgaagcaatcggaagtggagacagagagacttttctgccgtgcctgttctgcccatcgcataatcataaatatcccacgtgtccatgataagatgagttggaacaatcttttgccttcaatatactcatttctttgtgcattttcttcctgcactcagaaaaagttttcacttttgttgtcattcttgtcatgaaaggtccctgatctaagctatttagtattattcatgctttatagaaagagaatttaagaaatgttacattccttatttactatctttggacttagcaaacacccagaatgggccaggaatccatgttctcactatttctgaaaccagtaatgaggcctttcctttcctttcccacctatccaaatcctcccatttttcagggctcagttcccaactcttttcctagaggactctgccagctactccagcccacattgttcttcccctattaatagtatcactggcaattataatcttgatttaatcatatttcactttgagtttctagatttagcagtttcctttgtgtgctatgtgaaaaataaattatacataggtccattctagtacttctcactgagttatcaatatgtggtctctctgtgacttcattgccagactgtgccctctacaaggatagtgacaatgcatttttttatttgaatacataataactaatatactatggttacacagtaactattttgtgagcaattaaatggatatagttgaacaaatatacctagtatacatatctatctatctatctatctatctatctatctatctatctatctatctatcttgtctccctacatgcaataaacccttgcctatagaattaggctcttccaggtcagaaactcgaagttagttttttttttttttttttatctcatttacgcctcaatatattttacaagctcaaatttattcaataaattcatgtttaattgatttcttaaatttggaaataaaaaactatgcaaagttttaaatacataaagagtctttaaggtattctgcaacctcagcccttccacttgatattttgaataaaaagcatgcagcagtggtctttttctttagagaccacactgttgacattgtacagcattttattcacaaactgcatggaataagatgatttgggcctataagtaaaagccaagattctacaattcgagcattattttgttttgttatttttcaacacttttatgaggcaggggaaaaacattgatgctggacacttttgtggggttcttcttgcagggagaatcagcttcatgcaatgaaaaggatatgacatggggctcagctatacctggaaagaaatctcagcccttccaacacttatttgcaatcctgggcaagtaatctcactgaatttctgttttcttatttagaaagtacgaataataagccctcatttaaccacagtattttgtaaaataaactagagtaggctgatgaagcacatgtagttacaagtgctggaaatcccagtctccttggcactagacggtggtgtacactgcgtggtggatttcccacacactgggaccagcatcctctacgtgccctgagggtggatgtcgccccttctcctcccacctctctaactcacgtggctgaatggcatacggcagacaaacgacctctcctgacatgtcgcctgcttggtttgcttgggcaatggggagtaccggagggaaattgaagagtattggggagcgagtttggcattgtgtggctttagcttcaaattccggagggaatttgaagagtattggggggcgagtttggcgttttgttgctttagcttcttcctgttttcaaaggaaggcttcctctcccacaggtaatggtttctgtccgtggcctctgctgaggcaaccccactttccctaagaacattcaaccccaagcatagagaaagatgcaatgaggtattcaactatccaccgggtttcccatgctctgtgtacaacgttgtagactcttcaaattattccatttgatgtgccgtttatttcctctgggaaccagactaaaacacctttataatatgttataatattataataattatcttttaaaaaaaacagaatgccttacactgaacacttcctcctttttcagtaacaaactgaggaaaactttctactttcctttgacttgaatattgggattaagactttgaaggaagaaagcaaaggaatgagagcaagtcctagatttcttcactagattaagtgaagaaaaccatcaagagggagctagcagtgttagctccaaactaaacctaaaaactgccaagacagaagagaaaattgacaattagctgagagctcctttccacaaagcaccaataacatcgttagagtgctatggattacttaagagcactagcagagaaaatctggagtcctctacaagattttatagtaaggtggaaaggaaatttaagaattcaatatcgcaatggggcatcgtcattttctcttgtgcaagaatgctgtagaatgctagcagaacatgacgtctaccagagcaacatggttgatttctaacaaggatcagataagagaatgatgaaagctaatatagatacaagataaatagagttacagataaatgtatataatacctctatttggatataattatcagatataatttacatatcataaaatttaccattttaaataatacgtttcagtggttttcagtatattgaaatgcaagatcatcaccactctctcattttgaacatttttatcatcccaaaaagaaatacccatgaccattagcagtcaatttattttctcctcatcaaccagatgttgacaaccactaccatattttccaaatctagacatttgccaattccaagcatttcgtataatagaatcacataatattttgtggctggcttctttcacttagtataatctgtcaaggttaattcatattgtagcatgtattagtactttatgctttttattgcggaataataaccaattgtatggccataccatattttgtgtatttattctttggttgatgggcatttgttattttttcacattttggttattatcaacaatgctgctatgaacattcatgtacacaaaaaatatttttttgtgagcatttattttaatttctcttagatttataactgggggtgaaatttctgggtcatatggtaactttatgtctaacattttgaggaactgccagactgttttccaaagagattgcaatatttcacatttccactagctgcctacgagccttccaatttcttccaatcctctacaatacttgctattgtctgtatttttgataatagccttcgtagtgaatgtcaaatggtgtctcactatggttggatttgcatttccctgatggcaaatgatattgaacaaatttccagaaggtgatctgtctactttactgggatcaatgtctattcacaccttttgcttcttttaaaaaatttggttgcctttttattattgagctgtaagaacttcgtgtgtgtgtgtgtgtgtacacacacacatacctatgtttatatatacatgttattttttctagttacaagtatcttaccagatagatgattcgcccaatttatctcccattctgtgggttatctttgtgttttcctgatgatttcctttgaggtacaacgtttagagttttgatgaagtccaatatctatatgtattttttgttgttgttgcttgtgcttttgcttttatctgaaaacaaaattgctttctacatgcctgtagagattcatgcctgtgttttctttgtaaggattttataattttagctctttcatttaggtcctttttgagttaatttttgtatattgagatggattgggcttcgacttcatcactttgcatttgaatatctagttgttctagcatatttgttgaaaagtctattactttatttgaattgtcttggcagtcatatcaaataacaattgcccagaaaaataagggtttatttttggactctcagtttccttccttggatcaataggtctatccttaagtcactgcaactctgtcttattgcggtagctttggaataagatttgggaagcatgagttctctaactttattcccccttttcaagactaccttgggtatttggggttctcttgaatttcaacataaattttagggtcagcttatcaatttttgcaacatagatataggtattgcattgaagcttcagcttaactgaagattgctgtagcaatatgaaatctcccaacacagaaattcagtatttcatcctatttatttaggtcttctttaattcttttaaacaatattttgttttcagagtataaatttgaacttctttgttaaaagtattattgcattcttttagaagctactgtaaatggaatggtattcttaattttatttgcagagtctcatttcaagtatatagaattacaattgatttgtctactttatctggtaacctgcaagcctgctaaattttatttttagatataatagttttttaatcgaatttcttagcattttccatgtccaagagtgtaccatcagaaatgagagatagttttccttcttttttttattattctggatgccttgtctttcattttcttgcctaatatgctttctaaaacctctagcacaatgttgaacagaagtaccaaaaaggcacatcgatgtcttgttcctgatcttagggggaaagcgtttagtcttttaacattaagtataatcttacatgtgcaattttcataaatgtcctttatcaagttgagaaacaccactgtaattcttgtttgttgattttattatgaggaggtgttggattttgtcaaatgctttttctgcattactgagatgattaggtggcttttgtcctttatcctgttgatatagtatatcacattaatagattttcaggtgttgaatcaacctttctttcttcattaaatataaaactatttttaatattagagatataataaagatatacttatgtattataatatatagtaaataaaaatgaaacaatattttcactttcctgatggtttcctttcatgtgcaaagttttgagttctgaggaaatccaatttatatatgtattatttgttgcttgtgtttttgctcttatctgaaaacaaaacaaaaaaatcaacactgctttctccatgctgacaaagatttatgcctgtgttttctttgtaaggattttatcattttagctcttacatttaggtctctgatcctttttatttacttatttacttatttatttacttatttgagacagtgtctccctctgttgtccaggctggactgcagtggtgcaatcttggatcactgcaacctccgtctcccaggttcagacgatcctcctgcctcagcctcctgagtagctgagaccacaggcacatgccacgactcccagctaatttttgtatttttagtaaagatcaggtttcaccatgttggccaggctggtctcaaactcctgacctcaagcaaaccactgcctcggcctctcaaaatgctggaatttctgatccgttttgagcttcaactttgtcactttgcatttgaatatctagttgttccagcactatatatatttttttattttatgtatattataaatgtatattccttaatacattattatgatgctggatttttcttgataatgttttgttgaggaaatttgcatctatattcataaaagatattggtctgtggatttctttatgatgtctttttagtttattggcatcaaatttctactgaccttgtaaaatgagttggaaagtgtttccttctcttttattttttgaaagtgtggatatatttacattaggtcttctttaattgtttcatataattcagcagtaaaactgtgatgcctggggtttccattgtgagtagatatttttatttccaagtaatcacagtacatatcacagattcattcagattttctatttcttcttgagtcacttttggtactcggtgtcttctttctaggacttctaaaaaaatttattttaccagatttgttggcataaatttattcttaaaatatttttatttctgtaaaattgttaaatgatctcttctgtcatttcagatttaagtaacttttctttttgctttaattggaaagtctatttaagactttttaaaaatatttagtcgatgttacataaccaacttttgatttcactcattttctgtgttttctattctgtatttcatcattttctgctcaactcttatatatttccttcctcttgcttggtttgtgttaatgttgataatccatttccaatgtgctaggtggaagtttaggatattaattggagatttttcttcttttatatataaacatttacagctataaatattcatctaagcccagttttacctgcattccataagatctgatatgttcagtcattatatgcctttaccgcaaagtattttataatttacattgtgattattttgcctcatgatttatttagttgtatgctgtttaatttccatacatgtagacttttcctagtttctactagaggcttttaactcaattacaatgtgttaaagaacatattttgtaggatttcaatccgtttaaatgtattaaggcttattttatgacgtaaatacagttatcatggacaacagttcatctgcaaatgagaaccgaggtatattagatttttttcacttggctacttttacaaacgtttttgttacgtgtagataattcatgatgctattcaattcttctagttccttgttattttttacatagttttttatttgttaacgaaagtgggatattgaagtcaccaaccattattttaatctatttctgctttttaattctattggttttgctttattttcaatatttattaattctactggttttgctttatttatatttgctttatttatttatttatttgctttatttgctttgttggtaggtgcatatatatttacatttgttatattttcctgatgagttgacaattttatcattttttttaaatgtctcacttcgtttctagtgacactttttgttttaaagtcttttttgagcagtgttcgtacagccactccagcttttgcatgactgatatttgcataatgcgttagttttcattcttttacttgaacatacacgtattttttatctaaagtgagtctcatgtagtcaatatatggttaaatctcatttttaaaatccagtctaacaatataggcttacatgcctctctctctttcccttccttttttgacccatatatgccacttctaggaatttactctgaagataaactttcaacaatgtaaaaatacatatgtacactcttaattataaaatattagaaataatctaaatgccatatataaaagagtatatgaataaattgatacattggtacatccatattgtattcatgaagtataataaaagaaagaaaaaatagaaagaaaataaagctatatttaggaatcgataaggagtaattttcaagatatgttgttaaatacacaccctctcctcacatcaagcccctggaggtaaccattatcattagttattgatttattatttttacatttccttttttaaaaaatgaggagatatatgtatattttcttatttcccattctttcattcaaaactgtcacacaacatatgatatacatatatattgttttgcacgtataggtgtgtgagcacacatacagaaggatagactgatagatgagagagagagagagagagagagaggtatgtgtgtgtttatgtgagagtctatggacccctgtaccctaactctatctgctaagaaggactacggcagtgacatcccaacaccaaaaagcaaattggtaaacagatcttcaccataaatatcatttgccaacaaaagaaaccaggggtccttgaggtaatgactcattccatggccggtgcagggaaagtgcaggccaagcctgggatatgtgttagggctaaaaagtaagaacatttccaaaaatcacaggacatatcaaaaggtcacaaaggccaacttgaagagacttccaataggcatctgggagattttcagcaacaaagagagtgaaataatagcaaagatttgtaacccatacattcacacaaattaataattaaatgagttaatgaatgaggagaagggaaaatctttacttacaatataattccaatttccaagcatcaaagaaatgatggaaatagaaaaatcaccatttggcaaacacgatggcatttattgtttcaggcaagaaggatgaatatgtggtaagcccagtgaatgaacgtttgatgagaaacggaatatgtgcaatgtccgaaagtatcactcacagtattttcattaatcacaaaaagaacaagttactttaaggtggagaatactgacagacatgccccaaccaagtgtcaaagctggtatcagtaggaatgactctgaaaacacaaaattagttctattattgccaaaaatccatagcctaaattgaatcatgaggaaacattagagaaactcaaattgaggagaattttatgaatcaagttttctacaaatgtgtcaacctcttgaaagataaggaagactgagaaaccaccaaatgcagtgagtaagcctgaatcctggctgggaaaagtagccaaaatttgaataagctttgtaggtgaggccattttttattaacattattttccttgcttatatccttgtgatatgtttatcattacaggaagttgtatgaaaggtagacaacaattcttgttatttttaaactgtctataagtgtgaaatgtcaaaaaaatagaaaaaaaaccataatgactggcttaaggttactggtagccataagagactgcaaatataaggttttatttaaagctggagagaaaaacagtaagtaaaggtaattaaaagcaaagaaaatttaccttaataggtccttggctatttttgacacattatattttatgtattcttcctagaacactaatagtgagggcctactatgttgaaacttgatgtgcaaaccacagccactagaattgctggagttactttgtatttattgatgatgaaacagagaatcaaaatgtatagcaatttgtccagttcacagagccagttttggaatgtggtcctctttacagccagaatgtatgacctttcaactacatcacaactatgaaacagaaatatatgacttcaggtatcttacctaataattaatatttcctgaggttcttgaggtgaaaggtaaaggtgctaaaactatgttcaatcagtttatacgtcagaaactagttctaagaaagaaaactattttatgatggcctctagaaaaatcccattttccccttaattttgttttaaagaaataatttctagtcattttagtcaatatctcataaacacacttgatcttggctcaggctggaagaagactgaagcagcacgatagagtggagtgaatttggtgagaaacgagaaatgcaaatgtctacgaagtaagctgaaaaggagagagaacctccaggttcctatggattagagtaggaaggcacatacaggggagatggcactcgggtcctcacagccatgggcatcctgggcaagacaggtgagagcgtgactccgacaccctcccgcaggacaggtgagaacgtgactctgacaccctcttctgcttcaggtcctcacagccatgggtatcctgggcaggacaggtgagagcgtgactctgacaccctcctctccttcaggtcctcacagtcatgggcatcctgggcaggacaggtgagagcgtgactctgacaccctcccctgcttcaggtcctcacagccatgggcatcctgggcaggacagatgagagcgtgtgactccgacaccctcccctgctttggttttgttctgcatgttattaggtcgctgcaaaagtaattgcggtgtttgcaattgaaagtcatggaagaaagcgcaatcacttttgcaccgacctaatacattccggttaaggacgcttttgtcgacattaagatgtgtgtttgctttagtcacagatcacattgagtgacaagaaacatgatttcagccaaacccctagagctcacaaggagggagtggtgcacctggggaaacgcaaaggcagagaatccaagggaaagtattggtggtgtttgatttcatagtaagaacacatgttttcaatcaagacctctccaaataaatagatatgtggaaatggttccattcattacatgcccaaattaatagttaatagaataatgggccattttccagctttggaactagcaaagccttcctgagagcagaggctgatgccacggtatgaactctgtgttttgagtcaatgagatttctgaaaatacatctggaagtgaaacatgtgacagtcacatctcactatgaagaggtaaaattctatgtgcaaataattgtacctatctctacatccttaggtaaaacaagaatactcttacaagtgaagacactaagctaacaatgtaaccttacttgaaagactgaagtttattgaagtgaattagagagcattttattcattgaataacttgacccttgatcaggttggtacattgagctttcattcctctgatacatgctactgtgtgtgaacctaatttaagtttacaatgtttttcttaatttgaaaggtctgtaattaaaagaattagacaatagtgttttatactaaaaatatttttatagggagtttgccttgaaattcctagcatcttgcaatttatttttcatctcttttaggaaatgtcttaagcacataatcggatgttttgctgaaagatgctgaatccaaatttattgaaattggaaacactatgtatttatcctaagggcttatattaatgcatacaaaaccactttaaagagttttcaaataaaatactgaattaattatttcccaaaactccctagttatttcagtcaagcaattatttagcaacccatgtagtctaacttaattaaatgcatttacattatttgtgtagactatacaccttgtattatccattgattgtaaaagttgacattcactgtattagattctattttagcaaacaaacagatggtaggttatcaacaataaaagaaaaaagaagatggcctttacagacataaattccaaaagaggtaagaccaaaatagctcttaaacactgtaatgagagcaccactaacaccaccagatgtagaaataaacattctgagtcagtagaaggtgcgggaggtaggaagaaatagaacttgctattttcttcctctctgtcacagggaaattttttttcccatttgtcacctgcaatttgaacaaagtagtttcattaaggcataattgaaacaacttttcaagattctttcaggccttaaaatacattgccaataaaatagtgctcttctaaaatggtaataccacctgggtagccaggtgtccctttattttaaaaggaagtcaatcacatactcagatggttgatacttaggtgacgaagccatctccacagcaagaaaaatggtgtgaacaagagcaagggggagttgagaatcctgagcttacagccctgcgtcctgtgtccctctactgcaaatagagattataaaaaaataggttcatgtcttttaatcacgttttactaactgaaaaatatagtaaatatttgcaaagacacctgggctaataagggtaatattacttgtactagcgttaggtattgcctaattatatttaaaaaatcatacagaaatatatacagaaaaaagtaaaagtagtctttccttagacgtgaacacttaacttttgagtgttttcttcttcagacttatgttttctatgcattcatatagtctttttgtacatttactgatatattgcttttaacacttttgctttctgatttgcatctcatttttattctttgtattatataataataatagggtataaatctaccttgtagatgggaacttctgtatgctactccatagtataaacacaccttaatttatttaacaatattcttactaagaggcattagactgttttccctttggctttataaagtattaatgaagtgaatatattttatatgccacatggtgcattaatatgagcatattgtgaaagatttccaaggaatacgcttgcacggtgtgatactgcatctgtgtttgtaatttgcatggtcaatgtcaaactgacttccaggaatgagggctgtgtcgattatcccctccagggctcgtcactggatattatctctctttctagtttttgtcagtgtgacaggtaaacataatacctttttgttgttttaatttgcttttctgtgattttcatcagctttattaactcactaaaatagttgtattggtatctgaatttcttcttttaattgcctacttaatatttttccaatgtttctaactgatgtttttcttgaactagaagctccttatatattctgtagagtaatccattattttatgttgtttagtatttttctgtcacttttttaactttgtttaccatgcttttattaatacagaattttttttcttaatgtttatattcacaaagatgtagttaaatgtttttctttatgtcttcagggtttatttgttgtctttaagagcttcccaattaatgtattataaaaatgcacattttaatttacccactttgaataataattttatgttttcctcaaacccagatgacaattcttttgtaaatgtgtgatgtatttacataaattacattttctgcaataagatatgctaatttgccaatacattttatgagaagccgaacttctttttcctaactggttcaaactgtcacctgtaccatagtctaaactcacatttacataaaagtcttcttctggactacttgctttgtttcattaatctatgtgctgctttcagagccaatgtcacattgttcagattccaatgtctttttagcatatgttgatatctggaacggtgagtagcatacagttgttcttaccccttttttccccaaaaacagaaaaaaatctatttaaccaagggggcggggcaatgtctttttcgcaaaatgttggtttaaatgttgtaaagctttttgtcttttttttaggtacagattttcaagaaggatttcaacatctgttatgtatagatacctttggattttctctttgatttattttgtttaagttgtattttcctagagaataatgaattttaactagcttaccaaaagtcttcatataggcctgcgcactgtatcccatacatttgaaaaattatctctattttaacagtgaacagtttttatgttattagctctttctatatgtcttatcagatatgcccaaacttcatccatttatttcagaatttgaagaataagctttgatcttttacctatcaagtcttttgttttgctttttcaaatttattgaatttatatacatttttcattttttatttaattttctactaattcactgcttgtagattcttaaaaacacttagataatttactttcatattctctctttcactctttctctgcccatttcaggttatgtattttgctttaagagctgcttgggaggctgaggcaggagaatcacttgaacccgggaggcagaggttgcagtgagccgagatcgcaccatcgcattccagcctggggacaacagcgagaactcatctcaaaaaagaaaaaaaaaaaaaaaagctacattggcaatattgtgaatgaaataatattctatccacccattatcatttatctgcaaatatctgcaaagggattttaatgtgtttcattcttgatttaagtcaagttatctgaaagactgtgtgtgtgtgtgtgtgtgtgtgtctgaggaggaccgagggggaccaagtgtgtttgtgtgcacatgtataaaatcttctgacttttaattttatttcctcatgaacggacaacttgatctgtgccaatttgcttttgaatttttattaaggttctctgtgtgactttatatgttattgttcatgaatccttgccaaaaatgcacattttcaaggaaggacactttgaaacataaggccaggaatcaaatggctgaggttcagggctcagcttccacttttctgatctactgccttcggcaagtaacttcacttctcttgacctgagttttttcattgataagaatatctgttttgtttctgtacattaaacatgagtaaatatgtttcactctcaggaactggttattaaagagttttcactcaaaaatacatttgatttacattcgcttctgtacaaaaaataataactatttgtagaaggttcaataataacaaaaaactaagctaaccatgtacaactaagacaacctgaatcacgttcagagatgaacaatttctgactcaggtgtgttacgattatgaaaatggtaagtccgtatgacttagttgtctttgtttctctccaatatttcagtttctggagtaatgtaagtgtaacagcatgtttagctcagtatgatgcaccaaacacatccctctttttcccatgcaaagcctgagtaaatttcattttctgtgatatcaacattgttattctgctttatcattggcatttgtctagtacatgttttctttcttaattcacagtctttttatacaaattttaaaagtcaaggagtgtttttactgataaagaaattttgctgattcaaaggtattgattatagttattcgggggcttctttttatgatatgactttcctactctgatgttgtggttggtctgatgaggctcctttttccaaattgctatccaccttcaccttccctgatttttttttttctcctcagtcttcaaacctacaaagcctctatttttctagtaattaaccaaagatattaaactttaccaaagtaaatttaaaatcaataagctgtacagctgctcctaaatcccctaaaatattgagaactttaccacgatattatttatcttcctttcacttgccttttgttacttcccctgttgtaaatacgttgaattttggttcagaattgttaccaattatttttttgacatcatccctccattttcagacctaattttcaatgtttaaattcttgccatcctcccctaaccattttctgattgagatatttgtaatgattctacaattctttgtagttcaatgtgtggtttgcactatttagaggccttcctctgtctgaaaatttttttctgccttctgaaatcaatgctacttttagtagcataaatatttttttaaacatttgaaagattgtttcctttgtctttcatattcagcatggcttttgtgaagtgtcttgtcagtctggttctttcaactttgcaggtcaccttgatccagtccgtctctatatgcttttccctagcatatcgctaattatgggtctctttacattcatgcttttcaatatttaattcacactttaatctgcatatttgagcttaacacagggagcattgcttttgcattttcaaaattatttactcgcttcgattatttactgatgttttctcaattcttttgttatggagcatctaccaggaaaatgttgaaactctcaaactgaaactctgtctctaaaatttttatcttatgttgtcactctctctgctctttgcttcatgtcttcagatacttccttcacctaaccttacacatactgatttaatatttaaccatgttcataaattatccattctgagtcccagtggaaaaacagaaaccactgcaagtatttaaatattggaaattttttccgggggaaggattgcatacgtgctggaagatccaagacttcaagcttgtgatgatggtgaggagtcctccgattctaagcaagattgaaggaataagggaaggaggtagtttcagggctccagcggggtagggcggggggaagtgcagggctatccagtgagagccggagccacggagggttgcagcagctgccgggaacactgtccaaggcaggaaaaagtaacagtatcttgggctcctttattcttcctacccgcctgtctccctgggcaaacccaaggaagggctctccatttacatttctttcatttttgtgatgtgtctcgttttttacactgacttctcttttcccatgacagttttatcaatgttttaaaactcaggagtaaaatcatgaccggcctttcctgagtgcctacaatttcaggcttgactttgggtattttatttaaatgaatttatgagcaaggcaggtgcacgttattatctcccgagtgcagaagaggaagctgtgcaatgtcaggggaggtagaataaaactcacaacacgtctgttttgtttctactgtgtcaaaatcctttcatcgtatcaaccaaaaatttaagtgttcatttaggtaagaaaaaaacggaaaaaataaaatagagttttaccaagtatgccaatatatattgtttctataggccatgggcgagtggggtaccaattcaatccattcaacaggaaaaaagttacaacaaatatgacttaccaagaaaacaagtgactcttttccacttgctgatgggaatatctttaaggagtggtttgggttgctgtagaccctggctataacctctcatatcctattcggtgacaaaattaaactatgtgctagtgtttaatagattgcaatttgttactccgttttataaattcttagtgaccaatacaattcaaaactcattatttgtcattacgttaatgtccaataatatgatattatttatacagtatcttaagccagcacaacttttttttacatattacttaaatacattctatctgcgtattgaagaataaattctactcatcaactgttactgcattatgttattttaagaattcaagttatatgccagtagatgatacagaagagacagagacttaaataagtttttgtataatgctaagaagagaaaggcaatctagattttgtagtctctacattacatcgtaaaccagagcaaggcgtggctttgttaagtggggacattagattctaaacataagtctaatttttataatatgcttagttttaaattatcccgggctactttcttttagctctgtactggaaaaacagacttcagtttataaaacaagaaaattaaagaaaatttggttttattagttggaaatatttagaaatggattattggttaaatgaagcaaacgaataagtaaataaatattgcccatatatatgtgtatatcctctgccttctgatatttgagggaggaatgcccagcgtgcattgctatattgcaaatggaatgattaaaacgcacacatgaacggagagcatcggggtgcttagatgacttgcccgttttaggccaaaaataaaatgttcattttgtatttttccaagacacctgtcatctttgacagggtccattagatttataattatttgttgcaatttctgtgtcacacctgccatttttttgcagtcaagtactagcaattcaggccacacagtgactgggtgatggtcacagaaggaccgcatgggtgtagaaagtgtaagtgagagccgaccaaaatccaaatgcttgcctgctcactcccattacagaaggacaataaaacaggtctttatgcctctgttcttttaaatccaagggtgagcatggctcacaaatcatatcctagttctttgaatggctaataacgacagtgtctggaatgaaattttttttatgaaaaatttttatgaaaattgtcaaattatacagacaggaaagactgagaaaaacgaaatggaatagattttattatatagtccttgaaaacctctctgactttcatgtaaatttagttcatcgttggaagcggggggaagtgaaatgaaaactgcataataaatatttatattttctattaatcaaaagttgtggcaggacagaaatgacagtgtggtttatttgtctaagttttaacataacagctagatacattatttatcgtttaataagattagatttagagataatgaattttattctgagattacagttataaaattatttttaatattacggtaatgatatctacttaaaaatagaaaagtgagagttttatgctaaacacaatcgactcctttggggacagcttgatcatttaaaatgtagccctatcctgtgatttaagtgtgatctgttacataaatctgaaatggtaatttggttatacacgtatcaataggcaaattgagctaaaacctttctctcaactgcatttatatgtgtgggtatatgtcctatcggaagaaacatcatttgaagcaaatacttcagagaagttttggttgaaattgtaaggtattgccatccatgcattataagcaaaacataacattattgataacataaattcttacctttaaaattgaagtggcatacactaacaaaaagtgagccactcaaaataaagatgaaatatactgaggaattatttggaaggatataaacatacttctcccaggaagtattttaggtaattgagaattaaatgtagatacgcatgtccatagtcaattaaagagaagaaatcccaatatgttagatctcattgtctcacaaaataagaagcaaatgagcgtatctatatcactctttcttgtcatggtgatctggacactgaaagtcaatattttttcttctagaagttacctgtggttacataacatatagggttttgtctgtagttttgcaaaaatataagatgaccatgtcttgaacaactctcattaaaatgtgtatagttaaaaatttctaatcatatctcactggacctttttcttgtgggaaaagaaaaagctagaatgcactataacttcatcttccaagaggatacaagcacagaatatagagggcctcacacagtgtaacaaataagcaggtcttgcagatagctttttctctggtgtcagacatacctggggacaagcctttcagctgctctgtccctagagtttacccatcaccagagtcttgttcacagtaggcctttaagaaatagttgttaaataaatgggtcttatttttagtctaagtaggatgtctgttgctttaatctattctcttctctcttcctcaaaatacgacgtttttgcatttcctcctccatctctggtagttccttctgcttccactgcagactcaccttccaccttcccatgcctggcttttgtgtcttcttcacactctagttttcttaaagacatacctcaccacattcaagtcccaaagtgacaggggtatgaagacacgggttgggtgcctctatctccaacctcccttcgagcttcacctgccagtgtcaccttctttcgcactttgaatcagtatatgcaactcatccacctcctatgtccttaggctccatgaatagctacaccatttgtcaactttcatggcagaaatgttggagcaacccttgacgaacctccttccgcacgcctctgcaccatatctatcaccaatttctggagatgcagcctcctaaataacattcagtttatccagtcctcctacccttccccttcaccctggcccaggctgtcatcacttctggtctgccagtctctgatttctacacaatccagatgctgatgtgcatgcttctcccagtgccacctttctggcctcttctgatttccagcatctctggttccagattcgtgcccctaggctgttcatccagctcctgtactcgccctactctctgctgtccaaggagatttgcaaatgttgctgggggcttagaaaatctgcttctctcttccactcacggagttaacttatcctttcattttcagctcagaatcacattctctcaacagaattcactgacttttctatctaggccaaactatgacacatgaattctcacggctctaatttctgtccttatgtaatgcacacttccttcagtcgagcacagtcaccgtaagggcaggtgcaccactagttacttctctcccttgcatcctaagtgcccagcacagtgcggccacatggcaagtcttaataaatatatttgaatgaattaatgattcaccatactatttgaaagtaaagaatgccgatgttcaacaaattaaactattgtcaaaaggagattacacagagttgaagcaattcaacttattattttgggcaacagtataccctcgtcagtattacacagcaattgcatgttcaaagtgtcatctgggctaagaaagattttcttaaaccaaaagttagtatagatcaacctcttttattttgtagaaacaactatatttcagacgcttcctcaaaagttgtctttttaacctctagaaaacaaaactacattgttaagtttgtgataattttttattccgcttgtgtcatctgaacacaaaatttcaggtataatggtattagaagtgtagttatctatagaagactattgcagttaggatttctacacttgaaagcagctcattgcttcttccattattcaagttttcatagaatttaatacatagttgagaattatttcaaaacaaagctacatcaattatgtttttccatctttgtgagcttaaaattacctctgtaagaattcatatgatctccccaccaaaaaagtgaaagaaaatgtcagatgtttctttacgtttccggacacttctattagcctttgtccccatacttcatttttaatttaaaactagaaagtttgcaaggctctttgtagctttaaaaaatccaactggcagtatgcatactagcatattagcatagagcatagaggatgctgaatcatattagcatagaggacggtaagtaaatgatagggagaggtgccttccttggagggaggcacaattgtgattacatattctcaaagaaataagataaatctgagtgagtagcatcatgatgatgacatatatatacacttcccaccagccaaaaggacacttccatttaccctaaatacgttaaaaagattgtcagtcagatattgatcttcacaaccagaggtcaaataccaaagacataatgtcaacctcaaacatcatttaagaggctgtaaggaaatgcagctatgatgcaaacatactgtggctttggctatatggacttacattaaagaatatatatgtgtatatttgttgattttcatcttttcttccaaataactatatatcaatgaagtttgttaaaaagaaaaatgcctgtcaacccagctttttgggagaacaagatggaaggatcacttgaagccaagagtttgaaactcacctgggcaacttagcaagactccatccattaaaaagacaaaacatctcgctctatctattaaaaaaaaaaaaaaatcctggcatgatggcacacgcctctagtcccagccactcaggagactgaggcagaaggattgattgagcccaggagttgaagactgcagtgacccatgattgtgccacttagcaacagaacaagaacccatctctaaagaggagaaaaaaaaaaaagaaaggaaactactctataatcttttcaggaataaatgaaaaatataatgtagtttgcaaagcaaatgtcaactttacatcaaattttacatgaaacattcaagacattttcttcttagaattagaaaatattatgctgtggctaataacatcctttgaccattgtaatattttgattatctatttaactctttataacttttatggcatatactttaatcatttacttttgaataggtgatatacgcacatgatacaaaattctacatatatcaaaatatataaatggaaaatgtgtctccctctggcctctgtagcttatctgcccaggcagtaaacacagttaccaggttcatgtgtatccttttcacaaaatatacatacatacacatatttttatttttatcatttatgttttttctatacatacatatgtactgcatgtatatttttacacaagcaatatgcaacctaaacttatttagcacatttcattttatatataataataaactttgaatactaaactaaataataataaataaatgataaataatattaataataaataaataaataaataaataaataataaactaaataataaactttgaatactgtcatgtattagatatacgcagccatacactgttccactgatatgaacttacctttgctctatctttgtactcttatttaatcttgaacagtttgtaatgcaatcttcccacaggaacatttgttatttagttttaaaacagtgcttctctctgaccaaccctgcacttacagccagacttagtgtgtcatcttcattccctggagtgaattacagctgacctttctgatttccatttagcaattgctttatggataaaattaccatctttgataagtagctcttaaatatacccctgtggttttaattcaggaagcttcatgtctttaaaacgaagtccaagcagttgagtgactttttttacccttgagaatgataccgtgctaaggcatacaccaattgtacaaatgtatatcgttaatgttttatgagctatgttgtttaaaactgcaaaaaatactgaaacaggagatatatttagcagcatgtggtctctctggtggcaatttaaaatacctgtaaatgtcaacttgttacatgataaaacattatgaagtaaacttggattagaaactcctttctttgaagcaagttattcaggactaaatgtttataccaaaggttgtaataaggtcccacaactctaaagagcaacacagatgaagcagtcagagctccacaatggaaaggtgagaggagaaggacctggagtcttcttagcagcaggacctactgttagcctggctcttcaaactcaaatggccaagaagtacttcccatcccttgatttaaccacatcagctgcatggatgccttcaacgccgataatgcatttattgacattgaagactatatttccttgagcctattacggaatttgctattataatttaaataaatcttctcataaagtgtaaaatcatatggcttcattttgtatttatttcttttattttaatactttttttggaggactggcattagtgtaagatttgagaaaggacttaccatggaaaagaaccaggataggataggctcgaattccaatgtatgttagaatcatttctggagtcagaggaagtcagggcaggtgttctaccttcttcaaatctctgaactctggtcataacatgatgaccaaccatcacctaaaattaggcatcatagaaagctccaattcctcattattccttaactgtggattttaggaacaatgaaagtacagtaaatgtatttcccattaaaaaatcaataatttattacatctatgagtatttatgcctacagcatgcaagaaggttgggttttaaatttctctttcacagtagtcaggcaaagaacaaacaacttatatctcacaaataaaactagctatttgaagaggtaagagacatgttcaaagtcaaacagctggtagggctcaatcgtcctgactcagagcctactaccctttccaggtcctacactgccctctctgtggacacatggagccacagaatatcattaaacacatatagtgaatatcattaagcacatatatgagtgagccagggagcgcccaaccatccaagtcaaccagaagttcaagagtgttgtgagcctgtccttgttaagtactggggaaaactaaaatggaagaaagtaacacaggtaaatgtgatcttaaagcaaaattaaaaaaacaaaaacacctttaatatgtaaaaacttcagcagttattttggacagttataataacatgaaacagaaagtctggcatgaagatccctatcagcaatgatctgtaaattactacctttcgggactgtattcatttattttccaatgaaaaagagcctgcaagcacttctgtagaatactgtccagggcctctttgggacaagggaccatgccgccgcttcaaccaacatagtacaatttgcaaaggtattactcactctaaggtagtgtgacagtagaaattaaaaatagctgggaccttctgaagctctcaaacatttctctgccagcataggatcgttccctgtggtgtatttttagtgctctatatactcaacttttaaatgtcataaggaatgaaatcctgggagtactattcgaacacatctctgaaaaaaaaagttatatttgatatctcatctgtgattttcatacaggcattatctctcctccaagtaacacattaaccagctattttcagtcatttgctgaagtttagggtgcccagagtctaatggataactcgctgtgtcaagtaatatcataaaggctaccatttcttctcattagactcttagatagatttataaaatatatatatttacacagtgtatatttatagatttataaaatacatatacatgtacacatagtaaaagactctcactttctgctttaggcattctaaaacaggacacacattatttccatctattccctatcatcactaactctctaaagaaaaagaaatcggtcagacacagtggctcacatctgtaatcccagcactttgggaggccaaggtgggcccatcacgaggtcatgagatcgaggccatcctggctaacacggtgaaaccccgtctctactaaaactacaaaaaaattagccgggcgtggtggcgggcgcctgtagtcccagctcctcgggaggctgaggcaggagaatggcgtgaaaccgggaggcggagcttgcagtgagccgagattgtgccactgcactccagcctgggccacagagcgagactccatctcaaaaaaaaaaaaaaagaaaaaaagaaaaagtaaaaaagaaatcttactatccttaaaattattattctcacatctaattgcctttctcagagccactctttcctttcaccagtcccagtttcccaaacccccattcattcttcctgccttcaaatactttcggcaacaccacttttggcaggaagtctgatccgataaattaaaatagaaagcatattaaaaaatatactgtaagaaactttcagaccctctcacctctggagctgaccaataatcaaattatccttgtatgatatatggtaggtttctagatgctacctgcactcttcgcttcaaaggaagtttcctgtgagaacccttgagtctagaaaatcaccctttcactagcagaagaaactatttgctgtctaaattctgaagatgacacttcctgaactcttttccaagtaaatattaacaaaacaaatacattattcagttaacactctttatatgctttattaagtattattttcctttaaaacacattcttgcatacaacttatgttattgtgggtagaacactgagttgtcaaagggatgaatagaggtggtctggccccagcaacttaaaggaccaaggactgtgttcattaagttttttgtagcaaaggaatacatcctcttacatgatttcacacactttgtttttcagtttttattctaaatattttaaataagtttgtcttttcaaggtagctattacattttgagttgcttttttttcccccactttgtcgaccaggttgaagtgcagtggcacaatctcagctgtgcaacctccaactccggggttcaagcaattctcctgcctcagtctcccgagtagctgggactacaggcgcatgccaccatgtccagctaatttttgtattttttttagtagagacggggtttcaccatgctggccaggttggtctccaactcttgacctcgtgatctgcctgcctcggcctcccatagtgctgagattacaggcgtgagccgctgcccccggccttgagtttcttttttcaaagtacctttagtttcacaatgtgagtaaatgtggaaactgactatattagtaggtattttcctattagtctttcctaaatgacttgcctactaaatatagcacaattgtacttattcaagacttaattcatctatatgtcttaaagtgccatcataatgtttgcattcaacataacagtgagagaatgttctattttctgtttggtatgtaacaagccacagttaagataattgctgctttctgtgtgtgcaagagttagggaataatgatgaaatattcttacttaaatcactttccctgtccttctattttttccacaacttttactctctttgaaatcttcctagtgaaaagctacttctctacttttaagaataaattattctccattttgtgatgtaccttctgcattgatttctactataaaagccaaaagaactctctcgctattaaccttcagacaaaacggcaaaaagcttgggctcctaaatgagaaggtcccttgttaaaatccctcaagtatgaattactgcaaataggacattgggcaaaatacataaatatcctaaacctcagcatctgtacctttaaaataaatataaaaatcctaaactcataacatcttactagaattaaatggaaaaaaaatttaaattatttttggtttgtgtttctttttgttgttgttttattggttttttgagacaggttttcactctgttacccaagctgaagtgcagtggcaaaaacatggctcactgcagcctcaattttccaggctctaatgatcctcctagtcaactactagagtagctgggaccacaggcacatgccactatccccggcaattttttttttttttcattttttgtagagatggggtcttgctttgtttcccaggctgctccgaaacccctgggctcaagcaatcctctttcctcagcctcgcaaagtgctgggattacagacaatagccatctcactttggccattgtttattaattatatcctgcagccataacaaaaaattgtgtttctttttgtgagttaaaatcatttgatagaaaataaaagtaaggttatgactcagatataggcatagatattctaatacaccatctgggaattattacttttaaaataattacttttcttctgtggaatgtacaatagttttccattaatttaaggtggttttctttctccatggaagtcgtctatgtccttcacttttgcagtataattttgctgggtacagaattctaggtagttgtatttttcctttcaaaactttaaatattttgctccattctcttcttgtttgcagtttctgataagaaatttgctgcagtgtttatacttgctattctgtagggtaaagtattccttcctgaattctttcaaggtttcctttatctctggttttgtgcagtatgcatatgatataggtaggtgtagataatttgggatttataattcttgatgttctctgaccttcttggttctgtagtttagtgtctatcattaattttggaaagctcccagtatattcctcaaatctatctttctctgctctccttttcttcttttagtattccaatgaattttacggtgtaccttttgaaaccattccatagttcttggatgttctcttctgttttttttctttgttttgtgtttcttttttctcttttcatttcaatgtagagagtttttattcaacagcagtcaagctccgagtcttttctaggctatattcagtctagcaatgagtccaccagactcttttctaggctgtattcagtctagcaatgagtccatcagaggtattcttcatttctgtcaccatgttattttctagtaattcattttgatgcttagagttttcatgtttctgcttgcatagcttatctgctcttacatgttgtctacttttcccattagcactctaagcatactaatcatactcacttaaaatatctgataaatcataattgttctaaattccctgactggcaatgtcaacatatctctcaaatctcagtcattccactgcattgcctcttccgaacgtgttttccttgcctttagcatgccccgtgctttttctcgttttctttttggtaaaaggctgacatgtattggttaataaaaaatgtgataagcaggactttagcatgaagatttgtgttaatcggactaggagttggattatgtttaatgcttgctgtaggtgtaggtgtcagaggatttgattttcttctcagagaggactgtccctggcagggccttctgctgtaatccactcttataatgcaggaggcctgttgctgtggtagtgagggatggtagagtgttttataaccttcctactagctgtgagtcttttagtgatcctgtgtttcagggctatgacttttctgagaattttcccagcaaaatacctccttttacctccttgccttctactacttttccagttatagaaatcccattttatttccttgaagccatgacacccactaagtatgaattttccactagcaagacaggaaggctaaaggggtctgtctgacatggaagtaacacccttccctgataaccttctagcagagatttttccctaaagagaaagccttcctgatgtagaaggatctaggatacttcacaatgtccatttttccttgacctgccagaggtaagaagggatattcctggaattttcaccgtgagcacttcatggggttcctagaagtaaaggcaatgagtgtaggggcctcctaagactgcacacccccggattttctccttctcacaccactgcttccagcagctcatgaaagtgaccatttaagtgatctcacctgtatatagctcctatagtctctgatccatgtacatttgttttggttgtgactctgtggacccacctgtccttcatttccaggtggcaatttaactgcaacctcagttctctgatgggttcagagaagtcattgatttggggtttgcccagctttttcttcttatgaggatgggagtgagccctttacacgactagctgaaactgaagtcttgtggatgattttactatattatttatcttttctaaactttatcaatgattgaaatgtttcagcatatatgaataaccaatagcatgtcagattcttaactcccactttctgtaactcacaaaaccagactttacttaggactgaatcttaattattgtctaaatttttatatcagttttaatgttataatgttgcagaacatatatttcaaattgtgtttcattatacacatacacacacttgttatactggactaaattattattcatcttgggaaatgtgactatttacacttccattgtattatctcatcacagtgaacagtcaacgcatatatcttgatttatacaactttataagctttttctgtcaatgttgatgatgtatcttagtcaattttggctgctataaaaaatactataaactggattgcttataaacaatagaaatttatttttcacattctggaggctgagaagtccaggatcaagttattagcgggtttgtcctctgatgcagggtcttgcctggtttctagaaggcaccttcccgctgtgttttcccatggtaaaaacgacaaggaatctctgaagcttttttatagacgctaattccattcatgaaagctccctcctcataacctaatcacttcccaaagtctgctcctccaaatattaccattttggggattagattttaacatattaattttgaagggggcacaaacattcagtcatagaaatgtgttttaagatattctttgtaagtgttaaaaaataataaagcacataattatatattgtctcaccccaacaaggaccttataaggtgggaaaatatagtcatccaattgataaatgtcattagatagtcatcaaactgatatggtttggctgtgtccccacccaaatctcatcttgaattcccatgtgttgtgaaagggacccagtgggaggtaattgaatcatggggtcaggtctctcccatgctgttctcacctagtgaataagcctcaggagacctgatggttccataagggggaatttccctacaaaaactctctctttgcctgctgccatccatgtaagatgtgacttgctcctccttgccttccaccacgattgtgaggcctccccagccatgtggaactgtaagtccattaaacctctttcttttgtaaattctccagtcttgggtatgtctttatcagcagtgtgaaaatggactaataccaatgcacattaaagattttggcttttcctcaaattctgtctgctccatcagtttcaaatgacctttgtccaccagtcgtaatttctgcctatacatactggataaagtgtttcatcaggtgctgagagaataacttaaccaatatgcagatgaaagacaattatttttgaaaatcactggggaaaagtctgttggtctttctctagatttgttaggtaattcccttgacctctgacacagcatatttttccaggtcccatgaatacacttttccataggatgtgattaaggtgtgggtctatacctcaatgtcattaacattccttaataattttccttaatcccaagtcagggccaaactttactgctaatacctgccctctacctgcatccagggatctcagagctctcctgacagaagcgtttaacttcctgtgaggaaatgttcatataatttacacactaaataactacttcgaagtctgcataaatagactgaaataagtttttataaccacccagaaactgaatcaactctagcaagggactggtaaatcacgttggtttcttcttgggcttccaacatagaagccgccagatcaatcacttctagattggagttgctcattaaacttcacggtgttttctcatttctctccaaataaatttgacaattcctctctgaggcttctgagaagctcatcagaaaaattactagacaggtattttgtggcaacatattttagcttgtactattttaagccccacccagaaagttcagtttaataatttctccacaagaagtacgtactcttttggtctttcttctgtaacctttattaaaggaaaaaaagaagaaaaagaaaaagaaaaaacctaaatcccagttctttccaatttcagatcctgtacttttctagtgctcaacatagcttcaaaaaaaaaaaaaaaaaaagaaagaaagaaaagaaaagaacggaaaagaaaaagacaatgcataaaattagaaaagtcctcttactgagctaggtggagacctgcttccagagctaccactgaaattattggcaagaacatgcgaaggcagtagattgtactaaaatgacgtggacagaaacagaatctaataaaagaagagggaagaatttcttacattaagaaatcattttctgcttttttttttttttttcttttcacaggaaaacttgctgtggggttgtctagatcaatgccattgcagaaaggctggacaaggattgaaggtgaaaacgggaggagagcatttctagaaaactctttccatacaaagtgccagaggcttcatgccagatgccccataagctcgtctcaatcccacctttagtgacttcactggggtagtctgaaatgaacactctcaaaagcctgccttcctattttagctcaagtttgtttggcttcctttgtaaatacctgtgacatgtaggtcaggaaccaaagagtttagcactttcatttatttctgtttttggtctaagggaaacagaataaccaccagtgactttctattagtttgaaattttggaggccaaatgacataaaatgacatacagcaccagctattttttttggagggggggcacagagtcttgctctgtctcctagactagagtgcagtggtgcaaccttggcttactacaacctccacctcctgggttcaagtaattctactgcctcagcttcccaagtagctgggactacaggcacccaccacctcacccagctaatttgttttgtatttttagtagagatggggttttaccgtgttggccaggatagtctcgaactcctgacctcaagtgatccacctgcctcggcctcccaaactgctgggattacaggggtgagcccccacaagtggccagcaccagctgctttaaaaaaaatcgtgagggatcacagatcaaagcagagtccaccactcagaacaggcacaggacagtgggtcttgcaaagattaggttggtgcaaacctagtagcgttgctgttaggtacatcccaaactccgtcacgcaacacaagttgtttctcttctttcctgccacaggtttgtggattctattgctatcctcatttggtgttataattacttgcaataattgtttacagcctcacctctgtcccttaaaatgtttctggcgggggaccattgctttttcttgattgttttcctaattcctagtaaagtgcttggacactcagtgaatatttcttcactgaatgctattaatggccattgtccatcagcatcaaatagagaatgaaaactacccccatatgtcttattttaaacagaagccctgccctcaaagagctctacaggggaacgccaccaacatatgcgtccacagctcatttaataatgctcccatccatatgttttgcagtaggtgttgctggaccaagactgagttctgcgtcaaccagatgtactgtgcagattagaattccatcttcatgcttttcctgactacaattaatcttaggaagaaccattgacaaatctgcaagcgagggagttgtccatgtgttaccagaattagggagtcactgccaaattgcacgccaaccttcccaccagactctttggggcttcataaccagaagagcttctccagccagcagctgttaagggatattattgtttggatggaacccgattactgtgcatccttcttaattaatgcgattaccaaaggaatgtatacaaaatagggctctaattaattgtagccaattaagattttaaactataaattctgtgattatttcacatataaggtgtgatgctgcagtttcttaaagacatttcctgaagaaacaaatcttagtacgatacctaaattactcagagaggaagattttacatttatggatgattgatttgtgttgagctccctacacagtttctttctgaaaagtgcatataaagttaaagaaacaaaagcacggagtcatgagactctatagtattacaggtgcaatcatttctgttacaaagctatggaattatgcaagtgagtgtgcagaggaaatagaaacatttcactttaaaaattggaagatagggccgggtgcggtggctcacacctgtaatcccaacactttgggagactgaggcaggcagatcacgaggtcaggagatcgagaccatcctggctaacacggtgaaactccgtctccactaaaaaatacaaaaaaattaaccgggtgaggtggcgggcccctgtagtcccagctactcgggaggctgaggcaggagaatggcgtgaacctgggatgcggagtttgcagtgagctgagatcgcgccactgcactccagcctgggagacagcgagactccatctcccaaaaagaaaaaaaaaaaaaaaaaaaatagaagatagaaatataacggtcgcctttaacttctgcaagttttgtagcagatcctctgtttggacactaatccgtgaaaatgaactcggaaaaggaaattagtaataaacatgagacgttttcacacttaagaggctaatgtgttttctcagtttacgtcactacctgcatgagttcccatgtaaccacaatgtaagacaaagctgtggcagaggcctgtggacatcagggagtttcacctactgctatttcaccttcacctcctgaactcacaagaaagacatggggtattcccaagtcacagaaaacaggaacagaacatttatccaaagaaaatgatgatgatgatgaaacgcattccgtttcatgtgaaattaccaggcaatagctaccgtatttaattcaattcatattagatatgagaaactgcacgtgtggagggaatagaaattgaattaaatacactcggtttctcagatgtaatatggtcaggccgagtcaagtgttaccaactgtggttgccgaacgaagaaaatggaatacgcatgcttatgattatatatataagagaaatgcatatatacacatacatatacctgtgtatttatacataacatatatataaaatatgtataacaagaaaaatctaacacaaatactccaattcataggcataacacccctcccaaaagcagactttcccgtgtggatttattgcaatggtaaaaagctaactcttgctaaagtagattacatatagtctgacaatcgtagattctgatccgtattttagataagaaattgtttacactgtgttgtcgagtatagattggaaaccacatatctgcgtacaatcttcctttcctcagaaccaacatatatttatttttcttgggtttccatacaaaaagcaggcctggcaggagcacggctctgaggtgtcatggacctgcgtctgcagtagagggcaggagcagggacagctgggggactgttgcatccgattgaactctgggctagcagttcccaaccttcacacccagacctcggacgagggaacgttagcgcccggcggcagtggatttcgggagagggtcacgccctaaacattatgtccgggtttggagacagacatccatttggattttcctggcggggattcaaacttttagcagagacacttgatgcatagaatacttggcatcttggccacacggagacccatctgtcacaatggcatcctgcctatttcaaagttgcttagatcttttcagcaagccataagtgccaggcaggagtggctcttcatggggagtgggtataaaactgcaagtggcatctcttccacaggaacatcttctcttccgctagttcccatccctggtccagcttgcaagagctacacctgttgcccctcgttcatagaatacactagatttgccctggaaaggcaacgccagcacttcagattacgttcatatgccagaaagacaggtggtgcttcagcaggagtctgatgaagtcaggaagataactcagggcataaaaatgtttttataaaagaaagtagagtcctctccatgggagcattgtgaggcagctccgtagatgaccacaattataaaactaaatagaatttcggcacactacgatgacaagaacacggggtaatatcacatcaagaacttgctcttcacatcagcagatattgttgacaatgtttatgggcaacttttaaatatggcaaaaccctttgaaaaaagtattctggttatagattcagagtacattggaacacatatgcacatataaatatggctttcatttacatgaaatcaattgtttgtcagggaagatggttttgttcaacttgcaatgtatgttttctttcttcctcatggaaatatgaaagctaaatgcagttgtttagaatgagaaaatgcacgtggcactcaaatactgccctgctcaataaatgtaagttgaaaatatcagatcatcctacttggggaaactctgtagtaataacctccaataaaaatactttacacaaagagtctaggcatttttttacagctgattttatttaatgaattgtaaggcaccataactattgtgatatcgcaaagaataaataggtatcaaggttcatattttaacaaagtgacagctagatgctaacgtaggctttactatattaaaagtagataatgcattcaacagaatccctgagaatattttacttttgcaagaaatgacagaaaggaatcctttgtcagcattacagtttttgactggtgatggataccaacattcatgtcaacagggtgtgagacatgtcattaggcatccgcaggtgtacagggttcagtaggtgtattagctcattcttaccttgctataaataaccacctgagactgggtaatttttgaagaagagagatttaattggctcaggttcggtagactatctataggaagcacggctgtggaggcctcagtaaacttacagtcatggtggaagggaaagggaaagttggcatgtcctacttggctggagcaggaggaagacagagagaagtgggaggtgctacacactttaaaataagcagatctcctgtgaactctatcatgagacagcagtagggggatggttctaaaccattaaaaaccacccccacgatccaatcacctccaatcaggccccaccttcaacactgggcattacaattcaacatgagatttggggcagggtgcggcggctcacgcctgtaaccccagcactttgggaggccaaggtgggcagactacaaggtcaggagatcgagaccaccctggctaacacggtgaaactccatctctactaaaaatacaaaaaattagccgggcatggtggcgggtgcctgtactcccagctactcgggaagctgaagcaggagaatcgcttgaacccaggaagcggaggttgcagtgagccgagatcatgccactgcactccagcctgggcgacagagcgagactccgtctcaaaataaataaataaatgaaataaaataaaaaataaaataagagatttggatgggggcatagagacaaaccgtatcagtgggaaccctagaatgtgactatccacaaaacaaggatgccaagttcacaatacctaataataaaagccataatgtgaaaagtgttgcaagataggaacagagtgtggcagtggttcagatggaggaggagatttccaaagactgtaacatttgagatgggcctggaaggctaggtacgattcaaaacaggtcactgctcttaaggcatttacaatcagaagttgatacagaaaatatgctaaggtctatttagtagagtgagtattgttactgtctgtgataacaaagctgaaatgacagaaaaatcacttgtaaaataatactagactttgtgatgtttaaagtcttatttctctgattatgagttagcaatacttttaaaaaaagaaaatatgtattctattacaaaactgccccctgaaaaattcttcctttgaatggaatcccgtgttggtgttggtgactcctgagttgaaatcattacgaaggggatgatgctgatcgagggatcaaggacatcactcaaggccccctccatgtgcgaagcatgtgagctttctgggacagacttatttttgtatttatgagcttcgaaaatcacaaagtgtattgccttctctctcttttctttttgctggaaatctcagagtgaaaggtgggtgttcctcccagattcagacctttctgccgattcttgcacaatatcctcctcttgtccttctgtatatccacctggacttcattacccattttctaactttctgcacaatgtgtatgtctgctccaatatttattagaaaaaggacagggatataaatgtgaaaaaaaaagccaatttccaatgtctagacaagcactgcgagttgtgctttaaaaagacacaaagctgaaaagtgatagctgaatcacgttacttcagattgataaatcttttctttcttgacccaatctcactatttcagtgaaataaacttattatttgactaatacatttttcgtaatttcaccaagaactttccagtaattaatttccacacatatatgcaggtatgtgcatatggaattttaaataatttatatataaacacacttgtgaatatgtatgtttgtacatatatgcagatatatattgttcatataatcaccacacacacacacccctacaacatgtaattttaaataagtgagttttaaaaaaagtagtaaaattctggggggtgtatgtatgtttggtttatatttttttcctttgctattacgattgagttgtttgggcacctaaaatacatgtaccaaaagataagccacttaggtgcagggacgaatgtaacagagccatggttttcagtgaggtagtagtttgttaaacagagaaaataatgattatgtaacatgtcatgccttacttctataaagttagaatggaaacatactcagttaaaatcactaaagtaaaattaaaatcctgtaaaactgaaacgtacttgaaattaaaacactttgtaatttagtcatagctacaattcagaaataatctcttgcccaaagggaaaaagaagagttctgtcaattagagtatatttagaaccacgggttagatgtaaatgttaaattcttccttactatgaaactttgctggtacttaaaatttagcataaacaaataatctaataaattttattcattagaaatatgaccaaaatttccaatataataacaaaaattaagggggatttaatgtatattttctattagccattccctggctatttgaagcatgttatcggtcattttgatagaaggcagaagtttgcattagttccagatctttcataaaatgttgacataaaataaaatgattcaatacccagtactcagtacactaaatgtagtaacaatttgtaccataatatgaaaagttttaatatcgatactccagtacattgtactactaattaacataggaggtgtgaatctgtcccctctaaaatctgggtgttgccaatgtgatagtattggaagctgggcctagaataagtgattagcctgtgatggctgctcttttgtgattacagtaggtccccccattataaaagggcatgacccagagttcatccccttttgccctttcaccttctttcatgtgaagggagagcattccttccctccagagggtgcagcaacaaggtattctcttggaagcagagaacagccctcaacagacaccagacctgccaatgccttgatcttggacttcccagcctccagaaccatgagaaatacatttctgttctctatcagttagtcccaggtattttgctgcagtagcacaaaagagctaagacagtagaggaaaataaaatgaaaagacaaatagaagacaatgttgagatcaatcaaggtaggttatcatgaaaattcctaccttgtatatataatatttgtaatgttgagtcaatgccttttctaagagtcttatgctaatgaaccaaacaggacaggatcttcacccccaaatctactcagacttattctagaaagtattatacttatgactggctgaaatgagcgatccaaggcagttcaagataagtcaatttcttgagtctacacataggaaaattagaatattaataacaaagtatttagagagaaaatgcatatggaaatgctggcagtataaatctagggaattcactcatatcttgaaaatccgtttaatgacattagttttgaaaacaaaagtatatgtctgcagcaagatcatttttctcaggaatcaaggatttagttactggggacctgtcctcagaaattacaatggtgaggccaggcacagtggctcatgcctgtaatcccagcactttgggaggctgaggcaggtggatcacctgaagtcaggagtttgagaccagcctgacctacatggtgaaaccctgtatttagtaaataccaaaaaaatagccatgcgtgggtggtgcatgtctgcaatcccagctacttagaaggctaaggcaggagaatcacttgaacccaggaggcagaggttgcaccaagccaagattgtgccattgcggtccagcctgggcaacaagagcaaaactctgtcaaagaaaagaaaaagagaacgaaagaaaagaaaagaaaagaaaagaaaagaaaagaaaagaaaagaaaagaaaagaaaagaaaagaaaagaaaagaaaagaaaagaaagagagaaagaaagaaagaaagaaagaaagaaagaaagaaagaaagaaagaaacaaagaaagaaagaaaagaaagaaagaaagaaaagaaagaaaggaagaaagaaaggaaggaagaaagaaaagagaaagaaaagaaagagaaagaaaaagaaagaaagaaaaagaaaaaagaagaaagaaagaaagaaaagaaaagaaagtaaaagaaagaaagaaattatgatgattatgatggtgatttagggtcagaaacaggcaatttcaagtgacttgttagctccctctcacgttccattcagaaacctcttccaccagccagaggcaacatttattgtcagccaatctgagtgggggtgctaaacacatttcacatttaggatatactcaggaaaattcaaattccattataaattatgttttaatcttcctaagctatctcaaaaattatcattatttaatatgaaacatgtataatgtgaattaatgggagtttatatttttaagatcatgttaaagataagaatgtctttatactgtcccctgaaaacacagtattctctgtatgtaagtttgtgatgttggaatcactatatagttggtaaaatggcactttaaactgtgaacatagaaattcagatgcttattaacatacaatgcatattttccaaaataccttttattttactcagataatggaaggataaccaacaagtgtgaattacccacagaagtgatgggtgtgtgtgtgtcggtctctgtgtacaggaatgtgtatgcaatgtttactcaccctaagacaaaatgtgttccttgttgttctgagtaattattcttctccaccagccatttttttcttatatgttgttttcacagatcatggcgagaggactttataaaagttcaagggaacgttactcaatctgagagaaaacccaagagtgactgtattcactcagaattgaaccttccatgcaagaagccacctccagccttctgaacgtaccctcacatctgtttggaatacttgccctcttcactcagccaaatttgcttcagatccaatcctgcaatttccttcctatgaaaagcctttcaagaatcccccagcatggataaactgccctcttcacttgtacccagagcacctgagcttttgtaatcatgatccaggaagtcactctggtgagattacccattgccttgcaggtatctcccaccagagtaaattctagaaggggtgaagtactgcctgtgtgtgcgagtgtgtgcgtgcatgtctgtctgtgtttttttaatgtaccttcagttctaatggcagatgatacgtacactgaatgtgttgtttaaaggtataaataggcatcattgattcttgttacataacctatccctgtcccaccccatctcaaactagcacttctaattatgtatgcttatatatagcacaatattttacaaaatcctgttttacttgagaaaaattagaaattaaaggtcaaatgatatttagcaataagaacttctaataacttgatattatcacttttatgtattcttcctaccttaaaatttgactcgttttacattgctgggcaaaccattcacaccctttcagtttttaagtgcacatattacatttgttttctataaaagctattgatagcgctcatgagagaaggtatgcagataacaagaaacaacacatcttgtccacagttcacatggtgcagcctgggaaatttctgagagcccctgcagaccttcagatgacagaccagcccattatatgcattctgtgttctcacgcccctagattgccagaggtgtaaagaaggctactgaaggacaccaaagtcaccccaagaagtgtttccttctacacagggaaatgacttgaggaattcctttaccaagtttttcctagtgctaaagttttaactggcatcttctctaagcctcaaaagagtctctcactcccttaaatcttcttattcctagtcttggtgtatatgcatattacacactttccatcacagaaatactcacattaatgtgaacagtaacagtccctagcatccacctcagctagatggggtgctactactcaggcataactccaagaattttccaacttaggggaacaatcttaaaaaatgatttgaaataaagggatatcaattatactagcatggaattaggggaaatatttttaaaatatataataccatcaatttttcagttttagatgaccactgtcattttctttcaatagttacataatagtagacacaagtgtccattcattaaacagctgtcctttcttctacccttcacacttgactcactcatgcctcatcctcaaaggcaatgtgagttgatgctttcgtattggttaggagcatgaacagttaacttcttaaagggttggcatacattttaaaataaagagtgtaactggattgtttgatactcaaaggataaatgttggaggggatggatatacattctccatggtgtgcttatttcatattacatgcctgtgtcaaaacatcttatgtactttctctctaaatataaataaacacacatatatattcatatatatatatactatgtgcccacataacttaaaaataaatataaaatgaagcccttgtgataacctcattgagtttaaacatacacactacacttgtattctacattgcttcctgcactcacatgttctctcctggtatacctatccacggagagcactcagtgggactatcagtgcttgggagttagcatgattacagaaatttaccaaggaaccttggaaaggtcattctattatatatctccaagattcagtgtcccaatggtagaaatataataattccaataatgagttttcaataataaatgagataatgaagaagtaactggcccacaaactataggcagtatccaaactttatctgtataggtttctttggtttgggttctatggaggaaagaaagtagcttagcaagctattctcaaccttgcatctgaatcatcctttgatagtttaagaaagttttataatagaattcatttttgtcctctgtcacatctcagcttgcttgaagtctcaatcactgtaggcagaaaagtgatgaacaagacaagtttctgccgtcatgattctgacaatgtaaatcaagcatccaggctcacaaataaacatccagacactcgatgttgaatacagatttgacaatctctgctagaaaaaaatgtaggatccactttgagttatgatcatgtaagttttattttcatctatgtgaccatgataaagttgtaaacagttttgtatcattttactaagatattttcatcccagtatcctaattatgttcatgtaaaatgaattttcctctcaagaatttgaacgttttctgttctatttttattgaattaaaaaccatctatatgatattttcaataaaagatgtaatagtaaacataagtataaaacctacagccaggcacggtggctcacgcctgtaatctcagtactttgagaggctggggcgggtagatcacctgaggtcaggagttcgagaccagcctggccaacatggcaaaacccgtctctactaaaaatacaaaaattagcctggtgtggtggcccgtgcctgtaatcccagctactcaggaggctgagacaagagaattacttgaaactgggaggtggaggttgcagtgagccgagatcgcaccattgcactctagcctgggagacaagaatgaaactccatctcaaaaaaaaaaaaaaaaaaaaaaacctacaaaaaacttttataaacattttaaaatcactcaaactttttgacatatgtatcatattgttttcatttgtcatattaagattattacagttcgggaagaaaatatgtttctcaagtttccccaaccagcacaagacaaaactgggatttgaacccaaatcttgtctcttcaaatcccgtctctttttctgtattatgcaacggaagaatctttgcatccaccatggtgtctacattgcataaatacctccaataaatatttctggaatgaatgagcaagtgacttgaattactacataccttaaatagtttgggttgttatcaagcatatttgaatatattatgacagaatgaactagcattataagtctttctgaatgtttagtccctgagcagcagacacaaggaaggacaacatcactatggttaatcagagaataaaacatggtgaataccagttttatggtttttttttttttttttttttttttgcagtgtggcccacttttggttctgggaaggggctcaagagttcaacttgaaggttaatttccagacacaagtaggtggtctttgacggggtcatgtgttgtcacatgactcctgttgaaacctgacatttctttagcagttaaatacatggcattttgtaaaacaatctaaaatatacctttcctacagaacttactgttaatcatttcaaaatcaaccataaaatatttaaaactcagtaatttctagtcttgtgttccttattctgaaacgtgggtattctgtctggcattttcttttttttttcttttttctttttttttgagacggagtctcgctctgtctcccaggctggagtgcagtggtgcagtctcggctcactgcaagctctgcctcccgggttcacgccattctcctgcctcagcctcccaagtagctgggactacaggcgcccgccaccacgcagggctaatttttttgtatttttagtagagacggggtttcaccgtgttggtcaggatggtctcaaactcctgacctcgtgatccgccctcctcggcctcccaaagtgttgggattacaggcgtgagccctcgcgcctggcctctatctggcattttgtaattgtgaaatggcattctgtcatgctcagtatgcaaaacatatcttttatttccctggtcatttgatgcatttccagccagaggtttatatttttgttttcctattacagttttagcaatgcattctttccaggttatatttaatgactacaaaagtgagagctcataaaccaacctaaataaacaaacaaatacacattttaaaagtggacttattcttttgaattgtttttattaaaagaacatattttatcaatgccgatattcatgaggctgccatatcataaattgaaaggacagccaagcctatcaagtctgaaatattcaaattgcagggtaaagaaagaggctgctattacatttattttttcttgtggacacaatgaataaatggatgtatcacagagttaaacatgaattttttttggttctaacgaaaggaagaaataaaacacctataattttgtgtaataacctttgctctgaccccaccatgaactctttatctttacgatattttctgtatttgtgagatctacgcatgtggccgtgtaattctctcacacttaatactggcgcttgcatctactagaagctttggaatttcaaaacggtgtaatttttctatgtaaatgtataaatagcagttatcttatttgtttttaattaacctccttatttaggtacagatgtgatatagccttggggaaaaaccaactcaaataataaagaaaatatggaataaaaagcatgtatatagttccttaattcttgatttccttgcaaaaaaatatgaccagtattcttctgggcttttcttttttttcggtcagttaatacaaacaaactttacaggactttacaatctatactgtgacttacattttaaattcaccaatgctttcatgtcatctctctgtattgggatgcctactgctattttgtgtttgaatatctacctagaactcctccctaaatagtttgctatcaatgaactttaagctctttccagattttttatataatgagcaaaggtaactttgttttagttaatttttaaaccatttacttggacccaagtttaaaactaaaaagcattcagctagagcacatactattttcatttataaagattcaaagcagtagacatcccgtatctaaaagacatgcttcagcattccttttaatgaaaaaaatagggctgtgttatttgctttcaatgcattattattattattattattattattattattattaagatagacactcactctgttgcaccaggctggagtgcaatggcacaatctcagctcagggcaatctccacctcccacgttcaagtgctttttggctaatttttttttatttttagtagagacagggtttcaccatcttggctaggctggtctcgaactcccgtcctcaagcgatctgccagcctcagcttcccaaagtggtaggattacaggtatgagccaccacgcccggccaaatgcattatttaatctaatcttagtataaatccctgccaaactgccccagcaactgtcagtgaggcacagtgtgaaagtttaatgtaggactcaagaactgaggcttggggctcaagtctttgctttgtagcttagctctgcgatgccagtcctttttttccgagagcaagtgagttggaaaggggcaacaactagcatgtaagagttatgccttactaaatagttcttagaggttcttcatggcatcctaaactgacgaaagacaacaggcagggcatctacattggtataattactcaggtaagtggtgatgacactgtgaactagggctaagggagtagatatgtcagatgatacttatctgcaagttaacataaataggacttggcaaatgcatttgtccatttgctcagactgaaaccttggattccaacttggctcctctccttctcacactcaccagcaaatcctccaaactctgccttcaagatatacccagaattctaccaagattccccaaagatcccaccttgtcatgtccagcagctctaacagatgaaaatcattttctaagtgttttccacactacatctccagtgattctttcagacccaagtctgtgtaaagctcccgagtcacaccccacatcctcagcggcaaaagtagaaatccttccctgatacaggatgctcaccaggcctggctcctgtggcctctctgagctccattcttagccctcatcctcagcccactttgctattccaccccagcctctgcccacgtgggacgcacacatagactttcccgttgccattggcactgcctggagtgcccgtcaccaagaagctgaccagcatgtcttgctctcttgcttccactggatctcagctcaaaccccactcatcagaacaaactgtcctgacctcccatatgtgcacaatcccctttatttttctacggaatttttgccaccatccggtatcactgtctgtggttatttagttatttactatcttctctgactatgcaagagctggggctttccctgattgtctctgatacatcgataactactaacattgttccaagtgcaccataggggctcagagatatttatgaaataattatgtgagcctgagcaagttactggccctcctgaacttcagcttcttctctctgaaataacaattctaattccagtcttgcagatgtgcacgatcatttacgaaagaggctatccacaaacgcgctgagaagtaactggctcatagtaaggggctgacaggaattcattgttactcagggttttaattcagctgaattgtgccaccctagaattcatacactgaaataataatccccagtgcctcagaataggattttatttgcacataggcccattaaagaggtaattaagttaaaatgaggcccttaggtgctggctcactcctgtaatcacaggactttgggaggctgaggtgagtggatcacctgaggttgggagttcgagaccagcctgccaacatggtgaaaccccatctcaactaaaaatataaaaaatttagccaggcaggttggtacatgcctgtaatcccagctacttggaaggctgaagcataagagtcacttgaacccgggcggcagaggttgcagtgagccgagattgcaccactgcattccagcctggggtgacaaagtgacactctatctaaacaacaacaaaaaaaggcctttaggatgggctttaattcagtcccactggtgtctttataaaaggagaagatgtggacacacagagaaagacatcagagaagctcctgcaaagggaacagagcacgaggggacacagtgagaaggcagctgtctgaaagccagcgagagaggctgcagagaaaccaaacctgcagacaccgtcgttgtggacttccagcctcccgaaccatgggcaacacatttctactctttaagccacctaccctatcacagtttgttatggcagccccagcaaggactacaattattaaaggactcctcctaaataacagatattcaagaaataggcatttctattagaagtttaattcacaaagatatatctaactatgcatagggtcgtgaaaaatgagatgctggatatttcagggaactcctgtcttgatatttcagaagcactaggtaacactcacctcagtgtagaaaggaaaaaagctagtctcaaggtgtgttcagtccatttgtctacaaatgatttcatcatttgtcaccattttcatctgattcaattaactgacacatcattctacacatctcccagaaaacttcagcttctgttttatttttattttttctggagcccgcacttgacaaatggggtgacattcaccctaagccatggttattataagccacaggagatgatggtgggagagagaattcagccacctccacaaccacattccctcactgccaaaaacatccccattggcaaatttaagtttttacaaaggcacttggcaccacagaatcagtagattctccagctattgtagtaaaagtatattgcaagagctaatttagttcctgagtgaagctacagttttctgttgtgagatcaggaattttaacattttattcacgttaagcactgatgaggtgaatgaagaaaggaacaggggtgcacggtgcagaagcaaaccccacagggccaaggaaaaagagcttgtttctcgccctagctctgtcactgtttttgtgtgaccttacatcaattgcgttgattggtttaggttctagattcatatcacataaaacgtaggcatggacagacgttctccaattccaatatgcaatcaatgtcctttcacatattaggcatctcgtgctaactaatcacacaaatattaaaacaaaatttatttcatgtaaaagtgtcatatgcaattggtgtgatattaacaccaattctgaacactgtaataatgtaattctgatttcattcataggtgcgcgcacacacacacacgcatatatatatacacatatacatgcacacatcattttgagaagtggcgcttaaagagaaatttgacatactgttagcttattagtttactcagcacagctgtgctgaaaattgttcaaaactacagccgagcatacagctgagtaagccaattccttgcagcagcatatattctttctagtttaagatcccctgctaggattggcaaggatagaacacaattacatttatcacctgtctctccaaagactggttcctaccaaacccagaaacattaatatttcctaccccaggtatcaatgtttaggtcgtttatattgtggataataccatataattgttacttttagatacaaaaggttaccaggtgctagaaagtgttaaagtacataaattaaggaaagcaatttcagctgtgaaatttacatttatttgatgtgtgaccattgtaaatacaggatagatcttaatttcttaataaagggttcccagaattactgtatgtctagttttctgtatcccaccatctaacacagtggttgacattgtacagaactggaaatttacagaagcttatggaactttgatttaaaaataaaaacagtaagacaatatatgtattatcaatgggagacatgagaaaaaggaaatctgcccttacaaatccttgacttatctgtaataattggcttggaaattcaggcaattatatagatatcttcattttccattagcctgatatgattggttttattacgttttaccttaatttgtgtcttatatgaaataaagttatttggggcagtcctaaaagattgaaatataactcactcccctttttttagaatattgttttctccttcaattttaacatttctgtgtttgacattacttttgttctctccttctgatcaggacatagttctccttctggtcgctacgaggagtaaacatcccatccctttgatattaggcataatcatgtaactcactttagctaatacttcctgagtgacactgactcgggtctttgctggctggttacctttagttgccaatttcaaacgcccagcctgcccaccgtctgtcccagcaatcatggaaacacatgttattatgttatgtatccatgaaccatccaacgcaaggtgactgccttggaggatcacccagactatagctgatttcaagaaaaaagtctggtttatagctacgttataaactagctgtgtcctgcaaccataaaacatctacctcctttggaaaaagggattagatacctatttgtgtttaagattatgtaaagcaaaactaaccaggattgaattattgagctgttcccagtaccatctcctcacataagcaatttggagagaatggctaccacagaaagggtggtgaggctcagaaagacatttgcaaacattttagcttgttaagagttttaaaatgcagtatatttttaggggattttcaaaacttcaaagtttattgattgttatatggagatatgtactttagaaatgtcccttggacattaagatgcttatgtaagaaattcttgtgtaacatgtattagttattaaaattcaggaaaaaatttaaaaccacaataatttgagagattcacatagctactaataaataaaatgcatattgctaacatttctttggtatatattaaacaatagcatgaatgcatttattaaagcaattttcatttggaatctttcaatgtttaatcacatttctgttgcttctagataaattgattacagcaatagagatagctttgctataattaaaactgtaaactttgaatttgctcccttcattttattttgggaagacttttaaatataacttctctggttttaaaaaaaagtgaattttacataaaattgtcttaaaaagtaacatttggtaccaagtaactacacacttgacatatttctagaaaaaaaaaaacactcaaagtctgatttcagaaactagaatatctacagacagagtttgttccttctgtgaggtgaagacacgaagacttccaaaatctttctgccagtttgtcttaaagagaaataatatactacctcattaaggcctatttcaattaaaatgagatataaatgaacgtattcacctagaagctaatagaaaataaagcttgtgacgtgtgctcttgtcttagaaatatgatactgcaggattttggcaaatagacccaacagggtagcaagttgacgtgtttctatgcactttcaggacaaattggtaaaggctgcaggaatgaatgacacagtaaatgccagcaacacaccatgtgctggcacagaagtgatcagccttaagtacgatccttaaaataatccaagcttacactgacttaaaggtaaatttttaaatattcaatagagttttaccccttccctgtgctccctggttcaaattttcaactacaggtcctgtcgacgcctcaaacataggaaaatgcaatattaatttttactatggcttaaaattgctgcctaatagtgaattaaattattataggtacataacatgtatctagccaaaatgcaggaattgaagatgggattataaaagaaacttacaataaacatttctctttgctgatgagttaaaagattttctttttaacttcaaggaatcaggtaatcaatagcactttcttttgcggcttgaagtaattaatcaccttacatacttgtatggatatgttctctatctggtatatgtttttcttttttacttttttttctttcttccccttcctttcttccttgctccctccctctcttctgtcttctgaatcatgttttcccactaagtatgatatgacggcactagtaaattttagaaaagcaacagcaacattctctcagaggagcacaacctgtccagctgtataatcatgcattaatatgccgtttaaatatagtatcccccattttggtaaactgtaagtgctgcttcctcctcgccatctgaccttatggggaaaaaagtcatattttgggtctttgtgtcaagataaagaaaattaatttcaaagccaacaaggagagaactgtcagtgcagaaggtaagtaaatgccagcagttgctctgtgacttcaagacagagagaaaaatactttcgaaaagtagcactttgatacatacaatactggaagttttgcaacaagcctctccggcaccaagtgcagaccccacaaccacaatgtactttccgaatgcctgtcaaataaatggatagatgaaaggaaggaaggaaggaaagataaatggatggatggaagaatggatgaatgcacagatggtggtgaaaagatatactaacttataactacaactatccttattgctttcttcctctcttccttctaaagggacctagatgtgagcccgatacatttattttgattaaaaatttgtactatagatatttacaaagatacattgaggcagagaagcatcatttcaagtagggttttcatttgttacatttttaaatttcataataggcagaatcacaatgtattcatctttgcccacacagtcactctcactcaacagttacttacgtttatgctttttttttaaaaaaaaatgaaggttttgatgatgagataaatgtgttctagcatgaatgcaaagaaggtctccatgaactgagaactttgaggcggcagccgtgagcaccagggagagacctttgacaaggaactcctggcccagtgactctgagaagaggccaggctaacaagaaacagaagaggctgcctgagctcagaagcaaagctcctccaacatttttatccagacatcccccaaggcagaaaaaaataaatatttccccacagaatgctttgggaccatccaacatacagttgtccatatcaacatcaaccttgttttgcagccctatgtattaaattcaaaattatttgtatagatatgaaaatattgttttatgaagccatcaagaataataattcaggaaggcattctatcatttcatgtagttttgcaaacctctagcttgtattcacatcaacactccactgagttatagaaaatacgaagagcttatcagagagagcttccggggctttgagctgacttaagttgctactaggaacgagatggagactgcaacatggacaaagaaaggacacaggcccaatataatgtctacctttttatttttcacttatctacctatctatatatcatgtatttattgatcaattattgacctatcatctatgatccatctacttataatctataatctatcaatcagttttcatccatctatatatctataaactatctatatctatctacctacctatactataggtatcatctatcaatcatctattatctataaacctacctatcatgtatcaatcacctatcatccatctatcaatcaatcaatcatctaactatactacatcaatcatgtctatctgtatctatcatctacctataatgtatcaatcagcaatcatccatcaatcatctatttaaatccatctacctgcctatatctatcatctatcaatcatctgtctatattcatcatctatctatacatatctatctagaacttaaggatttctatatacacacttatgcagataaacttaaaatcccatatcacaacaggccccatgatcaggattctgccttcattccttatagctcaccactttcaatatgtgtatcagtcacaggtgaggattttaaattccccagatgggccatgctgtttcacagctctgccttcccatatgtggtccctggatccagagttcttcctgccccacacctttcttcttcagttagatatcctcaacctgaaattgttccccatgactgagctcaggcagaggtctcattaggaaatgcccctgcgccctctgggtggagacatcgccctgtgtgtatccttacctcctgcacatgcacctcaaaagccctattactctgtgttgaagttaccggttcatttctaatgcttgcagaagactaacagttaccagaaatcagaaactaagtctttcagtgtgaatccattaagccatgtgtttcatgaatgaacgaatgaatgaatacaactctataaggttatacacttttttctgaatttcaatattttcagcaaaaagtctataagcctattttcatttgctctcattctccaaaatgtggattcactctctctcgatgatatcaccattgtaactaaagaaacgagttttacatatttttagttcttgttaggattgaggaatggcgtgcaggcattttgatagaagaaaataaaatctgagaagttcttctgtgattagaaagaaagacgaggaatacaagaataggaattgcaacttgagagagtgctcggcctgctgtttaccaaaagcagattcaaacgtcttcacatgagaagcagaactcatgcaatttctgggctgtcttcctccccagcaggatgctcctggatgccacgctgccgctcagaacagttagtacttacactgccttttcagcagcttcatggaagaatcagcaaaaacagccaggaataataggaacccaaagtgcaatgcattagggagtgaagacttaatcaaagaaacagcaaagggaaattgaaatcatcataggcaaggagtggaggtaattacagttataaaaatggtttctgtcctgttccacataatctttcttgctacatctagatcctgaaaatcacattaagttgagaggcagaaattattatgcttccatataataaagattagttaaaatgtgcccacagatattatatcatcagataacagatgttttatctttgaaatttcaattttaaaatgtgtgcatgggattgtgaataaacaaacagggacaggaaaaaactgaaatagtaaatcggcctggttaaggtttttagagtgggcagcagtataatttttaaaattgaagatgtactcaaattgatataaatagaaaaaaatagaaggatttttgtccagaacatcttattatttcaaggctttaaaactttgcccaccttttccaattacacttctattggatggattgtaccttcgtgaataaatgtttggaggtagaaattcataagcattttaagtagacctacctgtgaaacactttatttgatatatttgtcaacactaaattacctggggatgcattttaattcaagagctagttatggacattattaaccattgtctatgactagtaaatatttcactgtaattcattaaacatcaatgttaataggcaggacctgataaaacccatattggaattgtctatatgtgttgtccctaaaacacactcaaataaaatatattaaatggattttataacagctttgctgctaaataaaaataatacataaaacactattattttgactaggttttttgttcaaattattattttctcttgtgttttattttctttaaatgttatttttgttgtcggctctggtggctcatacctataaccctagcaccttagcaggccaaggctggaggataccttgaggtcaggaattggagaccagcctggccaaaataacaggactctgtctgtatgaacaattaaaaataattagccaggcattgtggcacacacctgtagtcccagctatccaggaggctgaaggtggaggactgcttgggcccaggagctcaaggctgcagtgagctctgatcctgagactgcattacagcctgagcaacagagccaggccctgtctcaaaataaataaataaataaaattattttttataaatataaggacaaatctggtggtatagtcctatcttcactgggggataccatattcatggactctacaagttactttccactgtttgtttttgtaaaatagtgaaagcacacctgctgggacttgatgtagtgtattctttactgggaaatatgacaggttgaagaattcatataaaaatagtgtttttctctatgatgagtaatactaaggcaaggtattttcttatgtgttggatgaaaagagatttacaaagcacagaatggtgacaaaaaaaacaatggctagtaacttacagtaccaaattcctctttctgtcagcatgacaaagaacaaagataggaaaagtcccctaaataccttggcagtgtcagagtatctgacggaggcatcaaataaaagcacatgaattatttcacctcatttaaaatagagcagtggtttctttaggggtatgaacgatttcttgactttacgcctgagcagagtaagataagtgtgatctgatctagagagaagtttctcacacagtggcgcgtgcacacacacacacacacacacaactacaaagtgtcagaattttaatcacacaggaaatctacattcgaagctaaaaaatatatattaacattacaattttcaccttgcttgtttttcctctttcccaaatgtcagctacctacttatctaaattttgtttttattaattttaatctgttttcaacagtagttttattggcctttgtgactcatcctccctcatgcaatctttgtactcaaaaatagttagaataatattacatcaaaaagtattaatttccaaatgattaaaattttatcccttttagtagcaacaaagaattttaagttaataattaaaaatacccattggtgcactgatgtcagaacataatagagttggggaaatatagaaatagtcagaactgttgactttgagctactagtgaagctctggagtgactggtacactagaaaatggatttcaataatttccaaaactctatttgttggactttgcagagtgggaaatttgacaggaaaagtttaactgcaatgagttcataaatgcaacatttcaaagattccaaaatgcttcccaatacagctgtcctatagttattacaaatatgactccatgcccacttctcatcaacaagtggcatatgcatactcacttgttctctagtaaaaagacaaacattttcacaaatggtttgacaaaaaactgatcgatggtatagacacctggtgactacccagacactgtgctgagtatgacagggatattccctgccctcacacagttgtcagtcttatcgggaaaacgcatacttgcataaacatttatacaagcacatttacataaacacgtagctgtaatcagtgcttgaactccaggatcaagcctcatgataatggggtggaaagaaacagataatcttctcatgataaattcgatctgaaatctgagaatgggaaggttaaaaagtgtgtggcctgtgggtcaagaagtgcaggggaatgcttttttatatttcatatttttggcaaaaggtgccaaacattattgaaacaggtgtaacgtgatgttactcagtggttttaatttgcattttcctgatgattactgacgttgaacctcttttcatatacttgttaaacttttgtgtgtcttctttggagaaatgttattctagtcctttgtccatgtttaaatcaggttatttgttttctttctattgagtcataggaatgttttctacgtgttgtacattaaccctgcatcagatgcacagtttgcaaataattctcccccctctgcgggttgcctctttattttattatttcttttgttgtgcagaagctttttagtttgatgccattcatttgtctatttttgcttcttggggaaaagaaaatccacgtacactgttggtgggaatgtaaattagtaaagcaaatatggaaaattatatcgagattcctcaaaaaactaaaaatagaacaaccatatgatgcagcaatcctactgggtatgcatccaaaggagaagtccatatgtcgaggcggtatctgcaagctcatgtctctagcagcactattcattaatagccaagctatggaaacaacctcagtgaccctcaacaggtgaatcgataaagaaacgtaatctatatacctaatggagtactattcagcctttaaaaagaagacagtcctgtcatttgtgacaatatgaatgaaacagacatcacattaaatgaaatgagccaggcgcagaaagacaaatatcacatgatcttgcttacatgtagaatctaaaatagttgaactcaatgaagccgagagtagaacggccattaacaagggctgggggtgagtgggaaggaattgggagatactggccaaatgttacagaattaaaatcagaggacaaggaataatttcaagtgatctattgtacagcacagagagtacgtgtggagtatgcagtgtactgcctacttgaaaactgttaatagagtcgattttaagtgttctcatcacaaaaaagaattcacatgtgatgtagcatggaagtgaataagctccactgagcaattccacaatgtatacctatttctatcaggttgtgtaccataaatatatatacaattttgatttgtcaattaaaatataaatttaaaaaaagattgggaaaacttgaaaaatcttcagagtagggttattgggaagattgggaaaactgaaagatccatgtgcctgcactcccgtcagagaagacaagagctgaggtaggagaaccgggcagaaaagttgcatgtgaactaccgggggctgctgaggaggtcttggctccccctgtgagagcagggaggggtcaggggagtgtgggaagcaagatattgactgacctatttcctctttaagaagatcctggccaccctagtcaaagcgtatttgagaaggacaagaacagaaatagtgtgagcagttaacagtccattgagtggaaaatgcagagtaaaatgatatggcttcaatctgaattattttctgacgtgcccatgtaatttcacatttttaaaatatgcaaattgagtggaaatatacagttatattacatgagttaagaaattccaattatgtgtaaaatatgtactttgattctctttaattataaatatacaagagttgggaagggcatggtctgtgtccccactttgtttgctaacctaggcacttgaattagctttgcagaaatcaaactgaaaattcatccacacagtatcaactagcctcgtgaagtttagagaggcaggtcagtgttttgattctgtttatttctgggacaaattctcacttaggcattagaggttcttacgttctttaacacataaaacaaaccaataccttacaagatcaaatcaaccaattaaaatatgcatgttttgctcacaaatctccagggtagcagcacaggtggtaatgcttcaacatagaaaatgagggggcaaaaaaattttaaatcataatctctgtaccatgtgtcagcttgtaccatgtgtcaggtaaggcttagaggtcatggttaaaaattgttttttcttcaggtaattttatcaccatttctttattctccaagaggagaagtgtttgggcaatatttctttaacagttcttagatctagatggatttttcaaatgtattttttcttaaagttcaagaaagagcgattaattttgagagaggaacaatctacacttttcatttctgttattatttttgtaatctgacagataaaccatctcaaacataattatattgaattttggagtttgtctttcgcctctgattttgactaattggttttacaataaattggatcactcaataaatattaaaataaaaaacaaaaatattgtaacattcattcttgtttcaaaacaacaaaacattgtaacattgtaacactcttttgttgtttcaaacacagtaacattctttgattcaaaaagttattttgatgtaatatactttgtttttgtaaagcacacgcttcataataaatgttttgagtactaaaatatgatattcaaaataaaaatattatcttttgatggtctaagatatttgtgacattctgtaccaacagtgtttatataggaagccatgttgtacaacaagtgtgccacaatttcaaaaaagcaagaattgatcttcagaatcaacagttatctacacatgtaacttgttgtgtttcttctgcagtctttgtcaatttttttcatttttatcctgttcatggaaacaatcagttttttttaatttttaatttttattttttttgagacagagccttgcactgtcacccaggctggggtacagtaccacaatcacagctctctgcagcctcgatccctctagctcaagcaattctctcgcctcaacctcctgagtagttgggaccacaggcatgtgccattatgcccgactgattttcaattcttttgtagggacagggtctccccatgttgcccaggatggtcttgaactcctgagctcaaagcaatcctcccacctcagcctaccaaagtgctaggattacaggtgtgagccaccacatctggccccatcagcaatttgatgatgctaaatttgcaaacacaacagtttttatctgcttcttccagtgagtatgtgttgtttttaaaagtcatttaaaacctgaatcaaatcattacagtcttcaaaattaccctgggtaaatgggattgtctggctcttctactttaagaatctctcttcacttcctatttttacaggtaacattccacaattcctaaatattctcttccaatcaaagtataatatactccctatttatttttcaagtcacttattttcatccacttttgcttccttccccccaacacacagacacatataaaccaggcttcactcttattttttccctgttctgaaatcacttccctcttccatcttgataaaactatgattcaaaagaattcctctgtgaattcttgcctaactctgacagatagaataacccattgctttctcggtacccttgtagtttgatgtttctttgctgagattactcttatcatgttgtactggaggaattcacagttatctacatcatgcccaaccaaccatcatgacaaagacagttttcacattttaaaaaatattttaacttatatttgttaaattcattttttcaaaatattttcctctattaaataatgtacagattagtaattctcacatatttaaaagtgtgacttcactctaatgactaagtcatcaagaactaatgttccaatatggatcttgccacttttcaccatctatccactaaatatacacatgtgagtcaccgcatatcacactgtgataggcagtttggcagacacagaatcagtggagaatccaataccgaccttcatcaacacagacagggagaaatgacatacacagatgatgtagctagggaattggaaactgcaacttaaatgaagctgtgataataggtgttaactaattcacagatagtgggacctttatttgtatccaaaacattctatgaaagctttttggaaagatataaacattgaaacaatggtttggattaggttatagatgatgggtgtgcattcaggattgagatagcttaaggcagcttcccagaaagtcaggcgctctcaggactctgttgagagtatggctttctttgaggaagaccaaatcaagaaatagtgagacatgaaagtaattgttcataacagatgaagacaatgactccatagattttacaatttgaaggaattagtggaggattaatttcacttctaatcagttagtaaggtcttcattatgtataccgttttcaaagcacatttgcactttatttgaaaatcatggccgggtgcagtggctcatgcttgtaatcccagcactttgggcggcccaggcgggcagatcacgaggtcaggagatcaagatcgtcctggctgacactatgaaaacccgtctctactaaaatatacaaaaaattagccgggcgtggtggtggacgcctgtagtcccagttactcgggaggctgaggcaggagaatggcgtgaacccgggaggcggagcttgcagtgagctgaggtcgcaccactgcactccagcttgggggacagagtgagacaccgtctcaaaaaaataaaatgaaataaaataaaataaaataaaataaaataaaatcatcacctctctgtaaccaattacctttataaatacctttaaacaattaaaaaatatatctcatatatcaaatgaaaagggtgtgatgatttatactatgttgtccaagttatcctatctagaactttgcagactgaatcacatatctgttccacatgtcattcctaaaaacatttgaagatatccatcatgatgtgataagcaaaggactttggtaagttactttccctgaaaattgcatgttagaaaaaatcccttatgaacgaagatttgacagcatcattattcagaacaaatcgaagccaagatagagccataaataagtgtaagagcccaaaacgcttaaaggtacgcagaattgcggtgatggagggccgagctggatattgattatggaaagacagaaaatgtattaagggaaagaaacatgacaagacatactggcggttgtatttgagtagtaaaaaagacttgggaatcaaaataagctggaaagtctggggaaagaagtgaggaagatgtttgatagacaggaggaagtttggagtagaaggaaaggcagattcaagtctaaattctgctgagttttaggcatctgaatatcttggaagtctcatgaaagagaaaaaatccacgaacttagatttggaaattcctagtgtatgtaataattaaagaccaaaagatgatagaaagtagagcgacctcaacagagctctgaggattctatactgtgagtattatggagatcaatgcaaagtttacagagcagaccaagagaagaaagctagttatcagtgagtttgggtttaaattataagggccagcaaaaatgctcaacacactattcagatggttgtaggaattctcttgaaatactttttgagatataattttcattctttcttgaaatcctcatttgactaacccagacaccaaacagatcttgggaaagctgaaagaacacatcagagactcagactcagaggcagttactaaaaggagtctacagtccacctgaagagacaaaataaatacacaagaaataaattgaaacattaattcaaaaatgtatgcggactggccaacaagcatatgaagagatgttcgatattattgatcattagaggaatgcaaatatcatcacctcacacccacgcagatgactactgtcgaaaagaaataaatcaataaaaacaaaatagcaactgttggcgaggatgtaaagggatggcaaacccgctgcactcttggtgggaatgcaaaatggtgcgtggtggctactgtgaaaaacagtatggtgattcttctgaaaattaaaaataaaactgccatataatagaggaatccacttctgaggatatactcaaaacagtcgacatcagggtctcacagagatatttgcatgtccacgtgtgtatcagagctattcaaaacagacgagaggtggaaccaacccgtgtcccttggcagatgaatggataagcaaaaggtggtctcttcacacgaaaattatttatcctaaaaaggaagaaaatcctgacataggctacaacacagatggacctcaagcacaatataatcagcgtaattagccacccacaacaagagaaatactgaatgatcccaaatacatgaggtttgtagagcagtgaaatccttagagatagaaagtagaatggtgattgccagaggctgtggaagggaacatggggagttactgttgaatgggaacagagttttagttttgcaaaataaataagtcctggagatggatgatgtggttgattgcacagccatgtgaagatacataacacttctgaactgcctgccgaaaaatagttcagatagtaaatttcatattatgtatatttttaccgcaatttaaaaaaatacatcccagcattttgggaagctgaggtgggcggattacttgagcccaagagttttaaaaaaacaaaataaaaagaggaaggacatgaaaaaaaaaaaagtggtactcagtaaaaatgctttaaaaaataaagacaagaatagcctcagtaaatctctggataagaaattctaagtgatgtattcaaggtgataaagtttgaatatttgaattagttttgggaaaggagacttttttcaagagaacttggcattaacaaagacaaagagaaaactaattacagcttttggagggtacaaggaggagatgatgccacctggagaagatgatgaatactggagaatggtgacggatgaggttaagtaggcagcagaacccagttttggagagtccaaggtcacgccttgccactgaaactagcaggatttggcagacaatcacagaaactcctgaataatagcattcactcgaagaaaacagaatgttatcaaactccgctgggagctatgtgcaagaaagtaggacatatcagaggctccagaagacacggtagagacctgtaataagaaccagtgggctcttgtgaacatcagacttctcccgtctgctgtggtccttcagcattgccgctggcaacgaaagtccacttgcacacccagctgtctctacgtggctctgagtccaatcgggttacagggataacttcaaaagcagtttcaattaaaaactttgatactccgtgttgttttggtctgactcaacatacttaatttatggatctaaatccctgtcttgttacgttctcagagactgatgcttttggtcttgtgagatgaagaaagctttttcccaaaactaacctcaatcaattaatatgactaactgaaaccttaaaacaatttttgagggtgctttagtcaccattgagaaatgcccccacctagtgatgaaggaactaggtcatcggtcattgtccatgaagatggctttggaccgtgtgttgagtgacaggctggtctgcccagtgaccctctatggagactaccctccccaggtacaatatgacagccatccccccagctgcctctaaccaggcctgaagcatgtccttatgaaggattctgactctgtataagtgaatagaacactaaattctaggcttatgtctaaggaaggaggtactaaatttatgccatatttagaatctgactcccgaattaaaaatgaagcaatgtggtaacaattgtattattcactcactctccccaaaggttgaatatgtgtagttggtgtacagttcagcatcagtaggttcagttataacaccaatgttactggcttcactacagggaaataaattagactgtgattctatttaaataaaacatgcctccaattacacatttattttgacataagattttaaatcatagccatgatttaataatcagaaaatatatgtttcttttagaaagacagagcatatgtacatacgtattttaatatttcactttcttcatatatattattttgaggagtcagtaatcaatgtctgtaatccaaatgctaaacaatcagcaaaataagaactttcttttaccagtagtattgttgcaaatgctacagaatttgtaataggataatccatttgtagttacatagtcatctataactacttgtatccatctgtgcataaatttatatttaacacaaattcacaacaaaataaaacagaaaaatatgttaacagaatacattcactgctgttatctactttttaaatgttgtctgacttcaaacagtgaaatttttaaaattaccttggcaatgatataataaactcaggaaacctataagaccatttggtagtttggaaaaaggtcagttcttctcccagttaaaatgcataactaaccaaattctcagcactaattaatgggaaattccctaaaataattaattatgtctaagaattaccagtttttttctcacataggtaagaaatgtcaatatttgacttgtcatctgtccagatcatcaacaatgagaaaatgagaaccatgtggtaataacatcaatcccacatgtggtcagaaaggtggcatgataattctctgaatataaattaacttgtatgaaaaatttgaagattttcttcccctacatgtaaacttacggcattcttcttcctccccccagtgacagataaccacttacattttgggttgatcattcttggcattgaaaaataaattcatcataaatatattttgtctaaagtttgtagctgagtttgcttgcttgatacattataaaactagtgtcctacttgaatttgcattttttcaaacaaaaatatgtttctaaaactcatcaagtttttgcatatagctgtgttttatttatcctcactgctatacaaaatatcattttgtgaacatattgcaaggtgtgcgtccattctcctgtaagacattcgggtaattcttgggtgctttgtgcgtttattcctattgttttctttttttaagatatccataaaaaaatctgctgtatgaactttcttccacatgtcagcttgtgttacacattcacttttctgtaggaatgtagataccatagtagtagaatttcaagaacattaatttttttttaagtgccaattattttccaaatggtcgtatcaatttatactactatcatcatggtacaaagtttcctaatgatcaatttatttttacctctcgctattgctacaggtcataatatatacgagtttagtaggtatcaaatagtatcaaggttttaattttttatcgtctttaccattaatggggttgaatatttttataatgttaggtatagttgttattttgttttccttttttgaagtgtcaattcaaaatatttgcacatttttttcttagaataattgtttatatattctgtactagttacttgccagtcattcattgggcatatctatctattcctgatttgttctttctatttctttcttatccagtaatcttgatgtctgcatttatttagattgcataatgaccttcattaaagtttcataatcttgtgaatactggttttgtaaatctgctagaaaatttattcatagtacctttatgtttcattcttattttcaatggtgtccttctcaattacattataaaattatcactgaaatatagtattataaatatgttgctaggttgctaaactcatatttttaaataatttgtgtgtataatcttttgaattttctatgtaggcatctgtaccatttaagaaaagtgatagtttagtttctttctttataaccctgaaagtcttaacgtgtttttatattcccttattcccctagaatggagctgcagcataaggatttttagaaaaggttatggtgtgaatcttttcattccgattttagataaaagaccatgtttttacataaaaataatgtttcctgtggatttttggtagatataattttagatgtactttatatagcaaggctgatataatttatcactttaaggaagcctccttctgttctttgtttgctaaatgtctttatcctaaatgagtgtaacattttaacaaatgcctttttggcttctgttgggataactttttttgtaactttaatctgtaaatgtggtaaatggtaaaggttttctgatgttaaactgcctttgtattcttaggataaactcaagtttatcatgttataatattgtcttaaataccattgcatttggtttgtctataatttttttagaatttttgcacctatcttcataaatgagagtggcctgggattgtccttttcctatggtatgcgtagctgttttgttaaaaaaaagttattttggcctcattaactgatatttcactttattatttgtaaatgtttgtgtaaaattgcagtcatctataccttcaacatgtggtgaaactttcctggaaaattatttgagtatgctgtattatttatagaaaaatattcaaccactgcctcatctaatttagtagttctcaaccaggggcaattctgcctcccaggggatatgctgcaatgtccagacgtgcttagttgttgcatgtcacatctggtatccagtgatgctgccaaagttcctgaaatgcccagtcaattgcccttccacatccccaaccaagaagcatctgaccccacatggcaatagtgccaaggctgagaaatactgcattagttattatgagaattttaatgggatcatttgggttacagttttctaaaaatgtattaattttatcttttcaaaaaaattgatatgaagtttctgtggcatttcctaaacatgtactcgaagcaatattgagcatatctgaaggacaggatatatatatagagagaatatataaggttagttcaaaagtaattgcctggcaaaaactccaattacttttgcaccaacttgagtgtgtgtgtgtgtgtgtattctatctacattgcaagaatattttaaacagttaatgcaaatgttttttatctaattggtcacgactattgattgagattaaagcaaaacaccttgatgaataatggcacagggaagaacctagaaataatacctagaaatatttctctataaatatttataaaacatagaaatgtttcatatgataagattttaatatatgtctatgttcccatgtagcacacttttgtatatgattgtgctatcataatctttgtaccaatgtcttctgaaaagtatttgatgcttatctaattaaaaatacaaaattagtcatttatgccacacacatattttcattactttatggttaattctgattagtaagtaaatgattttctcaagtgacatttgcagttgtctttaaaagacagattttcaaaagttaaataagtagagggttaattcataggacaatgttacccacaaacaagcgtttttagattcttttattttaaataaacgactcaacttgtgaaaaagcagaacacctgcaaaataggataagaaataaatcagcctacatctattaaacatacactactttattcataaaaaagtaagttgtttttagtaaagcaactaactttttataaatttagtttctatgtaaaacactacacatttaaggaaaaagcaaagttacttttgtggtaatatttgtcattgttttaaatggccaaggatttccggaaaaagaattcagagtttactttgattacattggcaataaaaagagttggtcattgaataccacgcactttcaaacaatatagcattatttataagtggcagcacgctaagtcagacaatgaccgtaagcatcaccactcaaccactcttggtgaccattaggagcaccactcaaccactcttggtgtaccctaccttggcttaagaaaaagtaccagggtggcaaacaaatgtacttgtttaaagtaccattcttgacaaataactgaccaattacaaaacttggagacttgtggtaaaaaaaacaaaaacaaaaacaaaaacaaacaaacaaaaaaaattaatagagaagggacctatacataatttaacccccaagaagtagcttcaacaaatacaaataataaatgaagaatgagatttagacaatgtgaaaaaaatgtccatctttctgacacacaccctcctcttggactgtccccttgtttctgcatcactccttgccttaaatcttggtttcatggtagcctgcaacattccatatggtccacattaatccacaaagaaactgtctctttcctgtgtcattgctgataacgacttttagtctctgcctgaaattgttcacgctcagtctttgaactgcggacttcacaaaccatatttctattacttgagctatctctgctcttaattgctaattattctagccagtcaggatcagaggtgtgactcctttactaccttctattaaaaaaaaagaaaaagaaagaaagagggaaggaaggaaggaaagaaggaaggaaggaaggaaaaggaaacagaacagggaaagggaaagaggaaggatgggaggggagaaagagaaaagaaaagaaaagaaaaaaggaaaagagaaaataaaaaagaaaagaagcaaaaaaaaaagaaaaacctgcggggtttttttaatgcctgtgaatgacttctgggactgtgaaatgttttatctggatttcctacttttagtaaaaaatgaggaatccttggctgtggttctaccagaagaatctccctatattaataatgttactcacaatctttctccacccacaccccctacctttccttaatatctctggtgaaagatatttctgagccttctcctttgcacaagctgcttataaagatcaacaaagttaatacactgaaggaccaccctgcatatacaatgagctataaaatattaatgacattttatttatatatttagaaaaaaaaattattttttcccctaggcctgaaactggtgactccttcagagccaagcttctaaacatagtttatcttaaaaggttttaattatatatataatatagaaatacatatatatacacaaaatatattttacacgtaattgtaagcaaatatgctgctatattaatgcatcccaaatagatctgaatagtcttaatttcactaaatatcttgcacaaaataatgtcttaaaattatcacacacacctctcctacacaggaaaagtaatgtaatcaaaacgtaaataaagccatgtttgctccgtggagttaatttggatttttttctataagataaactattatagataataaaacgcaacaaatattataatcaagttaattagccaacgctttttgggaatgaaaacaaacccaataagtgaaactgaataatgtatgcgttgattcaaatgtccacacagtttcacacttaaaaattgtaaaatggaagagtctatattagtgagtcatacttactggatttcaattacctatgtctaaaagaaaaggcaaaatatttaaggacataaaagtttaccttttcatgaattacttaaattctattttttcaatactttaatatgatttttaaattttcactttaaaattatccacactatgattttgtatttaattcacaattcacaattagagcatagttgatatggtgattgtggtagaggttcaaatatggatttaaaaatctatcagaagcaaaacatggaatacattaaaatgagtattaaaatgagtatatcaaatattgagagattcctttatttttatttgaaatttcctgtaatttcaatttatagcttacatcctaatgaaacaatacttctacacagtaatcagcgtttttaataactctgactatatgcaggtaagcttgttggatgtagactgtgatgttgttaacaaatgtttttgaatgaaatctatactgaactgattcactgctacatactacaagacatggcagtaattgatacaaaagtagaaggctgtttttattccacatccatgcattcatacttatactaaaggttttccacatgtgagatgagagtgaccattaatacgtgagcagatgttaagacaaaaaaacattatagtccttaaaagaaatatatattcaaatggaattgtaacagttattaactcaaattaactgaatttaattctcaaggtagaagatacactcaaagtataaggtagcactcattgtaggaggaaaatcttttatttcctaatgagttttgctgaaaattttccagccttatcttttgaacatatatttctaaatagcctaactaaatcagtcttttagaaagtacaatatctattcacaattgaacttgttgtaacttttcattaacagatactaaatcctgaatcaccatttatggaaggactatgcgatcaacacatgtaatcaatatgaaggacaaataaaatcattaagattaacactatcacttcaaatactaaataattgctttataaggagcatttctggatgaacccaacatcgtccacggtggcaagttatgtaacttgaactgtgcccttataaacctttatctcaatttgtttctcactgttgagaaacgattgtcaactagtcataaaatttagtaaagaaaaaaacttggcaatactcatagaaatacacagaagcagtcagaattaaatgttattcacattaagaaaagaattatcaatatgctatttttacatgttgctaaatttgcctgttccaagatttggatggagatcaatacctgtctttctgcaaggctaattctctctgtctttggtaattttcccaaaatgtggtttgtgaactatctgccacaggaagaattatctgggatccctgttcaaatgcaggttgcaggactcaaccctgggcttagagattggactacccaggagtagggatcaagggttttgatgtttaaaaagctctcctggtgcacctaatgcacagtaaagttaagaaatactaccgagattaccagaaacacagcagcaatgaagacgttacccttcccacccacctgttaaaaagaattgagtgcttttctttctccaaattcataaacatttcttccatgtatcctacctgtgccaatttaaacacattattttatttctaaatgccaaagagtaggttcaaataagaaccaactatttgccatttagaaataaacaaacagaaaacacattatgtgttccctaacctcaaggagctcagagtttaagaaattatttttaaacaattaccaattacgatatggtgtgataagtgttacaacagaggtgcaaataacaggttttaaataaaggaagcttgttatttaaaaaggtgatatttccatttgtaactctaaagacacattttttgtgtgtgattgttttctgattgaagctgtttccaggttagcactcccaatgctgtgcacaattgtatagctgacaccatttattgatttgaatgatgactgaaattgatcacgtggcacaacagaatagatgcattccacctcaattcatctatagattttatttttttaaaaaatatgtttaaatgataaacacattttatctacttagaacttttatactttctaaaagaaggatatactataaaataaaatcctaccaaaagcaaatacccaatgtgtactcatctgaattcatgtgtgtgaatgttccttataagctatcataaactacataagcaccatggaaatatgcagagactggaggataagagcaatattaataataactgctattacacagaattacggttttccatacttgactttaagaaaaaaattctcattttctcttacttttgcttttggtgttgacaagattacacatactaactcataacttcaggaattcagagtactttgtttcaaaatacctgattgaaatgatcagtgaaaacatgtttctgtttgtctgtgacacttttatcttttagaatgttcctgtctaatttttctgggttttcaatgttctttcttagacgagaaagccagctgattttctcgggacatccattgctgtatgtcagtggctctcaaaataggctctggaacaatcgcttcagcatcacagaaatggctttaaatgggactctttggctgcacctccagttccctatatcagaaaccctctgagtgcagacctacggggctgttcccgttggcttctacccattcgtgtgcacagaagttttcagaaatgttgcaatgcatctttgaaacacagtcatccttaaaaaccaataaagttgcataaacttgtaattaatttgtattttaaaaactaaggttataaatacagaaaacagtacttcccatgcattttatgactttttattatgattggtgtctttcatgtgttgagattattgatgcctactgtgtctgtttggtggatgcactacttcgaccgcaactctcacctctcttttttttttttattgtgagacagagtctcactctgtcacccaggctggagtgcagtggcatgatctcggcacactgcaacctccgcctcctgggttcaagagactctcctgcctcagcctcccgagtagctgagattacaagcatgtaccactacacccggctaatttttgtatttttaatagagacgggctttccccatattggccaggctggtctcgaactcctgacctcaggtgatccacccacctcggcctcctaaagtgctgggattacaggcgtgagccaccacgcccgggccctctcttccaaactgcatgttaggtggtggcgtaacagtaccttcaaattggccaacatgggaatatttaggtcgtagaaattggcaaacactgccaatcagtatctttcccctctagaaagtagttgttaaacttcagaggcaaaaaattatatttaaaaagccatccaggcgattcagatgaatggctgagtttgagaaacgctgtgctgcgttctgtgattttcagtatctgaaggattctagacaactactctcagactgctccagtcacgtgctcaaagaccacttgctcctatcctggggtgacgtaaaaccacttaggggagagttatttggttatcaccctaagaactgctaattactttctcgctcataatggatgacagagttatcatttttctagagttgtttcttttctacttggggccactggagatttgttttctttttaagttgttcaacacctttacagccctccttactcgctatttttttttaatttaaagtgacagaccttgcatagtctcataattttaaaacatttaatagcatatgaataataaaaataattaacatccactataaatgtatacttgtttaccgtaagataggatgatataagatgtatatatacacatacattttcaagatattataaaattcatatgtgcatatatttaatatacatattaaaatatattttaaatatattataaaatgcatatgtgtataaaaatatatgttatcatatacacacgtattttaaatatattataaaatatatgtgtatatcataacatataatatatttaaaatacatgtgtatatcatcataacagatatttttattttataaatatatgtaaatgcagaaaattactggagaaaatatgaaactttcagaaaacaaacaagttgatattcactcacttacagtatgatgaacttaatgttccaacaaagactatgtcaacacaagaggaaaatattccagggaatggagacttcacaaacaggacaagttcaccttccacttagattttctcctcccacctgttgcattgcttccacgcacctcctgcagaagtcagtgtgaactcatggtgttccctccacaccaagcggcaatccccaaccaggcgctctcatttttgtccacattcaattgcactggacacaagggaggaaagcagctatttgggaagcctaaccatgctcctgattcttgtgtctgctgaagcagaatcctaagtctagctagaaatgtgagaagaaattcaggaagaggaaacacattaatttgagactgttgccagatatgctagaagtatgaattttaaaatataataaatcatgaagagtaataaaagcaaatgaaatctggcaattaggtaaaaacagtttgtgacaactgaaaaacactgacctgtagacctaaagctatagcaaactgttctgcctgggagcctaatattactgagttgccttcaggaatcctggagtcaggcttgaaattctcaccccacacaaagggcaaagcccctaatatttttttaaacaaggaaagatgcgttggcagagaagagcacatttggcagtttgtgaaaaattatgttcaaaaagcaatgaaacacaaatctacgggcactatggtcggaaaccctatgtaacaggcgctttcttctttttgcctaagttctcttgatcatttcagggaagacacacatatcagagtagaaataactacttcttatcaacttttctgaagtgcttatatgagaaattcattgtgatatcagtgtctttgtagacaattaaaaataatcttgtgaaagatcctcatatgaaagaaaaaaatgcactgaagaaataaatgatgtttaccattctagagttaaaattaacaaaaggatataaaaactcattgctatagtaagattttttgtttgtttcttaccatgtctcttttcccattccccttctctataaggactcaccatgcttaatttaaaacgtgtacacaaactgactaggacaggggtgtactagctaagtaggtggatagtacaattggacaatactcagctcctgcagtcactctgccagcccctgcaatatggaagtgtggattgataaagctggtgtctgtaaggagaagtattttagtcatttacttgaagtactccttctgcttttctctccttagtaagatgttattttttccataattgtgtgatgtcaacagatggttcaagtcacgacgttgaggagaaagcatctttagcattcatttgataagagggagcttcatgtatttgagtgttcataatccataaagtgatgtctcaaattctatgaggtctttcctgtccttagaacatatgtttccctcaaacaaaatgttgtttcgatcaatttgtgtttaacatactctgtttccacattatatttttatagttttcatgaagagtcaatatattcaatatgagattagaaaaacaggttcaatgaaagtgcacatatttgacacatcaatttttttttaacttttacaaatatttccaattgtcaaaatcaagttaaaggtgaacatggttgatctttacccacctattttaaaacaatttttaagcaattgacatttcttcaaaatgtaagtctataataaaggtagatgaaggttaaaagtattaacagaaaactgcaatatatattgaagatattgaggcttacagaatcaagcactccatagttcagccagaaatattcccacagttaatttataagctcttgaaatgaatagaaattctgacagcttcttaagcaaggcagtgttctgagttctgctacaataataagctattcaagtatgggatctatgtgaaccagtctttctggttttgtgagttaccatggagtttttaagaataatagacataattagatttagtgactcaataaataaatgaagcttttatataagtcatcagtaatttccccctgtttcaaactagaagtgaaaaaagcggggctttcatgaagaaaatatatcccatgcttctgacaagtgtctaaaaaatgcatgtcctttagtcaaagaaagcaggtaatttattgacttctcattccttcaacaaagaggaaagaatatttttagaaaaaaatataagcagctgcctttgcttccttaggtcttgtgagaattacaaaattaaaaacaagaaacgtgaaaacttaaatcttaattgtatgctttaactgagattatcaagccatgctatatagtatatgtcatcaaatggaagatgatttcatctagagggaaatagtttagtctatgcttagttttaatatagatttttaaaggttatatgagaatttggaaagaaattgcacatatcactggtttctatgacacagcttccaagtacgttctgttcaacgttactgccatgaagcggtgcttgttatgtatttttaaaatggattctggggtcatatgttttggaaaagctaagtagatatgtaacaggtatgtttattgtaggaatttctgggaccttcttattcaacatgtacctggtgttccccgcatgtcaggtggcaatccccaaccaggcgctctcatttttgtccacactcagttgcactggacacaagtgaggaaagcaactagttgggtagcctaaccatgcacagagaggcaacgccctcaggatatcctgtttgttctatcttcaaacgtatccagaatccaacaacttccagctgctccatggtgaccactctggtcacggcactataattatcacccgatacctatctaactgctgtaggcattgagcaggcttcctggcttccagccttgttcctttctattctaatctcttctcagcgtattatctagcttgtctaactttgatcaaaaccctccaatagttctctcagttcacggaatgtcaaaatcctaatgaccaacttacaccagaagtcttcctgtacgtgacctttgttctgactgttgcttatttctagaatgattttcccagatatccacatagctaactacctaaccatttaacagtctctgtgaaaacatcagtgtctcaatgaggtgaactccctcattagaattgcaacaacaatcttccctattttctgctctacacttttaaaataacacttactctccttaaaaataggaaaatgtattttgttactgacttatggtttctctttgctcactaggatgcaatttcaacaaggcatatgtagccttcacagttactcagaacagtgccttaccaccattgggactctaaaaaaattgccaaataatgaatacatttttaggagggatataatgtgctcattacttctgaaatgtactagacccacaaaactctttttcaatatttctaaagatcactgtctcaggaaatcttgatctaggacactcagaagatgaaatacaaataatatcttgaaggaaatggaaaagataaactatacataacatttgtttaattttgcaacgcccctgatatatagacaagtgtgtttaatgttctgacatcttacttagaagagaataagaaatatcactatgatgatgtaaatttgagagagctggcaagctaccgatctcactcttctttcccactgttgaaaactactttcacctggcatgtgctggggataaacaaagtaccaaactaagctgaattccttgtttatgattcttcaaggaacaagatagatgtaaagttaagcgcttgtacatcttatgttaaaaagtatcctgcaatcttcatacacaatagatagaataatgccagtgcatacatacagtcatgggtgcatgcatccatacatccatatatccatacatatgtacatccattcatacgtacatacatacatgcataaattatttcttgctagttttagtccggtagtttcctaaaaataaaattgcaaattcctttataagggtacacaagtttcttacatctaagcaagaacagatgatcatctgttataaaatggtaaaactattttatcaaatgaattcatttacatcataagttatataataataaaatgtttatttttaaaagattcctcaactcctgaaatacaactatttacaatgcatgtggctgttacttctgatttcactgcacatttttaaacaatgcacttagcccatcttatctattgacatcctaacatcatagatgagcattttactctcttacagaaagattcttcctcttctcaccctacgaaatagtcactacactttggagtaaaattaacaacgggtgtttacctcattaggactataaaatccaagtcatttactatgattaacttcttaccttgaacaactttttgttttcctgtaattgatacatcttacttttagaatgcatagtattctgtgtaactagtgatattttccctaacacttctgcagttatataaaatcctcaaaatattttatcccatcaaacgcatccaaaaatggatccatcccattattccaccgaagacctcactcttagagccttttcaaacattctttcaacctgacctgattgcccctgaggcattcagtagaatgtttgtctcaacttcacttttctcacaggctctttactccttgaaatgtcctcttctagttgatttcctcaatacagtgaaacatattctccaatgacattttattcagcaccaataagtatccattagtttggctagtttgaaaattagttcctcttagaattttgaagacgttaaccattgttatctagtgctcatggttactgtgaaattctgtgccgttttgtcgctcaaacttttgtatgagctctattttcatccagaaaaaccctacaagttgtatagagtaatttttattgttttttttctgaaatgataacgtaattttatttggctgatatttttctgagtttcacaacattttcaatctagcaatttctgtccatttctgagactctttttgtattgtttgacaaatactgctaatctactttcttgttatttcctgttgtccacgtcttgatttcactttaaattttcatcattttctaacacgtgcaaaaattccttccttttttttccaatctattattttattcagttataacatttgttattgtctgcagatatttcttgtctttgaatgtcaaaatcctgtacatggatacaaaatttctgttatctctctgagattagtaataactttgggaaggtttttttgatttactccattatatctattttctttaagtttttgtcatgcatgtaagtatgtatttttttgttgttttttttttgtattggaggcttttacaactatccagtgaaacacaaaacaataatataaatgtaaatttctgctttttttttaaaaaaaaaagaaaaaaacaaatatttgttggagacagagactcactctgtcacccaaactggagtacagtgtcacagtcatagcttatggcagcttggaactcctggtctcaaaagagcttcccatctttgcctcccaattagctaggactacaggtgcaagccatcttgactgcttaattttataattttgtgtagagacagggtctttctatgtcgccaaagctggccttgaactactgccctcaaaggatcttcccacctaggccatctaaagctctgagattccaggcatgtcccatcgtgcccagcctaaattctgtttttatcttatgaagcatggaggacattttctgattagtttactataggattttggcataatcagatgggtatttgataaagcaccccagatgccagtatttctaatttctctgccatcacttcaatttattcagtgaagaatactgcagtctcttgctccatgtgggtggaagggatgtgcaagattgatggatgggcaagaacggcaggagaagccagtctagctgccaatgttcttgggatatggcagagagaggggacaaaaaattacactccttagtaaaaataatttcacttaatctccatttttagacctcttttgtgcttggtgtcctaaatgcagaggcactgccacttaattcctgtaaaaaataaatctatctccacttttctggtagtaaagcaggatgagagatgggaggagaacatgggttggcgctgggaaaaggatcgaagaatctagtgacgctatatacgtatttttcaaccaggtgccctgtttatagcctcccaccttactcctgcatggaactgcacccaggagctcaggtgttatgcctctccaggcctccgcaagaatataggcttatttcccatgggtggccctcctacaggcagtcaattgccctctgtaagctttggtaaatcagctgtaatcccttcattcactttatttatttacttatttattttatttgagatggagtcttgctctgtcacgcaggctggagtgcagtggtgcaatcttgactcactgtaacctccacctccggggttcaagcaatcatgtgcctcagccttctgagtagctgggattacagtcacacaccaccctgcccagctaatttttgtatttttagtagagacgaggtttcaccatgttgaccagcttggtctcgaactcctgacctcaagcaatccacccacctcgacctcccaaagtgctgggattacaggggtgagacaccatgcctggcccctcattcactttctacctcctagaaatagatttacctcccttacctgcttttgtgtctttcctattggtctttgtgtgtttatacatttatttttattgctatcatttatttcctgtaacttagatgatctcaggtggaagataatacgtgtagtatgaatttgcgttgaaattcctctgtgtagacacaggtgtctaaaagctcttctttgaccatacaattttaacactcaactcaagttttcttggtcacttaacaaaataacatgactttcatggcaacgtcaaaatggtaagcaatagaattattgaaattttcactaaccatgggagtagtcacccaatcatactagcctaacctaagctcatagaaatacctccactttccaattcctatcaaatattttatacacctcacttactagtattaaaaaaacaagctgatttcataccaaatactctataacatatagattgtcaaatcctaaaagttaagcatatggcacatgtgaagaacatataaaatttcttattatcttgatagctgggtgaatctggcaagacatatctggctttctgggtttattttattttttttactttctcaagtggcactatcttcatttttatcttcacattctttccaaagacttcaggaccaaggaggagataagagaaaagggaaatacattaatacattttagagcaaaatgaatgaatgagtagcaggcagccaggtatggtggctaacacctgtaatcccagcagtttgggaggcaaaggggggcaaattgcttaagtcccaaagttcaacaccagcagggcagcatggcaaaatcccatttctacaaaaagtacaagaaaaaaaataagccgggtctagtggcatgcacctgtagtcccagctacctgggaagctgaggtgggagaatcacctgatcccaggaggtcgaggctgcagtgaaacgtgatcccatcacaacacagcaagaccctgtctccaaaaaaaaaaaaaaaaaaaaaaaggaaggaaggaaggaaaaaaaaaaaggatgactagcaggagcacagaaccaagaaggacaagaaggactggagttaatcaatgaccctgaagcaggtggatcttccaaaaatacatttttctaacactctttaaaatcttctcagagattctccattctccaggttccagaaactcagttatggtcactaagccaaactgaaaaaaaatgaaaacttctttgtcattgaacctgacaaaaactcattttgtgaatgaaattgttctttttatcgtcgttgtccacctgttgtgcacccacgatggactttaataccagtcgtgtctgatgtaattgctccagctgtatttgatggttctggagcggagtttggggagcaggattttcagcacatcagcccttggtgaattaacctttctttgcatatgtacttgctacctattgattccttttgctttgggtcacttcttcacttcaaaaactgtcctccacaatatgcacgttgctttactttaaagaaggaatcaaatatatttcaaagcctctcaaaatctctattgtaggcaaatagcttatgtaatgtgaatatgcacatctgttctgaagatacaagcaaatatttgtagatagcatacagatatcatgagttatgtatctaagaaaacacacatgaagggcctctgatataaggattttaacacatttcagattttaaaaatgttcccattgataacaattagccaatacttactgagtacttattgtgtatcaggcatagttgcaaatgctttacatgtattacttcaatcaaagtcaaacctgtttatttaaagcaggtgtacacaaggtccccctatctgaatattttgattgaccactcacctgatttatttttcaattttatagatagatgagttgtctcagtgataatgcaggacatgtggattcagaaggatcagaaggatgactgagtctctgcttcacttcgcaatggggcatgtggccctggccaaactgtttaacatctttcagaaccagttttctgtttacttctttataaatgaaagaactgggtttgtccctgaagtttactgaatttcacttcctgtagctgtataagtggaatgaaagtacatgctcttagtctcccataaggttggctggatgttcaaataagataataaaattgaatgcacattttaatttttagagtgaaatactaatgattatttaggaaggaaaaactgcccagaattcaatctaattttatgagcttccagagacatctggaacaaaataaatgcatcttcatgttgattggaggataaacatgttaaaataaagaagatatatatttacataagtagagaaagataacttgaagcaggatgtgtatgtaatttgagaatgatctctcaacatgtgtgagcataactcaagtttacaccttaatcctcatatccagaatgcaaatcagactgaaggatactttatgatatgcaagtatttttagctgaacaatgacttttaccaatactcgaattgaaagagttccaggccgggtgtgatggctcacttctgtaatccccgcactttgggaggccgaggcaggtggatcacctgaggtaaggagttccagaccagcttggctaacatagtggaagcccgtctctactaaatatacaaaaaaaaaaaaaaaaaaaattagctgggtatggtggcacatgcctgtaatcccagctacttgggaggctgaggcaggaggatcacttgaacccaggagacgaaggttgcagtgagccaagatcacaccattgcactccagcctgggcaacaagagtgaaactccatctcaaacaaaaaacaacaacaaaaaaagagttccaaactatctcccggtatttggaacacatttccttgttaggctaatatcaaccatcacttccagatctcaatgggacacatcgcgaggcccttaaggggctgcagacatctgaaacccaactgtcactgtccatctgagagtgactgatgtgcaagtgtcacactgacatgctaaatacatttgtgattgagaggtactgtcttaggtaggttcaccctgtacaaacacagaaggatggtgatgaaatacaagttaaaatttataattaagttcactcaaattatccttctaataatttttatttggcaaaaaactaaaaaggactataaaattggatttaacatgtgtcttaatttaaaataactcagatatactcgaactgtaaaaatccaaagaatttattgcatgctgtcaacatgcccttcaaattactgaagttaattatgtaagatcatctttcccttattcacaagcacggttaaaaatatcaactaaagtgactgaagcattggcaatccagtgttgcaaattccttagagaacgtttgctttttacaaattgccattttactttatgtcattttgtacttctgatgttattgcatggcaggaaattgaccagacatcgcagtgttctccagtgggtgaaggctaattcaattagtcactgatttgaaatgtctgagcagataaatttgtcttaaaaaaaaatcagggttcattcaaaggaagagactccttgtattcggaaaataattttaaacactatgagctgttacttctcatttgtttgcaaagaagagcacagcagtaagtaaaaaatcaaagttggataatacttaggttgagtttttatcaattattctcttgtctgtagccatttcaggcattttaagttgtccttctctgaacaattagttttaagatatccaagtcttctgaagaaaaaaacaataatcactgccatgataaagccattttgcctataatacatattgataaataactacattagtaagcactactaaggtaagagatgttaagtctattaccagtgaatatattaggtgttctatgtacacactctcatgaaattactattccatacctatctctaaatcttaagccaatattttcccccatgcaaatttggaaattcttattaactatttttaattttaacagagttgtaacagtacctatacttcggttctatgttcagttcttaaatgattttattctctggttctaatgagcatgaatcttgcatacatttcttcctcaaatgttaataagtctgtgtgtgtgtcgttcacatagcattagttcatcaataatgaacttcttgtgtcatgtgacttacgtagctagagaactgttagaattcacagggtcgactgacccaaagtttaaaaggaagttgtaacagttgagatgacaactttacaagtcaaaggatgtgctgactcctgcagtaccataccgtgtgtggaagcagaacatttgaaactttccaaaatgattgaaaatgatgtatttttttttctaaataaagacgataggtagatataacatggtcagagattcaaattggcatcattttatataattgaatctgacaaataaaccaagccagccaaattagagttcttaggttagctgagaaatataatttgtttcatgatggatttccattcaaatatgaaagagaagtgatttttattaagcagcaaaaatacaaatgccatacttctgaaataggataattttttccagataattagatttttggtattttagaatcagggttttgattcatttttaaaaattcaatttatattatggagagctaactacaaagtctgccaatttcaccagttataagtgtacaattcagtgacattaagaacattcacaagattgtgtcaccatcaccactatccacgtccaaaactttttccttacccccaacagaaaatctgtaactgttaaaaaaaaataacacccaagcccctggtaaccactattgaaatagagccatttaactgcaaagacctctactgcatagattaagatataggaaaatgcaaaatgcaaaaactaatttccacctgcactactaaaaaccaattaatattttttatatatatttttttccgggcctgaaccaaaggagactctccataatcagaccagtttctctcccctccctcagtgctgatttcaaatattctatcaacagctagtgtggttcaaaagacttagctatctctgctttcaaatactaacctctaccagtggcagcagataaacgtttgctggtttagttaacagaccttaccatgtctcttctttaccaaaaataataaaaataaaaaaaggaaagtctggcagttgcatctcttctgccatttcccaaccagaagattaggatctactgcacaccgcttagtgctacacacaaagcatcagtctgtctctcgggttgccaccaactactgcaatgctcagcccaaacattttgtcattctctccatcactccatgaatgttcaagcccctgtgcttttgcacataggtttttatgaaaccaagatactgtcgcttctggaaagccactattcactctccagaattcatcctgaatgccaccatgtaggtaaagtgttgacagctcactgacctggtggttgcttttataatttgcaggacgaatggatatgtaccttattgtactttattataccattatcatgggattgcgtgtgtgcgtgtgtgttggtctcctgctcactgctatgctagtgacttgtacaacaaacctaatgcttagtaagttaatgttctataagaattacttaggcattttcaatttgctagggcaaaatattttacatagacattattaaatatcagaatattggcatttccttatataatgaggaaagcattgtaccccagataaaacgagatggggatgctcttgccaagatccagtagggcaagttagcatgcatcatctataggagccagttcacagaaaatctttctattcatattcattcattctctctctctctttctgtctccatccattcctccacccaagtagaagacaggccagtgtctaggaaataatattactcttatctcacaacagctcagttctatttttatctcaaaaagccaggttttattcaaatacacatagggctgtgcttttgaacatgttgttcattttgagcccattgatttcgaggtgtgtcaatattttggggacttggagggaagattcctgcggctggctttctcttccacactattgcactatgctccactgttttgatttcctgagaagacaatgaggctgctatgtggaactttaacactacctaatttaattgtttttctcaggcagtagtgaattttctctctctttacttaaacaagtaggatatagtgtcactacgagtgtatcaaaataaaggtagtttagagtttgagtttgaagtatactacggttaaaactggatgcaaacatgaaacatttgtgtattttacatacgtaccatgccttccatggtccgtatattaattatttctgcaatacctaaaaattgaaatgcaaatgaatgtccaataatagcacacagaaatgacaaaagtattcagtttcacataaaaataatatataaagtaattgtatgtaaaaattctatacacatttagaaggcatatcctactttattattggaggtacacagtgtagagggagaacttgacttcagactcgaatcttgtttcttactctgccattcattcactttgggagctgagtaagttgtgagtctctttgatctgcctgtaagtgatagatcatttgtctgtaaaatgggaataagtaaatgtggcaaggggatgtgtattaaagtacccagaacaaaaagattcaaaaatggtatcagcttttatgctaatgttatcattatttttatcttcatcaactttacaaacataattcatgaaagatgtttatgtgaccaaaatgacatcggtcatttatgagctccattataaccccattctcatggaatagaggtttcttcttaaactatatgatatattatggtaactttggacaacaggtggtatgaacaatactaatgatcttgatttttttttaccagaaatatctctactctttacaatgataggaagcttgtgtgacttaaacacatcataaaaacacttaaataaaaagttataaataaatagcctgacaaatgctatcttaactcaggacgtggattctgaaagagcaagtgtgcctgccgtggttctttttttgacaaaaccaaacaagggtcttaattttccaactacagaatctcaaaaccaggtaataccctagctctagtcatcaaaatcaaagtatggtagattttgaaaattttttcagtattttattaagaaaggaaagtaacgaagtgctttttatgtaataaaggttggagttaccttacaattccttgttaacatatgatatcagtgtgtttacagaagaataataagagtgttatttatggtcctttgtagagaaaaatctagttattccagggtaagaattgacttagtcttaactaactttggtcttaactatgtctgtgactttttttggatctcatttttttcatataccaaattcagacttcaaacaatctgaaccctggggtcccttccaactctcataatctatagtttttgaactcaaaaacaaagcatatgctgacataatgatattaatgatatccagtacctttaagttgataaagtggttaaaaattattttatataagcctcttataaatgctctcaacatggattttctacacattcatgcttaaatcatgaattaactctgatactaaaaaataatctcaacaactctatggtaaaatagaaaatacttataaagaaatgtttagaagaaactcttttctctaacactacaataattcaagtttccataattctaaccttctgaaaggaaagctggcagacaggtggtatttgccataattattataaaactaaggaaatgatgaagaatttatttttatctgacataatttcttgagttttaagccagaaatatatttagcagtaggctatgtttaccacacattcaaagactatgatttctaattgcaaatgcatgcatcaaaatgtatagtcttattcttacttccttgcacacatatgactgagaactattctgaaatatatatatatatatataatttgcttctatgattacattcttcatataaatattaccaacttttatgtcctaattcctctaaaattaatacaattctcattattataagtagaaatatagaatttaaagataagttgatttgtctcattaattttaattcaggaagaaatggactgtaatccccttttagctcagaaatagtagtaggtgatgacttaggacattttctataaaataaactcattgggagcaaacatcatgcatttgaaggataataaacaggtgttagtgatcaacatttatcttcaaagcagcagccaacaattgaagaaagtcttaaagaagtttagggaaaaagccaaggtgaagaggtaagcgataccatacccgttttcaagtatgttcaagcctatctgataaaagaaagagtaatatcgttatacgctgcccctgtaggtagaaatgagaccacacacgtagaagttataaaaacagagacttcaggcttagtacacaaagatggaaatttttgtgtcctgtaagagtcacaaaaccatggaatgggacactgatattgttttgctctgtcaccaccaaaaatttcatcttgaattgtaatcccctactcccgataatccccaagtgtcaagggggagaccgggtgcaggtaattgaatcatgggagcagttccccccatgctgttctcatgatagcaagtgaattctcatgagatttaatggttttataagtgtttggtagttcttcctgtgttcattctccttcctgccatcttgtgaagaaggtgcctgacttccccttcacctgccatgattgtaagtttcctgaagcctcccagccatggggaactgtgagtcaattaaatatctttcctttctaaattatctcacctcaggcagttctttatagcagtatgaaaatgaactaatacagacactaagcaatattcaaagacaaatcgttgactttccttcaacaaccctgaatttaaaacttttgctttaggtaagaaatattgtttgagttttgaagattaccaacacattttccagctatctaaatgacaggcatcatgaagttaggagctaggtgttgtcttgttaattgctctatttcctgaatattgcccagtatctggaatgaagtgaaactgcataattacctgctaaatgaacataggtactgggacctaccttgtggagagtactcttgaaaatactgtaagttaactctccagcatagccgtcattttaaaaattaaaaatcacttggactttctgtgtgatttgatcccatcgttttatattttatatattttaaaagatgtagtaaagaaggtaaaataatgcatagaacctcaattataagagtgcttgggcaatcaaaggaaactcatgctactgtataggtattaaatataaaacacaccaagaaatatgcattaattatccaatatcttgcagaacactttattactttttagtgcctttttggttcctctcatcatattattgagagaaagcattttcttggaatttaaaatgcttgagggcagggactttatctcattcgctttaggtacatgataactgcacaggccttgacttataggcgaagtcaatagagttcattgaacaaacatttgaaatcatttcagtgatttttgtgaaatttacttataaatactatttgcttgtcctgaagcattactttccccagtatgggttttagaacattttctagctcttaaattatacattttcatttgataaaataaaaaataataccatagaaactttgttgaattctatagaatcctacagtttacttcagcttaatgtagtaaagactcaaaaacatctctgcaatcaaacataaaattgacttaaagtgttctctaatttcgtatctctacaaatcttccaaatgccattaagtacactctattgaagaataatacccattcattatcctgaccataagcagagctcttcaaggcttatgttgtgataatagacttgctgatgtgcatttatttattttttattcacccaaagatgtaaaagggaaacttagaattttatgtaataacttagctgttcctgaactgagtataggtataggaaaacccattattcctttcaaatcaacgtgacaaatccaacacaatcacacctggctgaaaacatttttctccaaagtctgtctgtttcttggaataaaaaggaaaagtaatttttacaaagctaagtcacttaataacaagccatccaaagcaagaaagttttagattagcctctctggaaattattttatttacttatttattttagacagagtctcaccctgttgcccaggctggagagtagtggtgcgatcttggctcactgcaatctccgcctcttgggcttgattcttctgcttcagcctcccgagtagctgagattacaggcacatgccaccacacccagctaattttttttttttttgtatttttaatagagatgagatttcaccatgttggccaggctggtcttgaactcctgacctcatgtgatccacctgtctccacctcccaaagtgctgggattacaggcgcaagattttatttttgaagagcacagtctcacaatgtctcacatgtcggttagcacttagctgcaatattaaaagtttcccttgattatctccaatatttatatttggagttgagatatatttaaatttttgacagaattttagcagacacaggctatatataaatcactacatgttgatggagaatgatcattacatgaaaattatttttaacataataacgtgagagttagttcaggcatacaatctttgaaaaaagattggagtcgacgttttatgtataacaaacatcaacatatatatttttaaaattctgtatataatagcaggaatatgcagttggaaggcatgtacaaataatggttagactcagagacctaagagtaagacagatgtcgaaggataacacctttggtctttgctctgcaatccacaatatctgactagaaggtgattttttgagcctcaaatctttgtcaggaaaatatgggatgataaaatacagtattgagctgtctcccaatgatgatgtatgttattaagcattataactatgttgcaactgtatcaactttcacacaaaaaaactatgatggtttatgttgatatactggggtttaaagagagagacaaagaattattcgacaatagattcaagtcgaaattttatatatgttagtctgtgagaaaatggatgtttttttctagagctctactagaaggcattcacatacagcaggctggggaaagaggcttctccccaaaatctgcaataaacatttatctaccaagaagggctaggtccccataaaaaagataatcaatgtgacctagtggttccagcaaattaagagggaaccaaggtcctactgtttttaattcaccacggtgacttttctttccaaagttatgaaaatatcagaaaaaaagtctccaaggataattaatttcaacttacgcttattaaagagaatatctgctgtatatcatttgaagagagactgtagattattgagttaaaagcattggcaataagaaaagaaaaagaataattgcacacatagcaagtattccttttacttcctggctgtaagcggccttattgaatgtgggctactttgctttaaccttctaagtatgtattcatcaatctgatagccactaaaaacagaagtcaagttatgtcagggctgaaagcaaaaggccaaatcacttatttttcagatgaaggaagtgaagcccaggaaggtcccaaaactggaatacagtggagtttggactagaaaccccatcctgtaggctccaggtacaagtattgcatccgaacaaaacaggtgttactctgaagtgaggtaacggtaattcaagaagtaggcaaagggctattaccattgtgagctcttcagggtttcatctgatgtgctgagacaatgaagacacggccaactgtttccataataaccactatgaccagttgtggaggagtcatgaatagtgtatgcattttttttgcaataatagaaaaaaacccagcagatactacttatgaaactcagcactctaagataaaccaattagaggattaaatagtatttcctatgttgctcacattggccatatgtgataaaacataattttatttactatgagaaaatctgcttgaaaaagaaataggtgtacaacagacactcaaccctttctggtttggactggagcttttgtttacttgcaggtaataatttcttaagcataagtgtcaataattggttgacacatgttctcacctattactgggataaacattggataaatatggacataagggaagaacagacactggagaatcctagagggagcagagagacaagggctgaaaaaccatctattggaccctaactcactgcctgggtgacaagagtatccataccccaaacctctgagttaagcaatacacctgcgtaacaagtaataatttatttacaaatgtatggagtagctacctcagaagttgcagctgttccttctctcagtttctttcaatacatcttaacataattatcttatctatttacatactacattaaattaatgaaggcattttaatgaaatataaagaaagtttgttcttaaatacaattttgacaaaaaatacaaaaactgacttcacaatgctcctataatattacgttgttttttatccttacctctgtggcatgcctagcattcaatacttacaaaattattgggactgatttgttgttagtatgtccaaaataatgcaacaatttataaacagcttaaagacaagcacattgtgtgctaaactcatttgctatgaccctcgtccaccctaaataggatgagaaggtattttactccagcatttttatttgttttaatataccccatgccatgtccagcatgtccttgctggaaatgagcttcactttcatggcaaatgtgatatggtaggtatatgacacatcacttcctctcactgatatttttattaaatattcatttaagtaagtgccactttggggcaactgtgcttaaagaaatatagagggacattgctggtcagctataaacataaaaaaaaatcctccagagcatcaagtgtgttctgaagcagtggaatgagggcagatgctgttgtctttctctcctaatagagcaatttgtcagatgtctcccatgtgtactcgaactgaccatattatgtgttggcaaaatgctcatttttatacagcttttagtatcaacagttatattggcgtttctctcaagatggagcacatttatatcaacagctggccttaaaatgttcctatagtaatgatcatttgttttgaacttttccttgttaactattttctgtttatattaatttatatttaattgaatacatattcccttcaataaaagccaagtgagagcaaaactctttctgcaaaggtaagactgaacttaacattcttcctgaaataaggcaagaagggttatacgcccttctaaccttgattgaaaacgcagcagcacttaccccaggcccactgagcagctctcctcatggcacaagttgaaaggatttcaggctggaggagactgttgtgtgtgaggggtgggtgcatgtccacggactcatgcacattgggaaagaaggtctcatctcttctgggctttcttcacattggcatgaaaacgtaaattcacagagctccctttgagagggaacacagcgcacagtggctggctccagcccgcctttgggtggatctcactgaaatcactctcctgaacacgcacccacccacagctgctgccttaccccacgtgcagacccagatgcctcactagttgacataattgttaagtgagcgcctcctaaggaggtcccatttgaaaactaagtcactaagctacaaattaggttgcaggcaggttcacctgctagagatgaatgcattgaaagtgaaagacatttggcatactgcagcgcttttactgaataagtatagggctggcctgataggaattgactaagcacagtggaagaagacccatcatcaatacttaatcaactcattcattcacacattcgaaggtgtccaatacccaagacctcacaagctatttgttgctgagggtcctgcacaggtgctgtatttacgaggtttccctgttgatgtgtgcttggccacaatcgatgtgagagagatacacattcacttttacagccagactcagcatacctgactttgagaagtgtgtatctcgatcatggccacgtgagttctgggtagcctattccaaaggtctcagtcacgtggccctggaagaaacatctaattttcatgtcataatttgggatttatttttatattataacttgggatctcacagatagagacccaaccttttaagatataattgcaggtgttcaaaggggggacaggcaggtggaggtatagcagctttttcaactcaagggtccctctaatttgagtcaggacactctaatcttggaatctaaagccagaaggaaaaagccagatcacactgactgccttaacattattaagccctctatgtttagtttgggtggagggtatgtttaagtcaaagaattgggccctacttatgttaaagatgttaataaacccagcatctttgatttcactaaccgctcctcaccttgaaaaagctaacagatttactatattgccaagtaaataaattaactatgtttttcaaatggcttcactgggaattcacaccatttaaaacactcaaaagtagcctctggtgcttttttgaacaaaagtaagcagttagaaaaatatatgggccagacacggtggctcattcctgtaatcccagcactttgggaggccaaggggaatggattacttgaggtcagtagttcgagaccagcctggccaacacagtgaaaccccgtctccactaaaaatacaaaaattagctgggcatggtggcaggtgcctgtaatcccagctactcgggaggttgaggcaggagaatcgcttgaacccaggaggcggaggttgcagtgagctgagattgtgccactgcactccagcctgggcgacagagctattgggaacagtcagcacaaagacattaggatctttagaaaaaataactctggagaaagtagtagcaaaccttaaaaatctactttgaagagcaaaatttcctattatttcctctcatcgttcttttcatagtcacttcaaatttccaggccttcctggtgttaaatgatgttaaaacacgtcttttctacctgactctactgagtctctaattgtattcaagctaaatttcatgtacaagttcaaatgatgaactaggaggacacatctcatagaactgagagtctaatttttttttagttgcagtaataaaatagctgctcacatttatttaagcttagtaagagccatgcgtggttctatgctttttacatgtgtttcttcttgtaatccttatgatattgagcacagttgacattccctttgtaaagacaaagaaaccaagtgtcaagaagtttaacattttccacggccacactatgaggaggagagacggaactcgagcttacttagccgtatagcagatgccgtcaaaggtacctttagaacacttgagtgtgtgaaagctaagggaaattatttctatcataagatactcactgtctacctaaagaaggagctagttttcacttttttgaaatcattttttccttcaatgtatttaaatcattaagaaatctaaaaatgcaattgtctaattgttctaattggagcagtcctcacaaaatatgttggtgtggtgaaaatgtgtttagttcttcagaattaaatattctgtagtgacaaatatacagatcaaatcatattgatataaaacatattaactagttggccacgcgtggtggctcacgcctgtaatcccagcactttgggaggctgaagcgggtggatcactaggtcagcagatctagatcatcctggctaacacattgaaaccccatctctactaaaaatacaaaaaaattagccaggcgtgaaggtgggcgccagtactcccagctactggggaggctgaggcaggagaatggtgtgaacctgggaggcgcagcttgcagtgagccaagatagtgcactgcactccagcctgggcgacagagtgagactccatcccaaaaaataaataaataaataaattaaatagttaacacaatgttatcacaaccatgcattttttacctcaaataaattatcgttacttcctatacaaagcaataaaaccctgtaacacgcacacacagagagttctgtgtcaccagtgacagctctcagccatctcctgagcttcgaggttggatactgtgcttatccagctgcctgggtaatcttaagtttaagcccagaactttcctagcatgctgctcttcccagagtgtagccacaagggctgtgtgcctattacattaggagagaatcagtgcctcagttgcacttagagccccagcaaggagcaatagaggcggagtgagatggagaggcaggtctggtcttgtgtgtgtgggaaggaaggagtttgtcaggcgaggaggctttcaagaggcctgtgggcctcctgggagaaacactgtaaaatgaaaggagaattccttagactgagctctgccttttgggtgagatattgaaatcctctggacaaaaataaatgagagacttgaatttgtgaactggaaggtcactttgaattcaaaaatcttatctagccaggcatggtggctcacgcctgtaatcctagcactttgggaggccaaagttggtggatcacttgagatcaggagtccaagaccagcgtggacaacaggacaagaccctgtctctgcaaaaagctacaccaagtgagctgagtgtggtggcatgggtctgtagtcccagctacttgggggctgacacgggaggatcacttgatcccaggaagttgaggctgcagtgagcgaagatcgcaccactgcactccagcctgggtgacaaagtgagactgtctcgaaaaaaaaaaaaacttattatctatctgtactttgcccagcaacatggactagtatgagcaacttgtccttttcttcaatttttttaaatttaacaattattatttcacttagagaaggttgacatagttagaagaaaccaaacaagattcaagcgtgaacaccatgatgcgtgcatctttgcagatatttcccatgtgtgtacaagtagcctgccttttctgtacctgaaaatgggatcaaaatatagatattatttgaaacgttcaactgaaaacgctttaccatggaaacacattcatgaaggcagtacagtgtgtcatacaacaatctatttggccattttaggatggtaaacatttaagctctgtccaacttttcagtatgagagagggggctacagtgaagaagcccctactggagcaggatgtattaactctctagattgaaacatctgataatttagaatttgactgataggaccgaattatcccctcccctcatttttctagatatccaacaagagtataagggagtgtcctctctgtgcacaaccaaaacctgatatcatcaattagagtttcacaaatgcactggggaaaatgacaatgtttaatgcactgctttcaatcaattatacacttgggaatcttttcctacatttattatttatgtttgttcttcctataaaatacctatttgtacttaatggttgctaagctctttgctgactgtgagatgatctttttatattacttttctagaagagtgtgtggtgaacagactcttagggggccatgcggcacccccacctgctgatgtccgtgccctagggatccttttctccttgagagtgggcaggacccgtggcttcctttcaaccaacacagcaaactgacagtgataggctacatgtgattatgtgtacaggattatgtgattacatatggaattgtagcactcaactgtggagtctccctctcaccctctctctctcccccaaccccactcctaacctggtttgagccatgctaggaagtcccaggtgacaaccgtgtgtggcccccaggaactgatggtaaactctggccaaaagccagcaaaaaacttaatgcctcattcctacaactgcaaggaactgaattctgccagctgcccaactatcttagaagtggattctaccccagctgagcctcaggtggcaatgaagtcccagccaacacttgatggctgctttgtgagaccttaagcagagacccagctaagctgccaagccatgcacagacccctgacccacggaaactatcaggtaatgcatgtgtgctgtttgaagctgttgcgtttgcaataataatgttacaacacagtagttagctaatgcaaaaagtattcaaatgggagattgctcccccaatctgtccttctatgtagctctgttttctagctcttgagttgttcctggtggcatctggtcctgcggagaggataaacctgggtaacagagaatgctataaaattatcttgctacaaatactgttggctttctgtctctctccctcatttggagacaaagaacgggtattgtcattaaaggcattaaaaagtggctcaaatctcttcttctgattttgaagctacagtaaatgacaccacatctttaacttaggtacttctttctttctcataggttctattcttaaaatataaaaggtaagaagaaatgatagtcacttcaacttgtcatataacactttacagtatttttatatggactctttttaaaagacctatcattgtccatccatcataaaaactgaaagaaaaacacatttgctaggagatatagatcataccccaaagttcggcttggctatactttttatactttcagttccgtagacgcctcagcttttcaacaccctgacgacatgccccttccgtgtctcttgttgccagcaaagaatgcaggaaaggtaattttgtaactgcagttgtaaaagaaagagactgattagctcttctttgttccataatcctctaatgtaattctttaaaattaaaaagcggagagataaaatagtcatgaagatcaaaatgacaattgaaggctggcatatctgctgaacaagctctaatattaaattattgtcaccagaagaaaaaaatgcaaacatctcagataacttactcagtatacaaagaaaaacagtcaagaaacagaaacacaattgaatcaaataagcatggcaaaataatatcttgaatatagggtttcaaagctaattatgttgacaagttctagtctcagtacatgagtcaataagcaggcacagtgactggaagaaatctttaccaacaccttccctaggtcaactcttcaacgagtgttttcacaaaatgttgatgacaaattaatttgaactcactaaaaataatggctggaatcaagtatattacatagactgagaacatttatttatttattaaagaaacagtgaatgtgtaagaaaccagaatgatgcttggatacttgcaagagtgcccttcagttctccaggactttaagatttatgaagtccaaacaatgtaaacaaatgaatgaaaaatcagcaagcaagaataacactttttgttttttgaaatggaatttcactcctgtcgcccaggctggaaggcagtggtgcaatctcgactgactgcaacctctgtctctagggttcaagcgattctcctgcctcaacctcccatgtagcttggattacgggtgccagccaccacacccagctaattttttttttcgtatttttggtagagacggggaagaacaacattttttaaaggaccctaaacctacagtttcctacatcatgactaataatttttaaacatagtaactgacaaaaaaattagatcaaggagagattgggtgatcaacatatgatagaactagaagtggactcaaagatgggtgggcttgagatacatggaaacaaagctcaaagttatggtcgatgaggtggaatagaaaactcctcaatggcgagaaaactgaaggtatagttagggtgtacctggcctggctgaattggaagtcacaagggcagatttgaaaagactgattatggaggactttgaaagtcagtttgggagagagatgctgtaccctacagagaaaagcatgtacagtacttaagaaaacaagatacatggccagtaaatcaaaaactgcttttctttccacactcagtgtcctgttggtattacatcctggaggtcattagaaaaactccagaacagcaagagtaaccatcacaggacttgaagggaaaatgtttaaaaatgtctaatgttctagcttccaataagtagatgatgttcaaacaaacatatgaccccttggctgcatgagagtagaaaggagcaaggcctaacataagttgcatataaatctgcatatttcagggactagtcccatgacagtagtgtacgcttccgatccgaccttcagctttaaagagcaatgaatcaatgtctgagaagggtggccctgagcatcagtgtttataggaccatttacctgcttgacgtttcaactggccctcactgagctaatgaaaaacacaaagttttcttgtctgttctccggctgcttctcctcaacatcctcatcttcagttcatgatgttgttcctgttcccttcctcctccattatttgacatagattagggtagtcatagccttttgtaaaggggaatgaacttgccagatagatggagagaacaaaccacttgactgggcacaaagcacaaccacttctatgtgggtagaagatcctgcagcaaggaggatgaacagcagaaggaaaaacccccagattcttgccagaacagaaacccatacttagtgtccttgggctgacctgttctaactggaatagtaaaaaacacacccctgggtggagatctaagatgctagtgagccatgtgatatatgtgctagcatgcagagcagtggcacatatgcatccggaagaccactggcaaagtcaaaatggaaactcctagaaagcactcagagattcatcctctttgttaaaaatgtgatgtagccatggaataccatgcagccataaaaaagaacaagatcatgtcctttgcagggacgtgggtggagctggaggccattatccttatcaaactaatctaggaacagaaaatcaaataccactgttctcacttataagtgggagcaaaatgatgagaacacatggacacatagaagggaacaacacacaccggggcctgtcagagggtggtgggtgggaggagggagaggattaggaaaagtaactaatggatactaggcttactaccttggtaatgatataatcggtacaacaaccccccatgacacacatttacctatgtaacaaaacttcatatcctgcacatctgccctggaacttaaaagttttttttaaaaaaaaatgtggtgtaggtgaataggaagggcccatgcgttacagttatactgaactgagtgattctgtttggcacatgccataattctttaggtgagcaaaattatgagtataatccttttcaagagtcaagtcttcccaattctcttcctatccccagtcatcattgttaaggatcatatcagactaaaaatgtgtatatcttccctaaatcacagtagttctacccagatcacattaatcaataaaactaattccacctaacagtaacaagatgactattctcacctgaatttcccttgatattatttatattttttaagtatggggcattacattcaaaatctgtattgtttccatgtaaaatggagcatggatgttgaacaagtgaactgcaacctcatgaatatagctgaaaccataagacaaaaacaaaataccctcacagatggattggtcttatgttgtccacaggaattctattttatgaagaaaggggaaaagagacacaacaagaattgcaagacatttggagtgcgcagaaattgtctgatgaattgttagtttcttgtaaaaatgtgactcttcttagtttgccaaggtctctcttctttttgtgaagtgccgatcatactctgcaatgctcgactatcccagctgtattatacatcaaagtacactactttcctaccaaataaaagggatagtttgaaatgtggtgactaaaattgttgatggactttgaacattcataaggcccatcctttgagataaaagtgaagatagactctaacttcagtggaatccaccattttcacaggaagtgaaaatttactcagagcgccgccaggaaagattttaggaaccacagttatgtcactaactatcaaggaggtgtaattttatagaaaagggaatgatgagagtccccgacatcctttacaggaatatcaacttcaggtagaagaaaattactcatttgttagagatcaatgaagacactttctgttaaaaaagaagaggaggaaaaagtttctctaaatagaggcatagacattcttcagtcatcttgaaaatgactgcctgcaatttataattaatttcaaaggtttttcattcatcagagatcactctccaaataattcaaattttaatctaacatttagccctttcttatataacacgaatgatatcagagtatactaaacagtaaaagaaaaaaaataattcactcgaacagtatttttatatgaaagagcataattatcccctgaagtctccccataatataaacattatggacaaggagcttgaatctctgttttgttgtaaaactattaaaaaaaagaagattagacagcattgaatgatggataccgataatagaggcactgatgataaagaagaaatcttctgaattaattgcacaatttcatagtatagtatattcttcatgaaatcagtgtgagctaaatggtctgtgaaagattagtgaaaacgttattagattttgatcacttttattgaaaggaaggtagagagatgacagattgatagactctacctatctatatttaaaatatataatacatagataatgtttatatacagataaatgcatatagtatacatcaggtattacacatatacagatatatccattgcatttttactatctcaaagttagaagccatattttactacctagcacccaatgtggcattccctaagtgagattacgtgtattctctgtatcagaattacctgggatgggcgtgggtagaaaataaatagatttctacctccatccaaaatccacttattcagaatcatttggaaaagaagccatggaatttgcattgaatcaaaattgaaacaagtaattcttaggcacacaaagtttacatagagtgttcaaaaactgtgtgtcatgcccaccctgactttgacagctataatgataacggtgacaggcgtgttcagtacagaaagcagagggttgctgcaacactttaggaaaacgctcagtgccttgcaaagttgctttaattccatcggggttcatggtttataattatctgaataattcagacaaaaagttgtagttatctctatcatatccacatcatattagtttttcttgaatttcattgaggttgaagctccccaaaatatatcacgccaaaaagtaaaaaataaaaagcactggaatctgactgatattttatataatataaaatattgagtgtcaacatgattggattggaggatgaaaattacggttcctgggtgtgtctatgaggatgttgccaaaaaagattaacatttgagtcaacggactgggaggggcagaccctccctcaatgtgggtgggcaccagctcatcaactgtcatcttggctaaaagaaagcccacatgctgagtcttcaggtcttcatctttctcctgtgctggatgcttcttgtcctcgaaaatcggactctaaggtgttcacctattggactcttggacttacaccagtggttttccggggtgtcttggactttaggccacaggctgaagactgcactgttgacttccttgctccacagcttgctgacagcctattgtgggaattcactttgtgctcctgtgagtcagtactacttaataaactcccctttatatatacatttatcctatttgttctgtccctctagagaatcctgactaatacagtgaaaaaaactgggaagagacaccaacaatttgactccttcatgtttatgttcttgatctcatgtctattataatgatagcttttaaaacatagcattatatgcattactctccgctttacaaaggatgaggcaaacttacattaaaattataagcatcaagtatcaaattatgagcattaagatgcaagtatcaaagtatccaaggatatttgggtggaatgacaacactgaaatattcctttcccttttataacttttaccaagctaaaactagttcaggatttcaaccagtaaattgcaaaatgtatcagtaaaataaaatacgtaagttatttttaacaaaaaaatatgcctgcatgatcttttttcttttcattccccaaagaaattttagatggggataaatgttgccaccgtaggtcaaagtgacactgactctaactgaagttaatttgttgaaatgttattccttggtggaatgtttacaacacatttagagttggtggatgagacagggtgcctaatggatgacaaaatctctcatcttcatagaacaaagatatttgaagataaataaacattctgcaacttccctaaagcactgatggcattttcctctcccataaagtacaggttgatacaaatggtttaaagaaaattgcaactgagctcagaaaagagaactgtttcacactctgcatccaaagaggttgatctgctggagggaaaaaacaaggtgtgcattatttccataaagctccctataatcagtcaatttcagctggctcaattatacaatgtccttctattctttttcctgtaaagggaattttaattccgttacttaccaacctcagtatcaaggactaaagtccatccaaaatagacatactggttaatcaaaggtcacttaaggtcattttaaagtccttatggaaaagactgacttacttccttgcatttaggcatgaatacctaagtgcaattatttgatttttataccaatcagttgttctggaatggacaactagtttgctaagcacaatgatcatgtaattgaaggcaaggtaaaaaggttgagttccttgaggattaattcatttcagtagagccgaaacatctatttctatttctttggctcaggttgcatatccatgccaggtctacagtaaaaaaagaaaaaaaaaaatctgcccctggttgctgtggtggctgtgccacagcgtcagattggttggacttgtttaccactgctggtctcttagtccaagttcctactttcctatcctaggagacaacaggctggtaatatttccatacaacccaaagacacaaatactgtagactgtggaagatctccgcctttacacaagtatcttcctctgatttgttagttgatcaaataaaacttaaattaaaaaagaagacatacttgacctttactatgtgcaactacgcatgcaacttcttagttatcttacagagcgaagtgagctcaaccagaagacatacaaaaggccaaagggaaaaggtagcttaaattgcatgtatgcaacttgtaatggcttattttcactatgagctcagcagaaaaattaccagaggcagatttaaaattcagcgcaatagagagtatttaatatgccatttgcattttgacagcttagaaacgtcttcactgggtttgctgtatcgtctgcttataagcacgaaccagccaccgagctttgtttatctgtttcttaaaggaagcagaaccattttcttgacatttttaaagctgggttggtgtttgcttgacacaataaactggagagtaaggaagcattgcccccgggaggagctgctttcgcctgtagaagcttcagcactgtggttgtggcagtcgtcttaccaagcatgattggccagctgaaagccaatataaaaatagccattctctctcttcccgaggcctctgccagtgagatgcttgagacatgggggaattctaccaccctgcactacttgccatttgcttctctggacttgtttgatgagacctcattgccctaccattcaagtttacaaaacctgtcacttccgaagaaagactcccttttgcgactaactacatgagtgctccagaagcactgaaaagctttccgctgaacagttctgatttgaagtcatagtaattagtaataatatcctgataatgcaacaggaaaaaaacatgatctgctcagcaatacagagatattaacttcattttaaggggttcacatttttttttttgagatggagcttagcttttgttgcccaggctggagtgcaatggcacgatctcagcctactgcaacctccacctcccgggttcaagagattctcctgcctcagcctcctgaatagctgggattacaggcatgcgccaccacgcccagctaatttcgtattttttttgtagagatggggtttcactatgttggtcaagctggtctcctgacctttgatgatccacccacctcagcctcccaaagtgctgagattacaggcatgagccacagcatccggcccacttttttattgctggatggggattaggggtttcctgcgaaagtatcttcttcacaggagtgtcctggcttcatcaggaggaagggtattgggtgcggctctgccataaaggagtctgacctgcaaattaaaggtcttagcatacttcttggtgggatgagtctttaataaggtaactcatctaaaaccatgcaggtatgggagggcgcacctctctcgcggtggagttacagggtttctctggaaactcagcagtgcgtgctcacatctctgctgggtgggtcaggaaatgtttgaattacttactttaacgaatgttccacctttctctttcgggcttctcaaaatgaggctgctctggcgtagtagtgttgtgtgtgctctcctttaggacgctttctgggtaagtaattgtctgcaaatacctgcattctcatggctgcacatatgcaagaaacaactgagaaggaaacttcttccaaacagccagtagatcagccccgggtaaaggggcagatacgagccagcatacacagaattaatattcctgtttaccagatgaaaatgcttacagccttactccttttcccctggtccctgaaaataggcatttaaagagaaaggcacacttgggattcaacctttacaatgccattaataatccagaagaaaaaggaaatcgccagtgaattttcgatatccccaacgctttattgaagagtacagcaccatcagctgaagctgatactcaagtacccacagtaacgggttccagtgacctcaactgcgaccgcctccagcctcacgactccgcaaacaggtcacgaattatgccccacgcatcaaaaactctgcgcctgccttcgccacagcgggagccgccacccgggcgcgcgcggcgcagctgcccacggcagtggccgggcgccctcctgccggagcgctcctccccgggaaagccctgctgcttgcaagcgcctccggtgggccctggagcgcgctgccgagccccggggcccagcgccgacgcccccggggggaggcccgaccttggtcacccgggctttgctaggcaaggggaacgcgacgccgccccaatggccagagcgcacaaacggcgactccggcgctggcgtcaccagcccccttcctgcctgcagccccttcccaggccggtacaggagctcgcacttgaccccgcaggcgtggaggagacacggtccctggtccctgtggggttaatgaaggagctccacggacccactgcctcgtgggccagacaatagcgcagtgagagctacgtccgagcgtcctggaccccctccgcgcgcacacacttgcgcacagcacctctccagctccatgcacgccaggggcctgggaccctgggctccacttctcggcttctacagccaggttctgggacctgcagcgcgcaagaggagctctcttccacggggctgccccgcagggcccgaggcgcccaggactttgcaacccctgccctgttcgccccagaatcatccagagcagcccccgcccactacctggccctccacaccctccctcccgcctccgcctcagcctcatcctagcgctgcagcccacccgcgtgggggcggaatccgcccggcacacacgtgtgcggattattaagcagccgagctagggccgccgcggtctccacgcagcaacctctgctaattgcgggggaaggcagccggagcgtgcggaactcgagggaaccgagagtgagctcagaggctgagttgcctgcctggaaaggaggaagccccgggcccagttaggcttggagtgcaggggaaagggcgggaagttttgcggagttgcgtggcaggtgtttcctctccacgcaggggctcggctggaaaaagccaggtcctgtcccttgggctcctgccctcaccccgctgcgacacacacgccccagcacacctcacagggcacaaccctcttttccctagactttagctgcctcgccttccaattcccagccagtccagtgctgaccagaggccgctgccagtcgggccctgctcagcaggcgctgcctccgcagccggcaatgtcagaggcaccggccaaggcatccggactgagccgggcgggtgggcagagggtcggcgtctgcaagaagctccccagtcccgagcgaccacgagcttgggtgactaagacccactgtttgcgatccccgagatctcggggcgcattcccgcagacacccccttgtgagggtggatgccggtgaggaggagctggtgctgagcggtcagctttcacggagccctggacgccccgtggaggcaagtgcagggaggggaagcccaggcggcacgtctctcccccgctctccaggcagatctggagtttcctaatgaaccagatacagtcctccttcgccctgccaatcactcttccatctggaccactggaggaaaaggaaatgggtggaaaagaagatggaagaatctagagaggacggggaaatattatgtagggaaaaaagcaagtgaccattgaaaaaaaatcgtaagattggactccaacctttaaaaatgaaacgaaagaaaaaccctttgtagatacagatactcccgggaacatctatggaagtgctgactgataaagaaagcatctaaggaggctaaaaatgaggacaggggcaggtatttccaatgtgaaaaccaatcagtattctctctctctctgtctctctccctctttctcgccctgtctcaaaagggagcttatgttctttcccggagaataaacaagtacacaagctattgccagccttgaggtcgcagcctgtaggctacttagaagaaaacattccccaactcattcagggagaaaaccaagctcacagagccccaagcccaggagccacccagagaaactccttcccctgaccagcgtagaaggaggatacccgtgcgcccacagtgaatgtatctgacttggaagccggtccagaactcctagcctgtttcacgcaccttgccaacaccttacaacttgcaaggagcgaagtccgggggagaggaaagcgggggcgaccttctagaggcagctactcctcgccggctgaggacgttggagagggaaggaggagaggaggaatggggtgtatgggtgcgaggaggccgggccggcggagacctttgcctattggtaccaaaacccccgtagagagcccgaactttccaggccggcttcacccgggacgctttcccaggcgcgtcgggtccggggagaaagtcctgggaactgcccctcagccaccccgacccgtggagtccacgtctcggaggaggcaacaccgccccggcggagcacagttccagcccaactcgtattgggttcctttctccttgacaccctgtactgccgagaaaaagagatctctcctgtgagcccaagagagggggaaggaatggcggggtggggcgggggcccaggagggctggggagagcgcgatggaagctccctcccgtgcatcgcgttccccgagcttcggcgatggagcagcgccgggcagaggcggccactccgtaccctgcggtccccaaaacgcacactcgcgtccgcacacggggcctccgagggctctaccgcctccccggccaggagcaagtccgtcttacccttcgctgcagtgaggagcctcgcgcacagcaccagcagcccgagaagcaggagcagcgactggaatctcctccacgcagtcatgtctgcagatactccacacgcacgcgacaccgatggctcctccgaggaaggcagggctatgagcggagccaaataatcacccgagggcaaggcgagccggagagagagcccggtcccaagacccgccgcgcatccgacgcctcctgaaggtctgggcgcccggctcgcttccctctcatagcatcgggtcccgagccactgcagggctgagctgctccgagcgcggagacccgggctggcggggccggggccggggacgagcgccggccgagccgggcaggaaggcaccaaggcggcgaggctgcgggagggggagaagcggggagaggagcgcgcgcagccaggagagacctggagaggaggcagctggagagagagccagcgagtggg
